United States Patent 9,200,291 (COMPOSITIONS AND METHODS FOR CREATING ALTERED AND IMPROVED CELLS AND ORGANISMS) - sequence listing, part 3

SEQ ID NO: 4925 - DNA, 2475 bp, Saccharomyces cerevisiae
atgatgaatttttttacatcaaaatcgtcgaatcaggatactggatttagctctcaacaccaacatccaaatggacagaacaatggaaacaataatagcagcaccgctggcaacgacaacggatacccatgtaaactggtgtccagtgggccctgcgcttcatcaaataatggtgccctttttacgaattttactttacaaactgcaacgccgaccaccgctattagtcaggacttatatgcaatgggcacaacaggaataacatcagaaaatgccctttttcaaatgaagtcaatgaataatggaatatcatcagttaataataacaacagcaacacccctacgattattaccacgtcacaggaagaaactaatgctggaaatgtacatggcgataccggtggcaattctttgcaaaattctgaagatgacaacttttcttccagttctaccaccaaatgcttactctcttccacttcttcgctatcaataaatcaacgagaagcagcagcagctgcttatggtccagataccgatattcctaggggtaaactagaagttacaataatagaagcacgtgacctagtcactagatcaaaggattcacagccttatgttgtttgtacttttgagagttcagagttcatttctaatggtcctgagtcactaggcgccattaataataacaacaataacaacaacaataatcagcataatcaaaaccagcatattaacaacaacaacgaaaataccaaccctgacgctgctagccagcatcataataataacagtggttggaacggttctcagttaccatcgataaaagagcacttgaagaaaaaacccctttatacacacagatcatcttcccaattagatcagctaaactcttgctcttcagtaaccgatccgagcaaacgttcttctaattcttcgtcgggttcttcaaatggtccaaagaatgatagttcacatccaatatggcatcacaagacaacgtttgatgttttgggatctcactcggaattagatatttctgtttatgatgctgcccacgaccatatgttcttaggccaagttagactgtatccaatgattcataatttagcacatgcttcccaacaccaatggcacagtttgaaacctcgcgttattgatgaagttgtgtccggtgatattttaatcaaatggacttacaaacagacaaagaaaagacattatggcccacaagattttgaagttcttcgattattgggtaagggtacttttggccaagtctaccaagttaagaagaaagacactcaaagaatttatgcaatgaaagttctctccaagaaagttattgtcaagaaaaatgagatcgcccacacaattggcgaaagaaatatcctagtcacgacagcgtccaaatcgtccccattcattgtcggattgaagttttcctttcaaacaccaacagatctgtatttggtcactgattatatgagtggtggagaattattctggcatttacaaaaggagggccgtttttcggaagacagagcgaaattctatatcgctgagttagtcctagcgttagaacatttacacgataacgatatcgtttacagggacctaaagcctgaaaacattctactcgatgccaacggtaacatcgctctttgcgattttggtctttctaaagctgacttgaaggatagaacaaacacattttgcggcaccacggaatacctggcaccagaattgttactggacgaaaccggctacaccaaaatggtcgatttctggtctctaggtgttttgatatttgaaatgtgttgtggttggtcccctttctttgcggaaaataatcaaaaaatgtaccaaaaaattgcctttggtaaagtcaaattccccagagacgtactgtcacaagaggggaggtcttttgtaaagggtttactaaacagaaaccccaaacatagactcggtgccattgatgatggaagagaactacgagctcatccatttttcgcagatatcgactgggaggccttgaagcagaaaaaaattccaccacctttcaaacctcacctagtctcggagacggatacctcgaattttgacccagagttcacaacagcttcaacttcatacatgaacaagcaccagccgatgatgactgctaccccgctatctccagccatgcaagcaaagtttgctggtttcacctttgttgatgagtccgccatcgatgaacacgttaataacaacagaaaattcctacaaaactcgtactttatggaacctggttcctttatcccgggaaatccaaacttacctccagacgaagatgtcatcgatgatgacggggacgaggacatcaatgatggattcaaccaagagaaaaatatgaacaacagccattcgcagatggacttcgacggcgaccaacacatggatgacgaatttgtcagtggaagattcgaaatatga

SEQ ID NO: 4926 - DNA, 2475 bp, Saccharomyces cerevisiae
atgtcaaagctattttctactgtcaattctgcaagacatagtgtaccactaggcggcatgagagattatgtgcacattaagaaactagagatgaatacagttcttgggcctgattcctggaatcaattaatgcctcagaaatgtctactaagcttagatatgggtacagattttagtaaatctgcggctacggatgatttgaaatattctctaaattatgcagttatttctcgtgatttgacgaatttcgtcagcaaaaaaaagaattggggttctgtttctaatttggctaaatctgtgtctcaatttgttatggacaaatattctggtgtcgagtgtctgaatttagaagtgcaggcggatacaacgcatattagaagtgaccacatatcttgtattattcaacaagaaagagggaatccagaatcacaggaatttgacgttgttaggatatctgagttaaaaatgttgactttgattggtgttttcacctttgagagacttaagaaacagtatgtaactttggatataaagttgccttggccaaagaaagccgaattgccaccgccagtgcaaagcataattgataacgttgtcaagtttgtggaggaatcaaatttcaagactgtggaagctcttgtagaatctgtgtcagctgttattgcccataacgagtattttcaaaagtttccagattcgcctttggtggtgaaggttttgaaattaaacgcaatcacagccacagaaggtgttggtgtaagctgtattagagagcccagggagattgcgatggtaaatattccatatctttcctccatacatgaatcgtctgatattaagttccaattgtcttcatcacaaaacactcctattgagggtaaaaatacatggaaaagagcgtttttagcgtttggttcaaacattggggaccgtttcaaacacattcaaatggcgttgcaattattatcaagggaaaaaacggttaaattacggaatatttcgtctatttttgaaagtgaaccaatgtatttcaaagatcaaacccctttcatgaatgggtgtgttgaggtggagacattactgaccccaagcgaattattaaaattgtgtaaaaaaattgaatatgaagagttgcaaagagtcaagcattttgataatggtccgagaacaatagatctggatattgttatgtttttgaatagcgccggagaagatattatagtaaatgaaccggatttgaatataccgcatcctagaatgctggagaggactttcgttcttgagccgttatgtgaattaatatcccccgttcaccttcatcctgtgacagcggaacccattgtagaccatttaaaacagttatacgacaaacagcatgatgaagataccttatggaaattagttccattgccttatcgtagtggtgtggagcctagatttttgaaattcaagaccgctacaaaacttgacgaatttactggagaaacaaacagaattactgtttcacctacatatatcatggctatcttcaacgctacaccagattcattttccgatggaggtgagcattttgcggacattgaaagtcaattgaatgatatcattaaattgtgtaaagacgcattatatttgcatgagagcgtcatcatcgacgttggagggtgttctaccaggcctaactctattcaggcgtctgaggaagaagaaatacgcaggtctatcccattaattaaggccattagagaaagcactgagttaccgcaagataaagtcatactatccattgatacttatcgttccaatgtcgctaaagaagcgattaaagttggagtggatattattaatgatatttcgggaggtttatttgacagcaacatgtttgccgtaattgcagagaacccagaaatttgttatattttatcacacacacgtggtgatatttcaacgatgaataggctggcgcattacgaaaattttgcattgggtgattctattcagcaagaatttgttcataataccgacattcagcagctagacgacttgaaagacaaaacagtgttaatcaggaatgttggtcaagaaattggcgaaaggtatatcaaagcgattgataatggagtaaagcgctggcaaattctaatcgaccctggacttggttttgctaagacctggaagcaaaacttacaaattattagacatatccccattttaaagaactactcattcaccatgaactcaaacaattcgcaagtgtatgttaacctcagaaatatgcccgttttattgggtccatcgcgcaaaaaattcattggacatatcacaaaagatgtggatgcgaagcaaagagactttgctactggagcggtggtagcgtcgtgtattggtttcggcagcgacatggttagggtccatgacgttaaaaattgttcgaagagcattaaattagcagatgctatttataaaggtttggaataa

SEQ ID NO: 4927 - DNA, 2478 bp, Saccharomyces cerevisiae
atggagaatacactgggtgaggggtccacggtaaacgcttccgtggacgtggaccaacatggcaatgacaacaatagtgatagcaacgctaatgcagctgtggcaggggttgccaatacagatactgctggtgaagaatcgcagcaacaagatgagtctctgaaggatgaagcaactgttccgaacacacgcgatgcagaaagtgaggcgataacggtaacggcaaagcagcagccgactatgcaagcgaataagctagattcccaggaaacaccttctacagaagaaagcagggcccagaacgtctttggccaagataatgaggatagtgataatctctttggcgaaaccgagagttctgtttcgaacaatgaggcaaacactcctagtatacctacgaacccggtagacaatgaaaacaataagcctgctattaaggaagacagcacaatacaggattcaaatggtgacgttaaaaacatggaggacgtcaaaatacaaaaagaggaagaaccagagaataacactgttattgaaggtgtcaaagaagaaagtcagccagatgagaacacaaaggaaatggatgaagtggaagaagatgatgaggatgacgatcaaccgatgattagtcctgataattccatttttggagacacaaagagtgagtctaaacaactaggcaacacttcgtcggttgctaatactccatctgaaattccagatgcgcataaagctgaacaggaggatatcatagaaaagacggaaagtgtagataagaaggtagatagtggcgaagagagaaacgaacaggaacgtgaaatcatgaacgatcactccaaaagtgccaatccaaagaaaaccactatcaccagagtagaacccgaaacttttgagataccgcaagcacatgaaattgttattccaagttattctaaatggttcaatctagaaaaaattcattccattgaagttcaatcgttacctgaatttttcaccaataggattccatcaaagacacctgaagtttacatgagatacagaaacttcatggtaaattcttacaggctgaaccccaacgaatatttcagtgtcactacggcgaggagaaacgtctctggtgatgctgctgcattattcagattgcataaattcttaacaaaatgggggctaataaactatcaggttgactccaaactattacctaagaacatcgaacccccactaacgtctcaatattccacaaggcatgatgcccccagaggactattcccattcgaaagttacaaaccatctgtacaactgccggatatggcaaagcttaaaaaaatgatgaacactagtgattcggagagtactttatataaatatttgaaagaaagcaaaagaaaatatgatgaaataactcacccccccagtaccactgatgatgaaaatggtgacaaaaatgataatggtggtaaaatgaacaatgaagtaagtacgtcaacaagcatgactggtgatgccaatctattggaagaaggcgaaacttcacgtcctctgaaaaaagtcaaaattctagaacaaattgatgaaaattggtcaaaagaagatttgcaaaagctattaaagggaatacaagaattcggcgctgactggtacaaagtggccaaaaacgttggcaataagtcgcctgaacagtgtatcttacgtttccttcaattgcccattgaagataaatttttatacggtgacggcaatggcaagggtgataatgacaacgggttaggacctttgaaatatgctcctcacttgccattttcgaagagcgaaaaccccgttttatcaacaatagcattcttggtgggtttggtcaatccgaagactgtacagtcgatgacccagagagccattcagtccgcagaatcaataaaatcacaaaaagaggaaatctctgaccaaaagccaattgaacatattaaagaaggttcagaaattgccatatcatcattgggttataggagtcatattttcgctaccaacgaggaaaggcaaatgaattttttgactaacgagctaataagacttcaaatggaaaaattggacgctaaattaaatcatttaaagaaactagaaaaatttatggagctagaaaggaaaaccctagaaagacaacaggaaaacttactaattcagagattgaacttcaaccaaaactccagcaagattgtaaacgttttaagcaaatgcttgaatttaatatccgacagcaatatcaataatagttcagtggcggagaaggaggaaatcaggtcgcagatagaccatttcaaaagtatgctatcgaaacctgaaactttaagtattggaaagaatccatttaacaaacctaatattgaaacaggtgaaaaccataatggccaaagtatatctaacgagaatgatgtcaaacccatttctattgaagcacctcaattttacaggtattggtcggcataa

SEQ ID NO: 4928 - DNA, 2478 bp, Saccharomyces cerevisiae
atggataacttcaaaatttacagtacagttatcacaactgcttttttacaagttccacacttatacacgacaaatagattatggaagcccatagaagcaccttttttagttgaatttcttcaaaaaagaataagctccaaagaacttaaaaacacaaaagcaatctgtcatatagatccctcatgggtcaatctaaatgcttctttcattagagatgacatgatctcaataaaagctaccacagatgatatggacctcgatgctatttgcaggatttctttgcccttacctatgaacacaaatgatctaacagcagaattggaaaaaatgaaacgtatactattggacttgagtgaaaaattcaatttagaactaatcatcaccaaagaaccagcttacttcacaccagaacagacaggcgagagcaaggaattatgtatttacgtgcatgcattaggattccgatctaatttaatggaatgcgaaccccagttattggcatttgtcgatttaataaagaagaatggtatgactttgcctccacaacactacattatcgaacctatggaactgaactcatactctgtgcttcccttatatatgggtgtagatatggaaaacttcaaacatatatccagagcttttaaaaccagcatttacgcaccttccctcattacgctgtctagggatcttaaggcaaatccacaaatcttcttctcaggcgctgtccattcactaagtttactggctaggaaaactctacgtgagtccataagcgtgaattcaaagagttttttttatcgtcgattgactaatattaccccaggaaaactactgtttatccgaaaatactaccaacaaaaggtaaaccagttaattttgaaataccaatcgcttattagagttactaacgaatacattgaatttcaatcgatttccacgaacttattagaaatggttattaagaacttcactattcaagtattacatgaaattgtagaagtacagatttcactcaatgaaaactgcgcaatgtccccggaattaataatcgacagctttttcggacacactggaaaccaaattgtagtaataactcccaaagaggattccttcaaccaattaatagtagttggtaaccaatcttccacagatgaggcgtccgatacttccatattgcattacttatctgattttattatgggctcaaatcaagtgattaatccaaacttaagacagataaaagccattttcgagatacatcctgattttgaagacttcatatcaggcaagaaaaatggtaaattaacacgtataatggaactatctgcttgcttaattcaactggaaatggaagaggaagatgataacctttatttaaatttggttagtgactctttccctgatttcaaggaatcatttaagaatgttataaatgaatttcctgccgaagaatctttcttcattcctgaagtttgtcacagaccgattataggtacaggtggttccttaattcaagccacaatgagaaagcataacgtcttcattcagttttccaatagtttcaatcttccacaaaataaaatttctatgatcaggtatgataatgtgataattaggtgccccaggaaaaacaaagctaatatatgcctagccaagaatgatttaaaacaaattgttcaagaatatgatagtttacaatcgaagacgctcattagattttctagtgggcaatatagacatattttgcatgttaacggccaaaagaatattataggacaaatcgaaaagaacgaaaatgtttacataatgataccgttaaaagagcccttggatggaacatctcaattgagtatacaaggaaatgatgagaatgcatcaagagccgctaacgaattggttaatagtgcgtttggttatgaatacgagttcaaaatagatcaagagatagatcccaataaagaatacgaattttataacctaattgttgttccatttttgcaaattatgaacataattgtaacttttgagaaggaccttatcacttttacttttgaaaaggatactaatgagaatactctaacaaaagcaatcgaattactatccaattatttggaaacacaaaagacgaaaataatatttaaaaaaataattaaaaaatttgttctagggtctgcctccagcaagagtaacaccagtaatagcaataccaatggcaatttcagatcaatgaataatgccaaaagtcgtacgaccatcgataataccagccaatcaggagcctcaccacaacgccacaaaatgcctgttataacgacggtaggaggagcccaagccatcaaaggatatataccaaacacttattacaacggatatgggtatggatacggatatacatacgagtacgattataattatgccaactctaataaagctcaaaccaataataggcataaatatcaaaatggcagaaaatga

SEQ ID NO: 4929 - DNA, 2478 bp, Saccharomyces cerevisiae
atgtcgtcttcctcacttcgagttttagctattgggaacaacccgaatatcttgttctacacctcaaggtttcaactggccaagaatatagacctctaccacgtcaacgattcaaaatcatgtcaatttgaaattgaaactgaatactacggcaaagaccggttcgaattggaaaatcatttcacctctatcgagcacttgactgaagctttgagctccaaatcaagtgaagccgtcttcgacataatcatcatgagtgctccatctttacaggaattatcctcgttagcgtccaagttaacgtccataatcgattcgaacaccaaaattttcttagaaagcagtggtttcatccaattggaaccgtttgtcaaattatcgatggaatctccgcatgtaaacgttttcagtattttgactgatttggatattcgtcaaatcggtccaaaccatttcaaacactttcctagtactgcaaaggagaacacgatttacctcggcgaaagtaagtccagcactgagaaatattcatcaggcgttataacattattaaccacttttgaaaaactgtttgctaaattgttttccaacataaaaatcaatttgtgcaatttctcatcaattgagtttctatcacaacaatggaagctggcgatttccagaatttgttttgatccgttgttaatcatgtttgaacaagaaaacccaagtgatctagaccagcagatcattgccaaacctttaatatcaggtctggtaactgaaatcatcactgtagcaaaaacaatgggagccagactaaacagtagtcatgataatgaaaactctcttttatctctatggaagaattcttatcattcaaccaataagccacctgcattggtttatcatttcattcatcaaacaacgcctttgaacatcgatatcctgttgttacaaactattttattagccgatgactttggtatcaaaactccgtacttagaatttttatactctgttttgtcccaatttgaaagattgaatagtggcaaatctaaatggtttattaggtcagatgaaaaaactcaaatcttacaaagcttgcaaaaatcacaaaaaaatgaatctgctttacagactcaaattacctccttacaaggtcaaattagtaaactaagacaagagttgcttatgcaggccaagcaacatgaaatggaaactaatgagttaaaggagaaacatcaagtcgctctaaaagcccaggcccaagcccaagctcaagcccaatctcaagctcaaacatcaattgaagcactaacgccaactgaagcaacaaaccaatccgatacaaatgaatataaagcaacaggaactccgaatttgagggacatcgaagatatggcactatatagtgtaaactacggagactctccagtgagatctccaccacctgttgtaagctctcagccacaaatgaactcaccattatcctcacattcacaaactttcggagagaataatggcacgaatgacaaattactacaagaacgcgaattgcaactccgtaaaaaggaattagagctacaagaacgtgaactggagttccagaaaagagcattacagcaacaaagatttaataatagcaataattcaattccaagaaagccttccttccctcaattacagcagtctgcaaacgttcgttctaacagcagaggaatgcatggcaccaatggcgctatgtctcaacctgcatccgccggaaattttgtagacccaatttcttcaagtatcgctgcatatgacccgcaacaacctccttccttacccctacagcagccacaacaatcggtacaagtacaaccttttcactcacactctatcaagcccacaagtaggaagaatagaaatagtaatatgcctaatattggtaatccttccagtataaatatgagtgattttggcagaccaccgaacaattcaagtcaaactcgcttaaattccatgccaacgcatagcatcgtaaaccagaatagattgagatcacaacaatcgaaaaacaaactgaatatgccacatgccaccaacccaaacaatacttttaaccaagtccctgctcctagtttaaacaatcacgttcccacacaaaggcaatttagctccagtaccatgatagaagttacaaataataacaacaaagttaataacagtagtagcaaccctgatatttccaccaactcggtagttcataacgcaatgcaatttacaaatacaaacaacaatacaagtagcactgtggatataaacgatcccaaaaatattgcaccccctcctacaacctctgtttcagccccaagcactccaaccttgtcctcatcaagtcaaatggcgaatatggcttcgcctagtaccgataatggtgacaatgaggagaaaaatggtggtaagaagaagagatttggcctattcaaaaaaaaaaataaatcaaagaaataa

SEQ ID NO: 4930 - DNA, 2478 bp, Saccharomyces cerevisiae
atgttgctactttcttggtcaagaattgctactaaggtagttagaaggcccgttcgcttccggtcctattacggcttgacccatatcaagagtttacatactcaatatcggctactcaataggctgcaagagaataagagcggtaacaagaacgaggacaataacgaagacgctaaacttaacaaagaaattcccacagacgaagaggttgaagcaataagaaaacaagtagaaaaatatatcgaacaaactaaaaataatactataccggctaactggaaagaacagaaacgcaaaattgatgaaagtattaggcgtttagaagatgctgtattgaaacaagaatctaacagaattcaagaagaaagaaaggaaaaagaggaggaaaatggtccttcaaaagccaagtcaaacagaacaaaagagcagggctactttgaaggtaacaatagcagaaatattccaccgccaccaccacctcctcccccaaaaccacctctaaatgatcctagtaatcctgtatcgaaaaatgttaacttattccagataggactaacttttttcctcctttcgtttttattggatctcctcaacagtttggaagagcaaagtgagataacgtggcaggattttagagagaaactattggcaaaaggttatgttgcgaagttgattgttgtcaacaagtccatggtgaaagtgatgttaaatgacaacggaaaaaaccaagccgacaattacggtcgcaacttctattatttcacaattggttcaattgatagcttcgaacacaaacttcagaaagcacaggacgaactggacattgataaggatttcagaatacctgtactatatgttcaagaaggcaattgggctaaagctatgttccaaattttgccaactgttttaatgattgcaggtattatttggttgacaagaagatcggcacaagcagcgggcggtagccgtggaggcatatttggtctgagtcgttctaaggctaaaaaatttaacactgaaacagacgttaagatcaagttcaaggacgttgccggatgcgatgaggctaaggaagaaattatggagtttgttagcttcttgaaagaaccttctcgttatgaaaaaatgggagctaaaattcctagaggtgcgattctatctggtccaccaggtaccggtaaaactttgcttgcaaaggcaacagcaggtgaagccggtgttccgttttattttgtttctggttcagaatttgtagaaatgtttgttggtgttggtgcagcaagagtaagagatttgttcaaaactgcaagagaaaatgcaccctcaattgtgtttattgacgaaattgatgctataggaaaagcaagacaaaagggtaatttttcaggtgccaatgatgagagagagaacacgctaaatcaaatgttagtagaaatggatggtttcactccagctgaccacgttgttgttttagctggtaccaatagacccgatattctcgataaagcattattaaggcctggtagatttgacaggcatatcaatatcgacaagcccgaacttgagggtagaaaagccatttttgctgttcatttacatcatttgaaacttgccggggaaatttttgatttgaaaaatagattagcggctttgacgccaggcttttctggtgctgatattgccaacgtttgtaacgaggccgccttgattgctgctagaagtgatgaagatgcagtaaaattgaatcattttgaacaagctatcgaaagagtcatcggtggagtggaacgcaaatccaagctactctctcccgaagagaagaaagtagtggcttaccacgaggctggtcatgctgtatgtggatggtacttaaaatacgcagatcctcttctgaaagtcagtattattccacgtggccagggcgcccttggttatgcacagtatttgccaggtgatatcttcttactaactgaacagcaacttaaggacagaatgaccatgtctctgggtggaagagtttctgaagaattacatttcccatcagttacaagtggcgcatctgatgacttcaaaaaagttactagcatggccacggcaatggtcacagaattaggcatgagtgataaaattggctgggtcaattaccagaagagagatgatagcgatttgacaaaaccattttcggacgagacaggtgacattattgattccgaagtatacagaatcgtccaagaatgccatgacagatgtacaaagctgcttaaagaaaaagcagaagatgtagagaagattgctcaagtactactgaaaaaagaagttttgacaagagaagatatgattgatttacttggtaagcgccctttcccagaaaggaatgatgcttttgataagtacttgaacgattacgaaacggaaaaaatcaggaaggaagaagaaaaaaacgaaaaacgtaatgagcctaagccatctacaaactga

SEQ ID NO: 4931 - DNA, 2484 bp, Saccharomyces cerevisiae
atgcatagcaacgtatttgttggtgtcaaaccaggctttaatcataaacagcacagcaaaaagtcacgtttcctagaaaatgtctctagtcattcaccagaactgcctagtaactatgattacgttttgcttcctataacaacgccaagatataaggaaatagttgggcaagttttcaaagatttccaaagacaatccatacagaactggaaaccgcttcaaattcctgaaccgcagttgcaggatatctgtatacccccgttcaacgtcaagaagctagacaatgacgatacgccgtcttacatagggctgttatcctcttggctggagctggagagtcgcgatccaaatgtaagagatcttggcttaaaggtccttctaaacgaatgtaagtacgcgaggtttgttggaatcaataagctaatattggcgcctccacgggacctgtccaacctgcaattgtatggacagatgatttacaggctcctgcaaaatcgcatcgtctttgctgcgcctgcgttaaccatatccatttctctgccactttacgaagacagcgatccattggccacttgggaactgtggaataccgtgcggaaacaatgcgaatatcatccctctttgactatctctttggctttgccaagaaccaggactccttcgtatgtgctgaatagatggttagccgaacccgtctcgtgtcttttggtatcttcatccatctttgccagtaatcagtacgattatcccgttttacacaagtttaaccagaatttgattttaaagttccaaaaggttaatggagattcacaaattttgggtaatgaattatgcgtgatattgcatgggatggagaaatatgccaataatgttaagggcggagaatctgcctatttggaatatataaactacttattgaaaaagggcgacaaagtattaaattccaatagtaatcaccaatttttgctccaagaggactctcggataatgccgcctctgaaacctcattcagataatttattaaattccacatatttgacttttgaaaaagatttggtgaagtacgatctttacgaatctgccatattagaggcgcttcaagatcttgctcctcgagcgagtgccaagagaccgttggtgatcctagtagccggtgcgggaagaggacctttagtggatcgaacttttaagataatatcaatgttgtttatggatagtaaggtttctataattgccattgaaaaaaatccacaggcatatctgtacttgcaaaaaagaaatttcgactgttgggataatagagtgaaattaatcaaggaggatatgaccaaatggcaaatcaacgagccgtcggaaaagcgtattcagatagatctgtgcataagtgaactgctgggttcgttcggttgcaatgaattatcaccagaatgtctctggtctattgaaaaatatcattcccacaatgacacaattttcataccgaggtcatactcttcatacatagcacccatttcgtcaccattattctaccaaaaactctcacaaacaaatcgctctttggaggcgccctggatagtccatagagtgccatactgtatattatcctcaagggtaaatgaagtgtggcggttcgagcatcccatggcccaaaaagatactgtccaagacgaagatgattttacagttgaattttctcaaagttcattaaatgagttcaagataaagcaccgcggcgaaatccatggctttatcggattcttctcggcaaacttatataacaatatattcttgtcaactttgcccaatgacagcacagtccgtttaaaatttagcgaagaaacgttgatgaataccagacgagaagaaaatctaatcaagaaatgtgaccatacaccaaatatgacctcgtggtctccaattatctttcctttgaagcaaccaatatcctttatagatgactccgaactttctgtgctgatgtctcggatacactccgatacagaacaaaaagtttggtatgaatggtctttggagagtttcatataccttatgttgtcaaattacacttcggcggtaactgctgcaagcatgactattccgaggtctatagttacagatgacactaaaactttagcccataatcgacattattcagcgactaccaatcaaaagctagataatcaaattgatcttgaccaagacattgaaaacgaagaagaacagggattcctatccaatctagaaactggttggcaaagcgtacaagatattcacggactcagcgaaaccgccaaaccggaccatttagattctatcaataagcctatgtttgatctcaaatctactaaagcgcttgaaccctctaacgaattgccaaggcacgaagacctcgaggaagatgttccagaagttcatgtcagagtcaagactagtgtttccacgctacataatgtctgtggcagagccttttccctgcctctgtga

SEQ ID NO: 4932 - DNA, 2484 bp, Saccharomyces cerevisiae
atgcctagcccatatgacggtaaaagaacagtaactcagcttgttaacgagttagaaaaggcagaaaaactatccggtagaggcagagcttatagaagggtttgtgacttatcacacagcaataagaaagtaatttcatggaaatttaacgaatgggattatggcaaaaatactatcactttgccatgtaatgcaagaggcttatttattagcgatgatacaacgaatccagttattgttgctagaggatacgataagtttttcaatgtaggcgaggtcaactttaccaagtggaattggattgaagagaactgtacagggccttacgatgtcactataaaagccaatggttgtatcatttttatatctggtttagaagatggtaccttggtagtttgttcgaagcattctactggacccagagcagacgtagacaggaaccatgcagaagcaggtgagaagcaacttttaagacaactggcggcaatgaacatcaatcgaagtgattttgctagaatgctatatacccataatgtcaccgctgtggcagaatattgcgatgattcatttgaagaacacatcttagagtatccccttgaaaaagctggcctatacttacatggtgtaaatgttaataaagcggaatttgaaacttgggatatgaaagatgtttcgcaaatggcgagtaaatacggattcaggtgcgtccaatgcattacatcgaacaccttggaggatttgaaaaagttcctagataactgctctgcaaccggatcttttgaagggcaagagattgaaggttttgttatcaggtgccacttgaagagtactgaaaagccattttttttcaagtataaatttgaagaaccgtatttgatgtaccgtcagtggagagaagttactaaagactatatttccaacaagtcaagagtgtttaaatttagaaagcataaatttataaccaacaagtatcttgatttcgcaatcccaatattggagtcatcacccaagatctgtgagaattacttgaaaggttttggtgtgattgaattgagaaataagtttctacaatcatatggcatgagtgggctggaaatcttaaaccacgaaaaagtggccgagttggaattaaaaaacgccattgattatgataaagtagacgaacgcactaaatttttaatctttccaatatcagttattggatgtggcaaaacaacaacttcccagacattagtgaatttgttccctgacagctggggtcatattcaaaatgatgatattacaggtaaagataaatctcaattaatgaaaaaatcattggaactattatccaaaaaagaaatcaaatgtgtcatagttgacagaaacaatcaccaattccgcgaaagaaagcaattatttgaatggttgaatgaactaaaagaagattatttggtgtatgatacgaacatcaaggtaatcggcgtgtcattcgcgccatatgacaaactatcggaaataagagacataacactgcaaagagtaatcaaaagaggtaacaatcaccaaagtattaaatgggacgaattaggagagaagaaagtggtaggcatcatgaatgggtttttgaaaagatatcaacctgttaatttagacaaatcaccagataatatgtttgatttaatgatagagttagattttggacaagcagactcttcattaaccaatgcgaaacaaatcctcaatgaaattcataaagcttatccaattttggtaccagagatcccgaaagatgatgaaattgagacagcgttcagaaggagcttagattacaaacctactgtgagaaaaatagttggtaaaggcaacaataatcaacaaaaaacgcctaagttaattaaacctacatatatctcagctaaaatagaaaactacgatgaaattattgaattggtcaagaggtgtattgctagcgatgcagagctgactgagaaattcaagcatttactagctagtggaaaagttcagaaggaacttcatataacattaggtcatgtcatgtcgtcccgtgaaaaagaggcaaaaaagttgtggaaatcatattgtaacagatacactgaccagataacggagtacaataacaaccgcatagaaaatgcacaaggctctggtaataaccaaaatacgcaggtaaaaacgaccgacaaactgaattttaggctcgaaaaactatgttgggatgaaaaaatcattgctattgtagtggaactgtctaaagataaagatggatgcataattgatgaaaacaatgagaaaattaaagggttgtgttgtcaaaacaaaattcctcatattacgctgtgcaaacttgaaagtggtgttaaggctgtttattccaatgttctatgtgagaaggttgaatctgctgaagttgatgaaaatataaaagtggtgaaattggacaactcgaaggaatttgttggcagtgtatatttaaatttttag

SEQ ID NO: 4933 - DNA, 2484 bp, Saccharomyces cerevisiae
atggaaggtttgaagaaaaagatttttggtgtttgcctgaaaaatgacttagcacagactaggaatgaaacgaaaggaatccactatgggttaatgactttggaaacttctaaacaactgcaggaatttctccatttgctagtaataaagagagaagtaattcaaaattttgagttgttatttcacatcataaatgttgccgttaaaatcaccgattcaaatcttccaagtgatgatatctggcatttcattttaaaattaagattttcttctgagattaatatagacgaagactccaaagttttaaattatttacttgagactggcatcgcaatggaaaatccagtcagttggaaatgcttggccgttattagcagcatcctcagcagtgtccctcaatccaaaaagattataactaacctgatcgagacagaacatgccaaaaagattggtcagttgtttgataatattcaagatttgcaacaaggaaattttctggtggaaattctctctaactgttttaaaaaaagtgcttcaaattccaagaaagtggaaaaaatacctcagttatggcaaagcaggtctaagaacaagtttttctttgaaaatgaattttacccttttagcagcaaaaatgggagcttacaaacctgccaattcctgtgcaataatttcatgtcaactttatcctttacgggtattctaaggcaggtttcttatagcggatctgaaacattaaaaaatctccgtatatttaagaaaaaagacgatgaaaattcttacttcattcagtgcatttacaacaaaatctatctttggttagacgaaaaagcccctttggaatttgaaagaaagaaaatcaggattaccaaaaacttaaaaaataaaattcaaattaaattgaggcaacctttccatgaatgtgtgagaactaccgctgataaaacagcactcttatttaacaaaacgaaggggtttcagctggaatttgaagacgagaaattaggtgaaactttttttcacaatgtcaacaatatacctaagattagtgaagtacaaaactttttagttttagactatattgaagaagaaccagagaatgaaggtgaagaagaagagcaaatcggaagggcagatgagcagaaagaggatgaagaggaagaatctctcgatgaattatccactcccatggtatatccaataaaatcatctattccccataatcataacgaaaaggttcagttagtcactcccgaccgttctgtttccataagatctgatgaatgggatttaaagtcaaatactgaagacgaagaaggtaatgttcttgcagacctgaaaataagcagcactaaggaaacaaaaaggcaaacagactacgtccatattgattcagaagaccagtcaccagtagtatccgctcagatgagaaaaatgagaagagaatctacgaaaacactagaaatattgagacaagagtttaaagataaggatgtacaaaacaaagaagaccagtccgaacaaatacaaaacccgtttgtaaatacatcctcgttagttgtaggtaaatcctgtcttgttaatcctaaggaaaagcctaatattgatcaaacggtagtcggaataaccgaattaaagtcaaattcttccattaagaaaagggatatcaacattctcgacactatatttgggcaacctccgtccaagaagcaaaaacaattccacaaaaaggagaaaaagaagcagcagaaaaagttgacaaactttaagcccattatcgatgtcccttcccaagataaacgaaaccttaggtcaaacgctccgacaaaacccaaatccataaaagtaagtaagctgcgtaccgataagaaagttacaggggaaaaatcaagcccagaaacagcggcagagaaagttgatgatcaaactgtgcgtagcaacgatgaacaagcaatgagcagagcaactaaagaaaagtgctttccagatgtcaatgaaggcaaagaaattactaaggatgacgctaaagtatctctcgagtccaaaaaaaacaacgaaacttttgttgattcaagtgtagtagaaaaacatacccccccagacaaagactgtaacaattgtaacattacagatattttggaatctaccactgttatcgacttgcagtcaccccatggattatctgctcctggtcagaatactttcacaaacaaacttcaagaacaaatttatagttcaataaatcatttttctaacgaattggtaagaaaaatttcgataataaaccaagagttaaataagaaaatcttaaaagagttgtccgaaaaataccaaaaactattctccgaattacaagataatttccagaatgataccaatgagatgcttaaattcatgggcgagatcaaagacatgatgaatctcccggaagatcagctcgttcatgctattaggacaagaaaatttgataacaacaagagataa

SEQ ID NO: 4934 - DNA, 2484 bp, Saccharomyces cerevisiae
atgtctagtccagatgattttgaaactgcaccagcagaatatgttgatgcattggatccgagtatggtcgttgttgacagtggttctgctgcagtcacagcgccatcggattcagccgctgaggtaaaagctaatcaaaacgaagaaaacactggtgctactgctgctgaaactagtgagaaagtggatcagacggaggtcgaaaagaaagatgatgatgataccactgaagtcggtgtaacaactaccacgccttccattgctgatactgctgctaccgctaacattgcttcgacatcaggtgcatctgttactgaacctactactgatgacaccgctgctgatgagaaaaaggaacaagtaagtggtcctcctctgtcaaatatgaaattctatcttaatcgcgacgcggatgcgcatgactctttaaatgatattgatcaattagcgcgtctgattagagcaaacggtggtgaagtgctagactccaagccaagagaatcaaaagagaatgttttcatcgtgtcaccctataatcataccaatttaccaacggtaactccgacttatattaaggcatgttgtcaaagcaactcgctactgaacatggaaaattatttagtaccatacgataactttagagaagttgtcgatagtaggttgcaggaggaatcgcattctaatggtgtagataatagcaatagcaatagcgataacaaggattctatcaggcccaaaacagaaataatctctacgaatactaatggcgctacggaagactcaaccagcgaaaaagttatggtagacgctgaacaacaagctagattacaagagcaagctcagctccttcgtcaacatgtaagcagcaccgcatcaatcacaagcggagggcacaatgacttggtccagatcgaacaacctcaaaaagatacctccaataataataatagcaacgtcaacgacgaagacaatgatcttttgacacaggacaacaaccctcaaacagcagatgaggggaatgcatcttttcaagcacaaaggtccatgatttcgagaggcgctttgccctcccacaataaagcttcttttacagatgaggaagatgagtttattttggatgttgtgagaaaaaatccaaccaggcgtacaacacatactctttacgatgaaatatcccattatgtgcctaaccacacgggtaattctattaggcaccgatttagagtctatctttccaaaagactagagtacgtttatgaggttgacaagtttggtaaattggttagagacgacgatggaaatctgataaagactaaagttttgccaccatcaattaaaaggaaattttcagcagatgaagattacactttggcaatcgcggtcaagaagcagttttatcgtgatttgtttcaaatcgaccctgatactggaagatcacttatcacagatgaggatacacccactgctatagcgaggaggaatatgacaatggatccaaatcatgtgccagggagtgaacccaactttgcagcttacagaacccaaagccgtaggggaccgattgcacgagaatttttcaagcattttgccgaagagcatgcagcacatactgagaatgcttggagagataggtttaggaagtttcttctcgcttacggcattgatgattatattagttattatgaagctgaaaaagctcagaatagagagccggaaccgatgaagaacctcaccaatagacccaagaggcctggcgttcccactcctggcaattataactctgccgccaagagggcaagaaattatagttctcaaagaaatgttcagcctactgccaatgcagcgtccgctaatgctgctgccgctgctgctgccgctgcttccaactcttacgctataccagaaaacgaattactggacgaagataccatgaatttcatttccagtttaaagaatgatctatccaatatttcaaatagtttgccctttgagtatccacacgagattgcggaagctataagaagcgatttttcgaatgaagatatatatgataatattgatcctgataccataagctttccaccaaaaattgcaacaacagatcttttcctgccattgttctttcattttggcagtacgagacaatttatggataaacttcatgaagttatttcaggagattatgagccatcacaggctgaaaaactggtacaggatctttgcgatgaaactggtatacgtaaaaatttcagtacgagcatattgacgtgtttatccggggatctgatggtctttcctcgctatttcttgaacatgtttaaggacaatgttaatcctcctcccaacgttcctggtatttggacacatgatgacgacgaatcgctaaaaagcaatgatcaagaacaaataaggaaactggttaaaaagcatggaactggtagaatggaaatgaggaaaagattttttgagaaggacctgttatga

SEQ ID NO: 4935 - DNA, 2484 bp, Saccharomyces cerevisiae
atgttcaaaccagtagacttctctgaaacatctcctgtgccgcctgatattgatcttgctcctacacaatctccacaccatgtggcacctagtcaagactccagttatgatcttttatcccggagttccgatgataaaattgatgctgaaaagggtccgcatgatgaattatctaagcacttaccactttttcagaaaagacctttgagcgatactcctatatcgagcaattggaactctcctggaatcactgaagaaaatacaccttctgactctcctgaaaatagcgctactaatttgaaatcgctacatcgattgcatattaacgacgaaacgcaactaaaaaatgctaaaattcccacaaacgatactactgactacatgcctccttcagatggagcaaatgaggtaactcggattgatttgaaagacattaaatcacctacgagacaccataaaagaagacctaccaccatcgatgttcctggtttaacaaagtctaaaacatctccagatggtctcatatcaaaggaagatagtggatcaaagttagtgattgtcatggtcggactgccagctacgggaaagtcatttattacaaataaattatccagatttttaaattattctttatactattgtaaagtgtttaatgtcggtaacactagaaggaagtttgctaaggagcatggcctaaaggaccaggattcaaagtttttcgagccgaaaaacgccgactctactaggttgagagacaaatgggccatggatactctggatgaattgctagattatttattagaaggttcaggatctgtgggaatttttgatgctacaaatacctctcgtgaaagaagaaaaaacgttctggctagaatcagaaagagaagtcctcatttgaaggttttatttttagaatctgtttgttcggatcatgcactggtacagaaaaatattagactcaaattatttggtccagattacaaaggtaaagatcctgaaagctctttaaaagattttaaaagtcgcctggcaaactacttgaaagcctatgaaccaattgaggatgacgaaaatttgcagtacatcaaaatgatagatgtgggaaagaaagtcatcgcatacaatattcaagggtttttagcttcgcagacggtatattatttgttaaatttcaatttggctgacagacaaatttggataacgagaagtggcgagagcgaagataatgttagtggccgtataggcggaaattcccatttgactcctcgtggtctaagatttgctaaaagtctaccaaaattcattgccagacagagagaaatattttatcaaaatctcatgcaacaaaaaaagaataatgaaaatacagatgggaacatttataatgactttttcgtttggaccagcatgcgtgctaggactatagggactgctcaatatttcaacgaagatgattatcctatcaaacaaatgaaaatgttagatgagttaagtgcaggtgattatgatggtatgacatatccagaaattaaaaacaactttcctgaagaattcgaaaaaagacagaaagataagttgagatacagataccctggtattggcggtgaatcgtatatggacgttattaatagactcagacctgttatcacagaactagaaagaatcgaggataacgttcttattattacacaccgggtggtggcaagagccttattgggttattttatgaacttgagtatgggtattattgccaatttggatgtcccattacattgtgtatattgcctagaaccaaaaccatatggaatcacttggtcattatgggagtatgatgaagcatcggattcattttctaaggtcccacaaacggacttgaataccaccagagtaaaggaggttggccttgtttataatgaaagaagatattctgttataccaacagctccgccaagtgcaagaagcagctttgcaagtgactttttgtcaagaaaaagatctaatcctacttctgcatcttcatcccagagtgaattatcagaacaacccaagaatagcgttagtgctcaaactggcagcaataataccactctcattgggagcaactttaacatcaagaatgaaaatggtgattcgagaataccattatctgcaccacttatggccactaatacttctaataacatcttagatggtggaggtacctcaatttcgatacatcgtcccagggttgttccaaatcaaaacaacgtgaatcctcttttggctaacaacaataaagcggcttctaatgtacctaatgtaaagaagtcagcggctacaccaaggcaaatttttgaaatagataaagtggacgaaaagttatccatgttgaaaaataaaagttttctattacatggaaaggattatcctaataatgctgataataatgacaacgaagatataagggcaaaaaccatgaatcgcagccaaagtcacgtttaa

SEQ ID NO: 4936 - DNA, 2487 bp, Saccharomyces cerevisiae
atgctgtttggagtgaagttggctaatgaggtttatcctccttggaagggttcttatattaattatgagggcttgaaaaaattcctgaaggaagatagcgtgaaggatggaagtaacgataagaaagcacgctgggacgattcagatgaatccaagtttgtggaagagttggataaggaacttgaaaaagtctatggttttcaactaaaaaagtacaataacttgatggagagattgtcccatctggagaaacaaacagatacggaagcagccataaaggccttggacgctgatgcattccaacgtgtattggaggaactgttaagcgagtctaccgaattagacaattttaagagattgaactttactgggtttgctaagattgttaagaaacatgacaagctatatccaaagtatccatctgttaaatctttgttggaagttagattaaaggaattgccttcccattcggaagaatattccccattgttgtatcgtatttcatttttgtacaacattttgagaagtaattttaacactgcatctgaacccttagccagcgcttctaagttttctagcattgtcagcaatgacatagacatgaatttcagaagctttaaattttgggttcataatgacaacttaatggaggtcaaaacaagaatcttgagacatcttcccgtgttggtctacgccaatgttccctccgaaaacgatgacctggtcaatagattcgaatcagatatatcaaataatgatgaaattgtgggtagttcgagctccactagtagcgtagaacatggcttgggagcgcgctccttcgatccattaatcaacacgctatattttgacaatgagcattttgaattatataacgacaagttattaaagttaaattcagcacctactttaagattaaggtggactggccagttatctgataagccggatattttcttggaaaagaaaactcttattgaagacgaagccactgggaagtctgaatttgatctaactaaattgcaattgaaacaaaaattcattaacgggtttattttcgaaggtgataagaaatttaaagaacaaactttgaaaaagttaaaagaaagtggtacggcagggagagacctggaaaggttagaagaagatttctctgagattcaaaactttattatcaagaatgaattgcaaccagtttttagaactgtttacaccagaactgctttccagattcccggcgatgacaagataagagtaaccattgactctaatattgtattcatcaaggaggattcattcgacagagagcgtccaattagagaccctaatacctggcatagaactgatattgatgccaatgttgcaaatcccttgaaattcctgagaggaggcgagtatgctaagtttccttattcagtaatggaaattaaagtgaaaagttcattagattcttcgatgtctgccagttctatgatttctaatgtaaaactgcctaaaaagcatggtcaatggctgaacgatttgacaaattctcatttggtcaaagaaattccaaagttttctatctttgtgcaaggtgtggcatcattgtatggagatgatgaaaaattagatatcttaccattttggttaccagatttggaaacagatattagacaggatcctaagcaagcatatgaggaggaaaagaaaaaactgttgaaacaaaaagagatacaaaagaaaattgatggaatgagaaggctttccaacttaaaagagcctcaacatcaagcagcagtaccggtatctcaagaggaaaatgagcgtattacctctcaaggtgatttggaggcagacggttcatccgatgaggaaactgagcaagaacctcattcgaaaagatcaaagaaagttcggagaagaaaacccaaggccactttcttgagaattttggccggtagagatccaaagttaatgggggtggattctgaagaagaagaaattgaattgccacctggtgtgaaaaaaccattaaatttgttaaaaaatgctggtcctgtaaacgtggaggcaaaggtttggcttgccaacgaacgtacatttaacagatggttaagtgtcaccagtttattgagtgttttgacgttctcaatttataattctgtgaagaaagccgaataccccactttggctaactacatggcatacgtatattttggtctaacgatattctgtgctttatggtcctattccatttatatgaaaagagttgatattattcaacaaagaagcggtcaacatctagatgcaccacttggtccagttttggtttctatagttttatttgtcactttagtggttaattttgttatggcgtttagaaatgcagcaaagtctcgtcaagagttgcaaatacagaatttagaagttcctgaaagaataccagaagtattaaggccacttcaaaattatctattcaagttaatggggccaagcagtgattag

SEQ ID NO: 4937 - DNA, 2487 bp, Saccharomyces cerevisiae
atgttgggtaatttactgagaaataagacgagttcgtctggttttgagaagagctcagagcattccgatttttcctccgtagttcccaatgtccctgtatactgcaaagcggcaagcacaggaactactaagaccgctgctggagctcttttagatactgcagtcaatgtggaaaagccttcggaaatgctatcaacgacttctccgcccattttagatcatatatcggatgacttaaaactgaagcttttcggctcgagggatattccttatagtcgtcctatcgatacgttacaaaacaacggaggtcttggtactgataaaatcacgtctattaacgaaaaaacgtatgcattcaggattttgatcattgaggaagcgggtcaaatggcgtgtaggaacaactaccgtgatatcttcgattacactacgtcaaagatttcaaattcgatggagcagatacggccgagtgaattgaaggaatatatatttggttctcccgtaagatcttccgatttgacgcagtgcgacaagataaggacgattcctaactcggatttggtactcataactagaattttctattacacacaccaatacaaccgcatcgcaattagcttatgcataccgaggatattgttgcccgtagttgcagagtcgtggtcttccatttcatcatggttgacccagactcaaaaaatgctcattggtttcttgactaaaaaccgtattatgcaagaaaatactggcaattacagcaataattcagtcataaaattgtcaaatattgacatcaggacgcattatcccaaggaaattgaaataatggtgcaaactttacaaaaaagagtcataccaggtttacgttctatgtctgagattcctaggcttttcctttaccctgagacatttaaagaattcgttcacgtttggttcaaaagtatatttaattggattgaaatcaaagatggaccgaaactaggcttccttcctctcctaatggcaatgattatatctgattacaggcacactataagagaactaaagacatccaagatcgtaatcctgtcaggaaacatggtggttgctaacaagttactgttcatcttatcggctttattggagccaaagtacaagggacaaataacgatacggcgggaaaacataagatcggattcgtccgctgtatcaagaaataagtctaacaataattttgtcgataagcctgagacggaattgagcacactgacttcaacagacaaccttttgagtcgcacagaaaataatagcaatcataattacaacaacagtaatgtgagctctaacagcattggatcacccaatttccattctttgaggaaaggatggcaaatacccaatcggaggaactcgaacacttcagtatctgtgtcttctagtgagtctttagcggaagttattcagccatcttccttcaaaagtgggagtagttcattgcattatctatcgtcttctatctcaagccaacctggttcgtacggttcttggttcaacaaaaggccaacaatttctcagttctttcaaccaagcccttctttaaaacacaacgagtcgtgggagaggctgcaaacaactgctggaaatatgcaaaggacttcaagttcgtcttctttgcagcaagcaacctccaggttatcactaaccactccgcaacaatcaccgtctatcagcgaatatgatgagtatccttggatgggcacacctggctctcctaatgttggagatgtgtctcacgcacccccattggttaagaatatatcatataaatttccactaaagaacgttgagttgaaaagagattgccaaaggatctctcaggatgatcttttggatgaggcttttgaaagaatatgtcagccctctttggctgaccttaattccacttacgaaatttttccaggtaactcttcttatgcggatattttgactactgattctgatattgatgatggcttgatgaataaacctctggaactattgccgaaatatacaatgtatttaacccattttaacaattttttccagttgcaagcatgtcctgctggtcaagaatcagagagcagaataacaaattctatgaagattgacctgttaaaggcggattacacaagaagtctattagtatcgttacgttcaagggacattagggatgtcgcattgaaaagagagtttactggcaataacaacaataacagcaaccagaatatctatgatgagaattttgtcggaaaaaggaagtacgtgttgaaacagaagaccagaaaaatcttttcctgtggcaagattggcaagctaagtactagtttggaaaactgcgttaattttgttgaaaatagtataaagagtgcaatgatgttatatgatgataatggaatagatagtgagcttcgcgattcagaagctttacggattttttcatctcttgttcattattgtaatgcaggttaa

SEQ ID NO: 4938 - DNA, 2490 bp, Saccharomyces cerevisiae
atggccaagaggaaatatggcaggtcttattccctcgatgatacagattcctgcagcaataaagtcctgatagtaccaaccggtcaaagctcctctaacgcaatcactgatttctctgtcagaaaggcgcatgcttgcgatagatgcagactgaaaaaaatcaagtgtgacggtttaaaaccgaactgttcaaactgtgcgaaaattgacttcccttgcaaaacctcggataaactgtcgaggagaggtcttccaaaggggtatacagaactactagaaaaagaggtcgtccgtttgacaaatatgaatgcgagttccagcgccaatgcaaattctaatttgccgttcattaatgatacattttattgttttgataattacaacactcagtctgaaaatcaaaggtttttgggacatttgacatggaatattctaactaatacttttcctactcaaaaagcagtagtttttacagacgatcgaaataatattgatctacaactgcaactgttaacaaattttttgaacctgaatggtgactttaatcatctcccaaattttcttttacttaaatatgattataaccttcagtttttgaaaaatttgttgtctgtcattattaaagatttttttaaaaggcaaaattctttgctacttctattataccctacaaatttatggaaaaatttgctattagacaagattaattcaaccgcaatgacaggtgaacccataactctactggcgttactttatattattcaatttacttggtcttgttttgatgatttcaagctttttaaagtcacgaagcttattgtttctctgacaacaaacagcaaattagacttgaaagttttgcaattggttaacttatccatcttttattttatgggcgcctctgttgactcttgtaaaagtaaaagctcgttaacagaacattcaaatgtaaattcagtaatatggaccaatgatttgctaaacctaaactttacaaatattttgaatatgggattgtacataaatcccaaaaatttaattcctatatcaggcaacaataataataataaatctaatgaagaggatgatagaatagtgacattttggtgctttcaattcttaagctcatggtggtccttaattcaaggtttaccaaagtccaactttttaactgaagaatttcaaccgaaatcaatctcggttctagaaatccccaggctgaagccctttgaaattttgttaaacttcatcatatattctttggatggatgtaatttgttgaatatctcatctttaaatgtttcggacccaaatttccaatttttccagaatgaactggaaagctttaaaaaaaatttattactgtggaacctttatcacaatttgagtgatcacgataacttccgattcttaacatccagttcaaataaaaaactaacaacaaatttactacttaagaatttgacgggtctaaatcacaaactcaatcaacctgattttgtggagattcaattaactttattttacttgagtttaaaattaatgactttaaaggaaggggaccaagatttgaagaaagaggatatctcgttagagatattgtccctatattttttaattcttacagatgactctaataatgatgataatcaacagttacaaccacagcaactaaatctctaccattttacgcccttcaatagtattgacattattgacttatgtttaaacaatttaaacaattggtcattatcacttaaatacgaaagtggtcaaaaccagccccactcaagtaaaataaagtttgaaaaatttcaaaactttttaaatcactggtgtccaatatggtactatgatgaattttccacaaacccttttttacaaatcctcaaaatcaatttcaaattacttccttttgagacaatccattactcacaagaagagcaacgattgttaataagtttgaataaattgagatatttggatgccgtatcgagctttaattcaagttcagtcaagtcgaatttcgcgtctaaggtcaatacccagctaaaccttttgcaacactcgagttctaactccaatttcctagatgcgtcaccatacgattttaataaaatttttatgaacaactttgaaaactatgactacgaaacagatgaaggatatgcggaagatgatgatgaagaggatagtgacagtgacaatagcttaccactagaaattccttttaaaaaaagtaaaaataaatgcaagaataggaataaagagctttcacaaaggttatccctatttgaaaacagagatagcaattcggtagatttcaacacagatacaaatttaaatttaaaccctgattcgccatcagttacgtcttctaagaaaaaatatttagatcatattattttagataaccgagacatcgttagcaaccatgactccagtaaacaaaaattcaagatccagaatattttgaactcgaccttctaa

SEQ ID NO: 4939 - DNA, 2493 bp, Saccharomyces cerevisiae
atgaacttgaagcagttcacgtgcctatcatgcgctcaattactcgctattctgctctttatctttgcttttttccctagaaaaatcgtgctgacaggtatatcaaagcaagatccggatcaagaccgtgatctccagcgcgataggcccttccagaaattggtgtttgtgatcattgatgctctcagatcagactttctttttgattcgcagatttcccacttcaacaacgtgcaccaatggctcaatacgggcgaagcatggggttacacgtcatttgctaatccgcctaccgtgacgctgcctagactcaaaagtattactacgggatctacacctagcttcattgacttgctgctgaatgtagcccaggacatagattccaacgatctttcggagcacgattcctggctgcagcagttcatccaacataataacacgattcgtttcatgggcgatgacacctggctgaaactgttcccacagcaatggtttgacttcgctgacccgacacactcgttctttgtcagtgatttcactcaagtcgataataatgtgacgaggaacttgcccgggaaattatttcaggaatgggcccagtgggacgtggctatcctgcattacttgggtcttgaccatatcgggcataaagatggcccgcattcaaagtttatggctgctaaacatcaagaaatggacagcattctgaagtcaatatatgatgaagtgttggaacatgaagatgacgatgatacactgatttgtgttcttggcgaccatggaatgaacgaactgggcaaccatggtggctcttcagccggcgaaacatcagcaggattgttgtttttgtcacctaagctggcgcaatttgctaggccagaatcgcaagtaaactacacattgcccatcaacgctagtccggactggaatttccagtatttagagactgttcaacaaattgatatcgtccccaccatagcagcactgtttggtatgccaatccccatgaacagtgttgggataataatacctgactttttacaactgttgcccaataagttggcaagtatgaaagaaaattttatgcatttgtggaaattatcagaccatcacggcgaggttgctcttgacgatttcactgccgaagatatttatacaaagatgtacactattcaagaaacgttaaccaagtctgcaacaaattataattatcctcttttgacactggcttttgttggtttcctcataataacaatcatcgccatttatgtattattacgttattctgggcctgatttttggcagttgcgcgtttcttccctgtctgttctgttagtttccattatactaggcgtttccacatttgcaagtagtttcattgaagaggagcaccaactgtggtggtggatagtaactgcattctcggcggtccctctgttcgtataccgattgaatgtgctcataatcgtgcgctggtttataatgatggcatgcgtacgctcaatcaagttttggaataacagtggccagaaattcatttattctaacgttatgtccaatctacttaatcagaatccttcctggaagtggtgcttaaatatgttgacatttctagtgctgataatggcatctgctggttttcaagtactacattttattgtcactactattttggtggggttgtgtttcacgtacaaaatctcgtgggaaatcgtcaatggtaaccaggcagaaataccgctctttatgcatgatttactggctaagatagactttgcaccaactgaaagtaacttgattgtacttgcgcgcgttttcttccaagcttgggctattgttgtcatttcaaggttggtcctgacgaaattgaaagtacttaacaagaactacctcattaaagatatgaaagtttatataacaattcttttgatgttccaaacttcttctcagaacataggtcaatttctcgttttccaaatattagagtcccaaattttttactttttccaaaatattccaaccgcctcattaacatcaacaagtaagatttatttttcgaatttggtgtccttaattttacaaaattttacatttttccaattcggtggcacaaattccatttctactatagaccttggaaacgcataccatggtgtttcctcagactacaacatctacgtagtggggatattaatgtccgttgccaatttcgcgccggcaatatactggtccatgctaccgtggtcaataaactacgcctctattccagcacaagttaagttgcaaacgttcatcagaagtaagttacctgccttcacctatcattgtatatttggaacttgtttgatgacggcatgcgtcgttttgagatttcatctctttatttggtccgttttcagtccaaaattatgttattttcttgggtggaattttgtgatgggattgctgaatggctggttacctgaattggccctcctttgcgctcttgattaa

SEQ ID NO: 4940 - DNA, 2493 bp, Saccharomyces cerevisiae
atgaagacaccaacaagagtttcgtttgaaaaaaaaatacacactccaccaagtggagatcgtgacgctgaaagatcaccaccgaagaaatttctaagaggtttatcgggtaaagtttttagaaagacaccagaatttaagaagcaacagatgcccacatttgggtatattgaagagagtcaatttactccaaatcttggcctaatgatgtccaaaagaggcaatattcctaaaccactgaatctttccaagcctatatctcccccaccaagtttgaagaaaacagcgggatcagtagcatctggtttttcgaaaacaggacaacttagcgctttacaatcgccagtaaatatcacaagtagcaacaaatacaacatcaaagctacaaatttaactactagtttactccgagagtcgatttctgattctacaactatgtgtgatactttgtcagacatcaatttaacggttatggatgaagattatcgcattgacggcgattcatattacgaagaagattcaccaactttcatgatcagcctggaaagaaacataaaaaaatgcaattcacaattcagtccaaaaaggtacataggtgagaaatgtttaatctgtgaggaaagtattagttccacatttaccggtgaaaaggttgtggagtctacgtgttcacacactagccactataactgttatttgatgctatttgaaactctttatttccaaggcaagtttcctgagtgtaagatatgtggcgaagtgagcaagccaaaggataaagacattgttcctgaaatggtatccaaacttctaacgggcgcaggcgctcatgatgatggtccgtcatccaatatgcaacagcaatggattgatttgaaaacggcgagaagcttcacaggtgaatttcctcagtttacaccacaggagcagctcattcgtactgctgatatttcatgtgatgggttcaggacaccacgcttatcgaatagcaatcaatttgaggccgttagctatcttgatagcccatttttaaattcaccattcgttaataaaatggcaactacagacccttttgatttaagtgatgatgaaaaactggactgtgatgatgaaatagacgaaagtgctgctgaagtgtggtttagtaaaacgggtggtgaacatgttatggtcagtgtgaagtttcaagaaatgcggaccagtgatgatttaggggtcttgcaagatgtgaatcatgtggaccacgaagaactagaggaaagggaaaaggaatggaaaaagaaaattgatcaatatatcgaaacaaatgtggataaggatagcgaatttggcagtttgatcttgtttgacaaactaatgtattctgatgatggcgaacaatgggtagacaataaccttgtaatattattctccaaatttctagttttgtttgattttgaagaaatgaagatcctgggtaagattcctagagaccagttttaccaggtaatcaagttcaatgaggacgtactactttgtagtttgaagagcactaatatacctgaaatatacttgaggttcaacgaaaactgcgaaaagtggttgcttcccaaatggaagtattgtctagaaaattcttcactggagacactaccattaagtgagattgtttctacagtgaaggaactctctcatgtgaatataataggcgctttaggagcgccgcctgatgttatatcagcacaatcccatgattctcgtctaccgtggaaaagattgcacagtgatacgccgctaaaacttattgtatgtttgaatttgtcgcatgctgatggggaactgtatcgcaagagagttctaaagagtgttcatcaaatattggatggattaaacacagacgatttactgggaatagttgttgttggaagagatggatccggtgtagtaggcccatttggcaccttcatcggaatgataaataaaaattgggacggatggacaactttcttggataatttagaagtggttaatccaaacgtcttccgcgatgaaaagcaacagtataaggtaacattacaaacttgtgaaagattagcgtcaacaagtgcatacgtggatacagatgaccatattgcaactggatacgccaagcaaatcttggtcctcaacgggagtgacgttgttgacattgagcatgatcagaaattaaaaaaggcctttgaccagttatcttaccattggagatacgaaatttcgcaacgccgcatgactccattgaacgctagcattaagcagtttttagaggagctgcacactaagcgttatctagatgtaactcttcgtctaccacaagctacattcgagcaagtatatttgggggatatggctgcgggtgaacaaaaaacgcgtctaattatggatgaacacccgcattctagtttgatagaaatagaatattttgacctggtaaagcagcaaagaattcatcagaccctggaagttcccaacctctag

SEQ ID NO: 4941 - DNA, 2493 bp, Saccharomyces cerevisiae
atgacatctgcattaagggttttggtatgcggagatcacccaaatctcattctgtacacatccaggtttcaacatgccaaaaatatagaattttatcttgtgaacaactcaaaaaatgccaactacgaggttagttcactattttatgggacggaacggtttcagattcaaaaccatttccaatcgctcctagatttagtagaccttaataatgaaaatggtggcttggtattcgacttgataataatgagtgcgtcttcactgcaagaaatcccgcaggtattgagagatataaaacctatgatgaataagacaacaaagatactatttgaaagtagcgggtttatatatttggagccattcatcaaggcttcagttgatctttcgctgtcaaatattttcagcattttcaccgattatgacataagacggttggacaatggctcatacaaacagttcacgactgcaaatgccaaatccttttctgtttcgatcggtcaaacgacatccgttcacgaaaacagctattcaagtgatattattcctattttgaatacatttcagaaattgttccaaaaactgtttcctagggacgttgtgactctttacgatcattctccctccgctttcttggcaaaagaatgggaactagctttgcctcaaatatgtttcgatccattattaataatattagaagagaagaatccatcaaccttggatgaccacgttttggccaaacctcttatttcaggtttactaggcgagagcttattaataataaaaaaaatgggtatagccatgaacaatccaaattttcaaaatgaacagactatattgaaacattggaagaataagtgcgaagacttacctgatgggccggcacttttatataatttcatccataaggcttcatctttgaatattgacttattgttattacagccgatattattagcagatgactttggcgtgaagacaccatatttagaatgtttgtttacaatgatgactcaatatcaattgttaaataaaggtgattctgaatggtttattagaaaggatgagaacacagcgttaactcgcgttgatgatttacaaaacagtatcgcacttaaagatggaaaaatcatgcagctgcaaaattcggaatcaaccctgaaaaatgagataaaagaacttcaaagtcaagttttgagcttaaaacaagaagtgtcctcaagtaaagcaaataatggacaagagttggaaattttaaagaagaaagtgcaaatgggagacaattcattatttgatcgcccaaatagtaatactaatggtatatctccctctgataacattgttgatgttgatttaaattacgaaaggagtgaccaaggtaataatagtagtggtaatgatagcagaagacaatcttttttcaactccacatctgatacaacattatccagagatgaaacctcgttgaaagagcgtgagttagaagtacgaatgaaggaattagaacttcaagagcgtgagttagagttacagagaaaagccctccagcaacaacaacaatatcaacagagaccgcctaagcaagtatactccggtccttctggtacaccaaccagcggcaataacaataataaaagttacaatccaaatagaaaatcttcctatagtcagcctcaacatgtggctatgatgaccagcagaggtctacatggtcctagcgctgcaagctctagccctgtcatttctgccaacaattttgttgatccagtttcttctgggacgccatatagcagcaatagttctcgatttagtcagcaaattccatcgcagcaatacatgcatactgttaagccaacgagtagaaaaaacagaagtagtgtcatgcctaatataggttacgtcccagggctaaccaataacgagtatggtagaaagtttaacggtaatggtatgaatggtacccaaagccgtctgaattcactttcaaaccaaagtacgtttagatctcaacagggtccaccgataacacagcaaaaatcgtttcaaaataacggtggtagcatgaggacaaatcgcataccatctgcaaattacaatatttcaaatcagcaatcgggttttgttaactctatttcaagtccaaatctaagcaatttggagaatagaaacacagtacaaaacagtagaaatgcggattctgctccgtgcgttaatcaattgaacagtgactctccgccccaattacagtctctatctcaaaacggtacctcaaaagttcctcagatcaatattacgcaaccatcaccaattcagaccaactttgctacgagtgataaccctgctgctgtaataaaactagggacaccttctgaagatacagtttcagctgcggcaacagccaataatataagtacaatgggagatgaaagccgcaaagaggacgttaaggaaaaaaagaagaaaaagttcagtttctttggaaaaaggaaaaagtaa

SEQ ID NO: 4942 - DNA, 2493 bp, Saccharomyces cerevisiae
atggcaatcaagtcattggaatcgttccttttcgaaagaggtctagtaggatcctatgccattgaggctctgaataattgtaccctggatatagacgtcaaccattatgtttccagattgttgaccaataaaagagaacagtatttggatgccattggtggtttccctaccagtttaaaaatgtatttggaaagcgacttaaagatattcaaggatttcaatattacccctatttttgtctttaatggtggtttgacttacaaccaattagaggcatcgggccattttactgcagcatctgcttctgcgtcgatttcgtcaaccactacttccagcagcggtaccaatgccacaacaagatccaacacggaatccgttcttttgcagagaagtagaggctggacacaatggaacaacttgattagttcgaatcagaattcctatattgaccagcctattcaaccccaagagccattcagacataacaccacaattgactccaaagcttaccaaaacgatttgatcgcttattttattgagcatgggtatatgtaccaagtggctccttactcctcttggtttcaactagcatatttattgaatagcgcttatattgatgcgatctacggcccaactgattgtttgatgctagattgtgttgataggttcattttgggtatggaatttccaaataaagaatttcgattcattgacaggtcaagagtgatgaaggatttaggttgtacccatgaagagtttatcgatattgctatggctgtaggtaatgatttgcaaccaacaactttaccaccattgcaaatttatccagttcctcagctgtttgatattgctctagaaatggttttgaatacaggtacaaacttctatgcctatcaactatctacaaccttacaaaatgactccaaagagaatattcaaaactaccaaagaggtatttctgcattaagatacatgccagtcttgaaagatacaggtaaagttgaattatttgttcaagagatcgttgtttcagaggaggacagtgaaaagaataacaaggatggaaaaaagagtaatctttcctcaccatcttctgcgtcatctagtgcttctcctgctaccaccgtgactaagaacgctagtgaaaagttaacttatgaaaaatccagcactaaagaggttagaaaaccaagagatattcctaatgatgttcatgattttatcggccaaatgttacctcatgaatactatttctatagatccataggactggttactggaaaattatttgacgcaattgtcacaggagtttatcctgaagagcctccattgggcggaggatcttctacatcctacaagaaactggtttccaagtccgttgaaatcttcaagaataaagaaatcaatttattaactcaaccaattaacagatactatcagattaaacaaattaaacaagtcaagtggtatgcggcaaatgagcctaccactttgaccaacaggatgtcaccttctatgtttgaaactatcaaccacttaattgttaaaacagaaacgtctgatgaaaaggaattttctatctctgagttcattacaacaataaatggttctagcaatatggcgaaagattttatatctgaaaaagtcattttcccaaactccgtaccaatcgaatccaaattaaactcaccatttaatttattgtcgaccaatttcttaagattactagtactattggagttcttcacttttgatttcaaggaaaaactgctagagcctacgagatggggtgaggtattcttaaaattaaatgagctcaatattgacagtaagtatcacgaatcagttattatctttttggtatttttgaaatgcgatgtcttaaaacttgacgaagaagttcaaccaccggctccctcagccctatctcaagccactcttcgttcatatcctgaagaatcattgtacgtcctattgattacgcgtgtattaactttatttcaagtggaccaaaagccatcaaattaccacggaccaattgataagaaaactttgatctttagagatcatctttctttcataaaggaaaatttaaatgaactttttgaagccgttttgatctcatctttaacttctggcgagtttaatagattatcacttgataactttggttgggcaagaaagattgttagatatttaccgttcaaattagattccccaaatactataatggctatgatgtgggagtttttcttacaaaaatatcttcacaatggtaatgccaagaatgatgcattgtctttagttgctactgaattcaacacttacaaatccacaccaaatcttgatgaacagtttgtcgaatcccatagatttcttcttgaaatttcaaaagtcatgcaggagctaaatgctgcgaaattaatcgatgaaaacgtgtttaaattattcactaaagcagttgagtttactacaacagctctatctagctga

SEQ ID NO: 4943 - DNA, 2496 bp, Saccharomyces cerevisiae
atgtcattaacagcaaacgacgaatcgccaaaacccaaaaaaaatgcattattgaaaaacttagagatcgatgatctgatacattctcaatttgtcagaagcgatacaaatggacatagaactacaagacgactattcaactccgatgccagtatatcacatcgaataagaggaagtgttcggtctgataaaggccttaataaaataaaaaaagggttgatttcccagcagtccaaacttgcgtcagaaaattcttctcaaaatatcgttaatagggacaataagatgggagcagtaagtttccccattattgaacctaatattgaagtcagcgaggagttgaaggttagaattaagtatgattctatcaaatttttcaattttgaaagactaatatctaaatcttcagtcatagcacctttagttaacaaaaatataacatcatccggtcctctaatcgggtttcaaagaagagttaacaggttaaagcaaacatgggatctagcaaccgaaaacatggagtacccatattcttctgataatacgccattcagggataacgattcttggcaatggtacgtaccatacggcggaacaataaaaaaaatgaaagatttcagtacaaaaagaactttacccacctgggaagataaaataaagtttcttacatttttagaaaactctaagtctgcaacgtacattaatggtaacgtatcactttgcaatcataatgaaaccgatcaagaaaacgaagataggaaaaaaaggaaagggaaagtaccaagaatcaaaaataaagtgtggttttcccagatagaatacattgttcttcgaaattatgaaattaaaccttggtatacatctccttttccggaacacatcaaccaaaataaaatggtttttatatgtgagttctgcctaaaatatatgacttctcgatatactttttatagacaccaactaaagtgtctaacttttaagccccccggaaatgaaatttatcgcgacggtaagctgtctgtttgggaaattgatgggcgggagaatgtcttgtattgtcaaaatctttgcctgttggcaaaatgttttatcaattctaagactttgtattacgatgttgaaccgtttatattctatattctaacggagagagaggatacagagaaccatccctatcaaaacgcagccaaattccatttcgtaggctatttctccaaggaaaaattcaactccaatgactataacctaagttgtattttaactctacccatataccagaggaaaggatatggtcagtttttgatggaattttcatatttattatccagaaaggagtcaaaatttggaactcctgaaaaaccattgtcggatttaggattattgacttacagaacgttttggaagataaaatgtgctgaagtgctattaaaattaagagacagtgctagacgtcgatcaaataataaaaatgaagatacttttcagcaggttagcctaaacgatatcgctaaactaacaggaatgataccaacagacgttgtgtttggattggaacaacttcaagttttgtatcgccataaaacacgctcattatccagtttggatgatttcaactatattattaaaatcgattcttggaacaggattgaaaatatttacaaaacttggagctcaaaaaactatcctcgcgtcaaatatgacaaactattgtgggaacctattatattagggccgtcatttggtataaatgggatgatgaacttagaacccaccgcattagcggacgaagctcttacaaatgaaactatggctccggtaatttcgaataacacacatatagaaaactataacaacagtagagcacataataaacgcagaagaagaagaagaagaagtagtgagcacaaaacatccaagcttcatgtaaacaatatcatagaaccggaagtacctgctactgatttttttgaagacactgtttcctccttaacagagtatatgtgtgattataagaacacaaataatgatagattaatctatcaagcggaaaaaagagtgctggaaagcatccatgatcgcaaagggataccaagatcaaaatttagtacagaaactcattgggagctctgcttcactattaaaaactccgaaacaccacttggaaatcatgcagctaggagaaacgatactggaatatcaagtttagagcaggatgaagtagaaaacgatgtagatactgaattatatgtaggtgaaaacgccaaagaagatgaagacgaagacgaagactttacccttgatgatgacattgaggatgagcaaatatcagaagaaaatgatgaggaggaagacacatatgaagaagacagtgatgatgatgaggatgggaagagaaaaggacaagagcaggatgaaaacgatatagaaagccacataaggaaggagagagtcagaaaaagaagaaaaataactctaatagaggatgacgaagaataa

SEQ ID NO: 4944 - DNA, 2499 bp, Saccharomyces cerevisiae
atgccgacaccttcaaacgctatagagatcaatgacggttcgcataaatctggtagaagcactaggcggtctggatctaggagtgcgcacgatgacggtctagattcattctcaaaaggcgattcaggtgctggagccagtgctggtagcagtaatagtcgatttagacatcgaaaaatatctgtgaagcaacatcttaagatatatctgcctaacgatctgaaacacctggataaagatgaattgcaacagagagaggtggttgagatcgaaactggtgtagaaaaaaatgaagaaaaggaggtccatttgcatcgaatattacaaatgggttctggtcatacaaagcacaaagactatattccgaccccggatgcttctatgacttggaatgaatatgataagttttatacgggcagtttccaggagaccaccagctacatcaaattttctgccactgtggaggattgctgtggtaccaactacaatatggatgaaagagatgagacctttttaaatgaacaagtcaacaaaggttcatcagacattttaactgaagacgaatttgaaatactttgttccagttttgaacatgctattcacgagcgtcaaccattcttgagtatggatccggaaagtatactttcttttgaagaattgaagcccacattaataaaatcagatatggctgatttcaatctaagaaaccagctgaatcatgaaataaattctcataaaacacattttatcacacaattcgaccccgtatctcaaatgaatacgagacctttaattcagctgatagagaagttcggctctaaaatttatgattattggagagaaagaaaaattgaagttaacgggtacgaaatttttccgcagctgaaatttgaaaggccgggtgaaaaagaagagattgatccctacgtctgtttcagaagaagagaagtgagacatccgcggaaaacaagacgtatagatatcttaaacagtcagcgtttaagggcgttgcatcaagaattgaaaaacgcgaaggacttggccctgcttgttgctaaacgtgagaacgtttccctaaattggattaatgatgaattaaaaatattcgatcaaagggtaaaaattaagaatttgaaaagatctttgaacattagtggagaagacgatgacttgattaaccacaagagaaaacgccccacgattgttacggtcgaacaaagggaagctgaactaaggaaagctgaacttaagagagcagctgctgcagcagcggcagcgaaggcaaagaacaataaaaggaataaccaacttgaagacaaatcttctaggctcaccaagcagcaacagcagcaactgttacagcaacaacaacaacaacagcaaaatgcccttaagactgaaaacggaaagcaactcgcgaatgcatcctcttcttcaacatcacagccaattacgtctcatgtttatgtcaaactaccatcttccaaaattcctgacattgtattggaagacgtggatgctctattgaacagcaaagaaaaaaatgcaagaaagttcgttcaggaaaagatggagaaacggaaaattgaagacgcagatgtctttttcaacttaacggacgatccctttaatcctgtatttgacatgtcgttgcctaaaaatttttcgactagtaatgttccctttgcatctatcgcgtcatccaagtttcagatagatagatctttttattcttcacatttaccagaatacttgaaggggatatctgatgacatcagaatatatgattcaaatggccgttcgagaaacaaagataattacaacttggataccaaaagaatcaaaaaaactgaactgtacgacccattccaagaaaatttggaaattcattcgagagagtatccaataaaattcaggaagagagttggtagatctaatattaagtatgttgatcgtatgccaaattttacaacatcgtcgaccaagtctgcatgttctttaatggattttgtagatttcgattcaatcgaaaaagaacaatattcaagagaaggtagtaacgatactgactcgattaatgtttacgattccaaatacgacgaatttgtcagactttacgacaagtggaagtatgattctccacaaaatgaatatgggatcaagttttcagatgaaccggcaagacttaaccagatttcaaatgatactcaggtgattagattcggaacaatgttgggtacgaagtcctacgaacaattaagggaagccaccataaagtatcgtagggactatatcaccagactgaaacaaaagcatatacaacatttacaacagcaacaacaacagcagcagcagcaacagcagcaagcacaacaacaaaagcagaaatcacagaacaataattcaaattcttcgaactccctaaaaaaattaaatgattcgttaatcaattcagaagcgaaacagaactcttctataacccagaaaaattcatcatga

SEQ ID NO: 4945 - DNA, 2499 bp, Saccharomyces cerevisiae
atggattcgattacagtaaaaaaacctcggttaagattggtttgcctgcaatgcaaaaagatcaaacggaaatgtgataaactgcggcctgcttgctcgcgatgccaacaaaattcattacagtgtgaatatgaagagagaacagatttatctgccaatgttgcagcaaacgactctgatggattcaattcctctcataagctcaatttcgaacagcaacctgtacttgaaaggactgggcttagatattccttacaagtgcctgaaggtgtcgttaatgctacgctgtcgatatggaacgccgaagatatgctagttatagtaggattagttacatttctggattatccttttgctgcgcatagtctggcgcaacatgaccagtatatcagggcactttgtgcttcgttgtacggcatggcgcttgttgactttagcaattatgctaatggtattccttgtgaagacacatcaagaagtatactaggaccattgtcattcatagaaaaggccatttttagacggatagaacatagtaagcaatttcgagttcagtctgccgccttagggttattatacaatgcattttcaatggaagaagaaaacttctcgactcttctaccgtcactcatcgctgaagtggaagacgtgttgatgcaaaaaaaagactgtgaaatacttttgaggtgtttctatcaaaatatttatcccttctatccttttatggacatttcactctttgagagcgatctcactagtttgcttttacaagacgacaataatcgttggaaaattagtactgaagttaaaaatgtgcgcaaaaaaatagaaactttgtcattacttacaatagtaatggccatggccttgatgcattcaaaattggatgcaaatcttctttcaatggtaaaagaaaatgcctccgaaagtgccaggaaactttctcttttatgtcataaactattatgcctcctggatgtatttcgctatccaaatgagaacacttttacttgccttttatatttctacgtttcagagcatttagatcccgagagtcccgattgtgtactgagccccactaacttgcttactctgcaccatcttttaaatttgtccatgaccttaggtcttcaatatgagccttcgaagtacaaacgtttcaaagatccagaagtgataaggcagagacggatattatggttaggagttcagtcattactttttcaaatttctcttgctgaaggtgatgctggtaaatcaaatagtgaatatatggaggcatatttaacagacttcgaagaatatattgaagcttcctcagagtatgaaaaaagttctgcgagtgaatcgaacgtgcaaatgaatgatattgtttggaataagtacaaatttcacgtcattttgagtaaactaatgtctgattgcacttcagttatacaacatccgcagcttttccacattttaggaaatattaaaagatctgaagattttatggctgagaactttcctacaagttcgatttaccaaccccttcatgaaaaggaaccaaatgcgatcaaagttggcaaaagtacggttctcgatgtcatggatattcaaaaaactgaaatatttcttacaaatattgtgggaagtatgtgttttttaaacatttttgatgtcctatcgttacattttgaaaaaaaatgtgttatgcactgggaagaatatgaaaagaactatcatttccttactttgaaaagtttcaatgcatacttaaagctagcagggttgatatctgattatctcgagaataagtttcaagggaacattttagagagtcgcggttatatcatagataaacaaatatgttttatgcttgtaaggatctggatgttccaatgtcgtattttgttaaggttttcatacaagcaagaaagtcagaaaaaattggcctcttccagtatatccactaacgataatgaaaaagaagatgaaatgattgtcattttagaaagacttattaaacacattcgtaaccaaatggcacatttagtggatctagcaaagggaaaacttcaagatagttactttggtgcttaccaaactgttcccatgtttagatacgttgtgtatttgatcgatgttggcggcttagtatctgtgacaaatgggttttgggataagatttccagtgatggtgaaataccgccaaaagtacaacaagccgtgagattgaaatggggattggactgcaataattcgagaagaatcaaacaaaagttaataagcagccagagtttgcagagtttcaatcaagttctgttgtgccagatggaggatgcagttctctccagttccttcgcaataaaagccaataccgctatgtcccaaaacacggctgaagaatttttcaatatcagcgaagaagaggctttaaatcaactattggaaaacaacaattttgatgccttctgggatttattaggtgaaaatctgagcgatatgccttctttgtga

SEQ ID NO: 4946 - DNA, 2499 bp, Saccharomyces cerevisiae
atgggctcttcgttgagaagctttatcaaagacgttcgtggtgccaaaacactggcagatgaaagggcaattataacgaaacaatctgctaaaattaggacaaaattgagagatgaccatctaccacatgaaaaaaggcgagtaaatatccagaaacttctgtatctatacattctaggggaaaagacacatttcggtcaggtggagtctatcaatttaattgcttctgacgattttgtcgataaaagattaggctatctggccgcaactttattgttggacgaatctgaagatttattgacactcttaacgaacatgttgaacaacgatttgcatcatcccaacaaatatgcagtgtcacttgcactaacctcattaggctttttgagctcccctgaattagccagagatttatacccagacgtcgaaaatatcatcaaaaattcaagagaccctttcctcttgaaaaaagcgcttcaatgtgctgccaaactaattttcaaagacgtttcacttttagaaatcttcaacatcgaagacattactaagatattgtctagtcattcaatatgtactcacggtgtacttttaggcgttacgaaaatcatacaatctattttgttaattggattgaacagaaaaaaagatgaggatgaagatgaagacggtattgattacagcaatgacatcttgtctccattatctttacttttgcgtgattttttcattcgtttggaaaatatgaattctaaaaatattgaacctggatatgatgtccaaggtatttgtgacccatttctgcagtgtgaaataatttacactttaaaactatactttcaagttggtgagctcttaaattcgaacaatgttttggactacaaagataatttctgcgatttattgactcgtattgcgacgaatacggattcaacgaaaaacagcggacaggccattctttatgagaccgtgaagacgatcttttcgttggatttgaaccagcctctacgtgtccttggtattaacatcttggccaagtttcttgcaggaaaagataataatactaaatacgtttcattaaacaccttattaaaagttgttccccaagagcctaccgcagtacaaaggcatagaaaattcatttctcattgtctgcaggataccgatgtgtcgatccgcatgagagcgttagagttgagcttcgccatcttggacgattcaaatttagtggaattggttaacgaattgatgaaatttttggcaaaacaggatgaagattcaaaagatctcataatatacactatagatcacttaattgacacttttgatacccgcgttgtcaaagatgaaagctggaaattagatgttttctttaatatcttaaaattagtgggatcgtttatcaactatgaaaaaattaatgatattctaatcataataaataatacgagccagttatccgacaaatctgaatttttacggaaaatgctgacaatttcactaaatggaacatcagcggagatttccgaggaaaatattggttggcagttggttttgatttggtgcattggcgaatatggcgatttagtactcaacgagggcaataaaaatggtgcagacataatcaatgagtcatctattactgattacttactaactttgcaagaactctacacagcaacgaatctgaagataatcaattacattttaacagcagcattaaaattatctgtgaggttccatgacgcgaaaaatattgaaaaactaagacaactgatattgagctacacggattccactgatttatcactgcaaatgaaaagcaatcaatacgagatatttttcaatcagtcaatttctgtgaagaagatcattttagaaacaatgcctaaatttgaaaaaattaccgaggaacaggataatggaaaagctctatcgaaaaaccttatctccaacgaaccagttgatctgctgtcagatttattgggtgaggatagcaaggctgaaagcaaggcttctactggtgacaatgtgaaaccaattgacatattagaagagatttttggagagaagaatgacattgctcaggtgcccaaaaatgcgaacaaggaagaatcaatcaatcattcgtcggcagtggaggcaaactcaggtgtcaccttaccattggatgccaacaagatatatgacagttcctcactgaatgtatatgcttccttgctctctgcaaactctggattagcacatttggatttatattttcaggcaaagtctttaatatctgacttaaaaactttctgtgccgttcctaaagctcaaaagctaacactaggccagttatatccatcttccacaataaacgccagccaaatttgcaagcagtcattgaaaatttctggatctgggaaactgaagttaagagttaagttggattttcatttaaatggctcttcatctatcaccaatgaacagttcgatcacaaattcgatgaaactctataa

SEQ ID NO: 4947 - DNA, 2502 bp, Saccharomyces cerevisiae
atgaataatgctgcaaatacagggacgaccaatgagtcaaacgtgagcgatgctccccgtattgagcctttaccaagcttgaatgatgatgacattgaaaaaatcttacaaccgaacgatatctttacgaccgatcgtaccgatgcaagtactacatcttccacagccattgaagatattattaacccctcattggatccgcagtcagcagcatcgccggttccttcttcctcttttttccatgactcaaggaaaccttccaccagtacacatttagtaaggagaggtactccattgggaatttaccaaaccaatctatacggtcacaatagcagagaaaatactaatcctaatagtacattattatcttctaagttactcgcgcatccaccagttccttatgggcaaaatcccgatttactacaacatgctgtgtacagggcacagccgtcaagtggaaccactaacgcgcaaccgcgccaaaccacaagaagatatcaatcccataaatcacggcctgcatttgttaataaactatggagcatgttaaacgatgattctaatacgaaacttatacagtgggcggaggatggaaaatcttttattgtcacgaatagggaggaatttgtgcaccaaattttaccaaaatattttaaacattccaatttcgcttcctttgtaagacaattgaacatgtatggatggcataaagttcaagatgtcaagtcaggatcaattcaaagtagttcagatgataagtggcaatttgaaaatgaaaacttcattagaggtagagaagatttgctggaaaaaataatcaggcagaaaggttcctccaataaccataatagccctagtggtaacggtaatccagcgaatggtagcaacatccctctggacaatgccgcaggaagtaataatagcaataataacatcagtagtagtaattcattttttaacaatggtcatttattgcagggtaaaacactaagattaatgaacgaagcgaatcttggagataagaatgatgtcaccgcgattttgggggaattagagcaaataaaatataaccagattgcaatttccaaagatttactaagaataaacaaagataatgagttattatggcaagagaatatgatggccagggaaagacatagaacccaacagcaagccttggaaaaaatgttcagattcttgacatctatagtcccacacttagatcccaaaatgattatggacgggctgggagatccgaaagttaataatgaaaagctaaacagtgcgaataacattgggttaaatcgcgacaacacaggcactatagatgaactaaaatccaacgattctttcataaacgatgatcgtaattctttcaccaatgctacaaccaacgcccgtaataacatgagtcccaacaatgatgacaatagtattgacaccgctagcactaataccaccaacagaaagaaaaatatagatgaaaacatcaaaaataacaacgacataattaatgacattatatttaataccaaccttgccaacaatctcagcaattacaattccaacaataatgctggctcgccaataaggccctataaacaaagatatcttttgaaaaatagagccaattcctcgacatcgagtgagaatccaagcctaacgccctttgatatcgaatctaataatgaccgcaaaatttcagaaattccttttgatgacgaagaagaagaagaaacggattttaggccttttacctcgcgagatcctaataaccaaacgagtgaaaacacttttgatccaaacagatttacgatgctctctgatgatgatttaaaaaaagattctcataccaatgacaataaacacaacgaaagtgatcttttttgggacaacgtacatagaaatatagacgaacaagatgcaagactccagaacttggaaaatatggttcacatactttctcctggatatcctaataagtcgttcaacaacaaaacttcctcgacaaacactaattccaatatggaaagtgctgtcaacgttaatagccctggtttcaacttacaggattatttaactggagagtctaattcccccaattctgttcattctgttccctccaatggcagcggctccacaccgttgcccatgccaaatgataatgacaccgagcacgcaagtacaagtgtcaatcaaggcgaaaatggaagcggattaacgcccttcctcacggtagatgatcacacactaaacgacaataacactagtgagggaagtacaagggtgtcccccgatataaagttcagcgccactgaaaacactaaagtgagtgataacctgccaagctttaatgaccacagttattccacccaggccgacacggcgcccgagaacgctaagaaaagatttgtggaggaaataccggaaccggctatagtcgaaatacaggacccgacagagtacaacgatcaccgcctgcccaaacgagctaagaaatag

SEQ ID NO: 4948 - DNA, 2502 bp, Saccharomyces cerevisiae
atgataacactcttattatacctgtgcgtaatatgtaacgcaatagtgttaataagggctgattcgatagcggacccttggcctgaagcgcgacatctactaaataccatagctaagtccagagacccaatgaaagaagctgctatggaacccaatgcagatgaatttgttggattctatgtaccgatggattattccccacgtaatgaggaaaaaaactaccagagcatttggcaaaacgaaatcacagattctcaacgtcatatttatgaattacttgtacaatcaagtgaacaattcaacaactcagaagcaacatatacacttagccagattcacctttggagtcaatataatttcccgcataatatgactttggcacacaaatacttagaaaaattcaatgatctaacccacttcaccaatcattcggccatcttcgacttagctgtgatgtatgccactgggggatgtgcttctggtaatgatcaaaccgtgatccctcaggattctgctaaagcactgctatattaccaaagggctgcccaactagggaatttaaaggctaagcaagtgctagcttataaatactattctggcttcaatgtcccacgaaattttcataaatctttagtattgtacagggacattgctgaacagctgagaaagtcgtactccagggacgaatgggatattgtcttcccctattgggaaagttacaacgtgagaatatcggattttgagagtggcctattaggtaaaggtttgaattccgttccatcttctacagtaaggaaaagaactacgagaccagatattggttcaccctttattgcgcaagttaacggtgtacagatgaccttgcaaatcgaaccgatgggtaggttcgctttcaacggtaacgatggcaacataaatggcgacgaagatgacgaggatgccagtgaaagacgaatcattcggatatattatgcagctttgaatgattataaaggaacatattcacaaagcagaaattgtgagcgcgccaaaaacttgttggaattaacgtacaaggaatttcagcctcatgtcgacaatttggatcctttgcaagtattttactacgtccgttgcttacaattattggggcacatgtatttcaccggcgaaggctcctcgaagcctaatattcatatggccgaagagatcctgaccacgtcgctagaaataagcagaagggcacagggacctataggtagagcgtgcatagatctgggcttaataaatcaatacatcacaaacaatatttctcaagcaatttcgtattatatgaaagctatgaaaacacaagctaacaatggaatcgtagaattccaattatccaaattggccacttcattccctgaagaaaaaatcggcgacccatttaacttaatggaaactgcctacttgaatggattcattccagccatatatgagtttgcagtaatgatcgaatctggaatgaacagtaagagtagtgtggaaaacactgcttacctgttcaaaacattcgttgacaaaaacgaagctattatggcacctaaactgaggacagcatttgccgcattaatcaacgatcgttcagaagtggctttatgggcttattcccaactagccgagcaaggctacgagactgctcaagtctctgccgcctacttaatgtaccagttgccatatgagtttgaggatcctccaagaaccacagatcagagaaaaactttggcaatttcctactatacaagagcgtttaaacagggaaatatagatgctggtgttgtcgcgggagatatctattttcagatgcagaattacagtaaagctatggctctttatcagggtgcagctttgaagtactctatacaggctatctggaacttagggtacatgcatgagcatgggctaggtgtaaacagagatttccatcttgctaaacgttactacgaccaagtttcagaacacgatcatagattttacttggcttccaaattgagtgttttaaaattacacctaaagtcatggttgacttggatcaccagagaaaaagtaaactactggaaaccttcctcgccacttaaccctaacgaagatactcagcactcgaagacttcatggtacaagcaattgacgaagattctacaaagaatgagacataaggaggatagtgacaaagctgcggaagattctcacaaacacagaactgtagtgcagaatggagctaaccataggggtgacgaccaagaggaggcttccgagattttgggcttccaaatggaggatcttgttacgatgggatgtatcttggggatattcctattaagtatattaatgagtacactggcggcccgtagaggctggaatgtccgtttcaatggagcacaattaaatgcaaatggtaaccggcagcaagagcaacaacaacaacaacaagcacaaggtcccccgggctgggacttcaatgttcagatattcgccatatga

SEQ ID NO: 4949 - DNA, 2502 bp, Saccharomyces cerevisiae
atgcttatttcaaaatctaagatgtttaaaacattttggatactaaccagcatagttctcctggcatctgccaccgttgatattagtaaactacaagaattcgaagaatatcaaaagttcacgaatgaatctttactgtgggcaccgtatagatccaattgttactttggtatgaggcccagatatgtccatgaaagtccactaattatgggtatcatgtggttcaacagtttgagtcaggatggcttacattcgttaagacattttgcaacgcctcaggataaattgcaaaagtatggttgggaagtgtatgatccaagaattggtggtaaagaagtttttattgatgaaaaaaataacttgaacttgactgtttattttgtaaagagcaagaacggggaaaattggtcagtgagagttcaaggtgagcctttggatcccaagagaccatctacagcatctgtcgtattgtactttagtcaaaatggtggcgagatagatggaaaatcttccttagcaatgataggtcatgacggccctaatgacatgaaattcttcggatattctaaagaattaggcgagtatcatcttacagtaaaggacaattttggtcactacttcaaaaatccggaatatgaaaccatggaagtagcaccaggaagtgactgctctaaaacaagtcatttatcacttcaaatcccggataaagaagtttggaaggctcgtgatgttttccaatctctagttagcgattcgatacgtgatatactggaaaaggaagagacaaagcagcgtcctgctgatttaataccaagtgttttaactattagaaatttgtacaattttaatcctggtaattttcattatatacaaaagacatttgatttgaccaaaaaagatgggttccaatttgatatcacttacaataaacttggcactactcaaagtatttccaccagggaacaagttacggagttgattacttggtcactaaatgagataaacgcgcgttttgataagcagtttagttttggagaaggtcccgactcaattgaaagcgtggaggtcaaaagaagatttgctttagagacgctatcaaacctattaggaggaatcggttatttctatgggaatcaactaattgatcgtgaaacagaatttgatgagagccagtttacagagatcaaactgctgaatgcaaaagaggaaggtccatttgaactgtttaccagcgttccgagccgtggctttttcccacgtggattctattgggatgaaggtttccatcttctacaaattatggagtatgattttgaccttgcctttgaaatcttagcgagctggtttgaaatgatcgaagatgatagtggttggattgctagagaaattatactgggtaatgaggcaaggagtaaagttccgcaggaatttcaggtgcaaaatcccaatattgctaatccgccaactttattgctagcatttagtgaaatgctttctagggccattgaaaacatcggcgatttcaacagtgacagctaccaccaagtcatgttcaatagtaggacagccaagtttatgacgaacaatctagaagccaatcctggcttgctaaccgaatatgccaagaaaatttatcctaagctattgaagcactataattggttcagaaaatctcaaacaggacttattgatgaatatgaggaaatattggaagatgaaggaatatgggataagattcataagaacgaagtttatagatgggttgggcgtaccttcactcattgtttgccaagcggtatggatgactatcctagagcacaaccaccagatgtagcagaattgaacgtagacgcattagcatgggtgggcgttatgacaagatccatgaagcaaattgctcacgtgttgaagttaacacaggacgagcaaagatatgcacaaattgagcaagaggtggtcgagaatctggatttgttacactggagtgaaaatgacaattgctactgtgatattagcatcgatccagaagacgatgagattagggagtttgtatgtcatgagggttacgtctccgtattgccctttgcattgaagctaatccccaaaaactcacccaagctagagaaagtagttgctttgatgagtgacccagaaaaaatcttttcagactacgggctgttatcactatcgagacaagacgactatttcggcaaggatgaaaactattggagaggcccaatttggatgaatattaattacttgtgtcttgacgcaatgagatactactacccagaggtgattctcgacgtggctggtgaggctagcaatgccaagaaactgtaccaaagtttaaagattaatctcagtaacaacatatacaaagtttgggaagaacaaggttattgttatgaaaattacagtccgatagatggtcatggtactggtgctgagcatttcacaggctggacagcacttgttgtcaacatccttggacgcttctga

SEQ ID NO: 4950 - DNA, 2502 bp, Saccharomyces cerevisiae
atgtctaaccaaatatactcagcgagatattcgggggttgatgtttatgaattcattcattctacaggatctatcatgaaaaggaaaaaggatgattgggtcaatgctacacatattttaaaggccgccaattttgccaaggctaaaagaacaaggattctagagaaggaagtacttaaggaaactcatgaaaaagttcagggtggatttggtaaatatcagggtacatgggtcccactgaacatagcgaaacaactggcagaaaaatttagtgtctacgatcagctgaaaccgttgttcgactttacgcaaacagatgggtctgcttctccacctcctgctccaaaacatcaccatgcctcgaaggtggataggaaaaaggctattagaagtgcaagtacttccgcaattatggaaacaaaaagaaacaacaagaaagccgaggaaaatcaatttcaaagcagcaaaatattgggaaatcccacggctgcaccaaggaaaagaggtagaccggtaggatctacgaggggaagtaggcggaagttaggtgtcaatttacaacgttctcaaagtgatatgggatttcctagaccggcgataccgaattcttcaatatcgacaacgcaacttccctctattagatccaccatgggaccacaatcccctacattgggtattctggaagaagaaaggcacgattctcgacagcagcagccgcaacaaaataattctgcacagttcaaagaaattgatcttgaggacggcttatcaagcgatgtggaaccttcacaacaattacaacaagtttttaatcaaaatactggatttgtaccccaacaacaatcttccttgatacagacacagcaaacagaatcaatggccacgtccgtatcttcctctccttcattacctacgtcaccgggcgattttgccgatagtaatccatttgaagagcgatttcccggtggtggaacatctcctattatttccatgatcccgcgttatcctgtaacttcaaggcctcaaacatcggatattaatgataaagttaacaaatacctttcaaaattggttgattattttatttccaatgaaatgaagtcaaataagtccctaccacaagtgttattgcacccacctccacacagcgctccctatatagatgctccaatcgatccagaattacatactgccttccattgggcttgttctatgggtaatttaccaattgctgaggcgttgtacgaagccggaacaagtatcagatcgacaaattctcaaggccaaactccattgatgagaagttccttattccacaattcatacactagaagaactttccctagaattttccagctactgcacgagaccgtatttgatatcgattcgcaatcacaaacagtaattcaccatattgtgaaacgaaaatcaacaacaccttctgcagtttattatcttgatgttgtgctatctaagatcaaggatttttccccacagtatagaattgaattacttttaaacacacaagacaaaaatggcgataccgcacttcatattgcttctaaaaatggagatgttgttttttttaatacactggtcaaaatgggtgcattaactactatttccaataaggaaggattaaccgccaatgaaataatgaatcaacaatatgagcaaatgatgatacaaaatggtacaaatcaacatgtcaattcttcaaacacggacttgaatatccacgttaatacaaacaacattgaaacgaaaaatgatgttaattcaatggtaatcatgtcgcctgtttctccttcggattacataacctatccatctcaaattgccaccaatatatcaagaaatattccaaatgtagtgaattctatgaagcaaatggctagcatatacaacgatcttcatgaacagcatgacaacgaaataaaaagtttgcaaaaaactttaaaaagcatttctaagacgaaaatacaggtaagcctaaaaactttagaggtattgaaagagagcagtaaagatgaaaacggcgaagctcagactaatgatgacttcgaaattttatctcgtctacaagaacaaaatactaagaaattgagaaaaaggctcatacgatacaaacggttgataaaacaaaagctggaatacaggcaaacggttttattgaacaaattaatagaagatgaaactcaggctaccaccaataacacagttgagaaagataataatacgctggaaaggttggaattggctcaagaactaacgatgttgcaattacaaaggaaaaacaaattgagttccttggtgaagaaatttgaagacaatgccaagattcataaatatagacggattatcagggaaggtacggaaatgaatattgaagaagtagatagttcgctggatgtaatactacagacattgatagccaacaataataaaaataagggcgcagaacagatcatcacaatctcaaacgcgaatagtcatgcataa

SEQ ID NO: 4951 - DNA, 2505 bp, Saccharomyces cerevisiae
atgacgaatatggcggaggataaaacaagtataagcaaggtacattctgaattcagcaattcctcgaataccactggatctgaagaggagagtcggtcgcatcaagagagcttcgacggcgagtccagttccggtgaaagtaaaagtaaaagcaaactaaatcttgaatattctgcagatatcgagccattgaagttcagaatgacaaaaactaataatacaaatgacaaattaaaatatagtaacaacggcaacgccactgattcatttatgagactaaaggaacatttacagagaggcaatactttaaattcgaatcttagggtcaatgagttttaccctttcaattccattgatacagagcaatttgaaaactatttgagagagccaaaatacattaaaatgttgaaacgtcggaaaaacctgaaacaatttagaagattgtttctcgcgcaagaactaatggcctacgaaggtgaaacggttacctccacttccaaatcatctgaaccaacctctaaagctatatggagtacaaagtttagccgcgatggaaaatttatggccactggtagcaaagatggtaaaataagaatatggaaagttattggctctccagttgaaagagccgaattggactcgagtgcggaatcaaataaagaggcacgagccaagtcgatgcggatcaaacagcaggtcagttcattgaacaatccaaaagaaaaacaatttttggattctgctacagagaaatacgaagagaaggaaaaattattgaatttgtatgcgcctgtctttcacccaacgcctttgcgactgtataaagaacacgtgcaagatgttctggatataaattggtctaaaaataattttattttgtcagcatcgatggataagacagtaaaactatggcatcccgataggaaaaattcacttaagacattcatacatcctgattttgtcacttgtgtggaatttcaccccaccgacgatagatttttcattagcggctgtctggatcacaaatgcaggttatggtctatactggatgatgaagttagctttgagtacgattgtcaagacttaataacatctgttacattatcccctgaggagggaaaatacactataataggaacatttaatggatacgttcatattctgatgaccagaggtctcactccagtttcttcatttcacgtagctgatagacaaacacaagaacaaaacgctcacgtcatggtcacggaaactgactcaaaaattcgtcatggtccacgtgtgacgggtttgcaagcttttagatctcaactggacaattctttccgcttagtagttacatcgaatgattcgaggataagaatttttgacttagaacagaggaagcttctagaggtattgaaaggcttccatagcggatcttcccaacacaaggcacaattgtccatctggcatggtcagccaatcgttgtaaatagtagtgatgaccattgggtttacggctggaggttaaagtcttcggatagagagaatgatcaagacgaacctaaaaggaaaccaaagggattggctcggtccggaagtttgagaagcatatttagtaaatcaatgagtaggtcttccagccagaataacgaagaaaaaccacatcatcatttaaaacttactaacttacttcccttgcctcatcatagcaacgatcattatatcaaaaatacggattacatttcttttcatgcacacaatgcccctgttacttgtgttagcattgcaccgccagaaacttcgaaaacattatctttgtctaacgatgttatctgcgagctatctctagagttttttcagacatccgatagtttcgatgttttgagtcggagtaacgacgatggcataatgtcagatgtagagtcgtctttgggctacaattctaaaccaggctcaatttctaatgcttccgccaccagtgctatcccagatgtcgttgacgcaattggaacgatattgatcagtactgataacgtagggactattcgtgtgtttagagcagatatgccctctgttataagaaagcgcgtgttactcaaactagaagaatacaatagagaggttcggagaaggtttaacagttctgattctttgcattctttgagtcgaagcttcaactcgagagcgaaatcaaacttggctggccaaccggcagcggcgtatactaatactggaaaaggctatgcaacgggacgtggatactctaatatatgtcccaaaagcagtacatcactaaaaacactcggcagtaatgcacagccaagaacaccaagggaaagcatgtcatctattttctccaatgcacatgggcctaccactccaacgagcgcaatgaatttacctatccgttgcaatgtttgtaacggttcaaggtttgaggctttttctggtgctaatgaccaacaagatagaaactattattgcgtagactgcggtacagtagttaataacttccgctaa

SEQ ID NO: 4952 - DNA, 2505 bp, Saccharomyces cerevisiae
atggtacaaagatgattatattcaacaaatgcaaaagatattgcagtattatattttatgttagctatttttagtggtatggcaggaacagcaatgtctttaatcattagattagaattagctgcacctggttcacaatatttacatggtaattcacaattatttaatggtgcgcctctcagtgcgtatatttcgttgatgcgtctagcattagtattatgaatcatcaatagatacttaaaacatatgactaactcagtaggggctaactttacggggacaatagcatgtcataaaacacctatgattagtgtaggtggagttaagtgttacatggttaggttaacgaacttcttacaagtctttatcaggattacaatttcctcttatcatttggatatagtaaaacaagtttgattattttacgttgaggtaatcagattatgattcattgttttagatagcacaggcagtgtgaaaaagatgaaggacctaaataacacaaaaggaaatacgaaaagtgagggatcaactgaaagaggaaactctggagttgacagaggtatagtagtaccgaatactcaaataaaaatgagatttttaaatcaagttagatactattcagtaaataataatttaaaaatagggaaggataccaatattgagttatcaaaagatacaagtacttcggacttgttagaatttgagaaattagtaatagataatataaatgaggaaaatataaataataatttattaagtattataaaaaacgtagatatattaatattagcatataatagaattaagagtaaacctggtaatataactccaggtacaacattagaaacattagatggtataaatataatatatttaaataaattatcaaatgaattaggaacaggtaaattcaaatttaaacccatgagaatagttaatattcctaaacctaaaggtggtataagacctttaagtgtaggtaatccaagagataaaattgtacaagaagttataagaataattttagatacaatttttgataaaaagatatcaacacattcacatggttttagaaagaatataagttgtcaaacagcaatttgagaagttagaaatatatttggtggaagtaattgatttattgaagtagacttaaaaaaatgttttgatacaatttctcatgatttaattattaaagaattaaaaagatatatttcagataaaggttttattgatttagtatataaattattaagagctggttatattgatgagaaaggaacttatcataaacctatattaggtttacctcaaggatcattaattagtcctatcttatgtaatattgtaataacattggtagataattgattagaagattatattaatttatataataaaggtaaagttaaaaaacaacatcctacatataaaaaattatcaagaataattgcaaaagctaaaatattttcgacaagattaaaattacataaagaaagagctaaaggcccactatttatttataatgatcctaatttcaagagaataaaatacgttagatatgcagatgatattttaattggggtattaggttcaaaaaatgattgtaaaataatcaaaagagatttaaacaattttttaaattcattaggtttaactataaatgaagaaaaaactttaattacttgtgcaactgaactaccagcaagatttttaggttataatatttcaattacacctttaaaaagaatacctacagttactaaactaattagaggtaaacttattagaagtagaaatacaactagacctattattaatgcaccaattagagatattatcaataaattagctactaatggatattgtaagcataataaaaatggtagaataggagtgcctacaagagtaggtagatgactatatgaagaacctagaacaattattaataattataaagcgttaggtagaggtatcttaaattattataaattagctactaattataaaagattaagagaaagaatctattacgtattatattattcatgtgtattaactttagctagtaaatatagattaaaaacaataagtaaaactattaaaaaatttggttataatttaaatattattgaaaatgataaattaattgccaattttccaagaaatacttttgataatatcaaaaaaattgaaaatcatggtatatttatatatatatcagaagctaaagtaactgatccttttgaatatatcgattcaattaaatatatattacctacagctaaagctaattttaataaaccttgtagtatttgtaattcaactattgatgtagaaatacatcatgttaaacaattacatagaggtatattaaaagcacttaaagattatattctaggtagaataattaccataaacagaaaacaaattccattatgtaaacaatgtcatattaaaacacataaaaataaatttaaaaatataggacctggtatataa

SEQ ID NO: 4953 - DNA, 2508 bp, Saccharomyces cerevisiae
atgctatttggtattaaactggctaacgacgtatatcctccctggaaggattcatatatcgactatgaaaggttgaagaaattactaaaggaaagcgtcatacatgatggccgtagttccgtggatagttggtccgaaaggaatgaatctgattttgtggaggccttggataaagaactagaaaaggtttacacatttcaaatttccaaatataatgctgtcttgcgaaaattagatgatttagaggaaaacactaaatcagctgaaaaaatccaaaaaataaattctgagcagttcaaaaacaccttagaagaatgtctagatgaggctcaaagattggataactttgacaggttaaattttactgggtttatcaagattgtgaagaaacacgataaattacatccaaactatccttctgtaaagtctcttttacaagtcagattgaaagaacttcctttcaacaattcagaagagtattctcccttgttgtataggatctcatatctgtacgagttcttgagatcaaattatgatcatccaaatacggtgtctaaatcattagcaagtacttctaaattatcacatttttctaaccttgaagacgcaagttttaaaagctacaagttttgggttcatgatgataatataatggaggttaaggctagaatcttaaggcatctacctgctttggtttatgcgtcggttccaaatgaaaatgacgatttcgtcgataatctagaatcagatgtccgcgtacaacctgaagcgcgcttgaatattggttcaaagagtaacagcctttctagtgatggtaatagcaaccaagatgttgaaattggaaaatcaaagagcgttattttcccacagtcatatgatccaacaatcactacattatatttcgacaacgatttttttgatttgtacaataacagattgttgaaaatcagcggtgcacctacgctgagattaagatggatcggtaaactgctagacaaacctgacatatttttggaaaagagaacttttacagaaaataccgaaactggtaattcaagttttgaagaaatcagattgcaaatgaaagccaaattcatcaacaattttatttttaaaaatgatcccagttacaaaaactatttaattaatcaactaagagaaaggggtactcaaaaggaggaactggaaaaactttctagagactttgataacatccaaaactttattgttgaggagaagttgcagccagttttgagagctacctataatagaactgctttccaaattcctggagatcaaagtattagagtcactatcgattccaatatcatgtacattagagaggattctttggacaaaaataggcccattaggaaccctgagaattggcaccgtgacgatattgattccaatattcccaacccattgaggtttttaagagcaggagaatattcgaagttcccctattctgtaatggagattaaggttataaaccaagataattctcaaatgcctaattatgagtggattaaagatttaactaattcacatttagttaacgaagttccaaaattttctttgtacttgcaaggtgtggcttcactgtttggtgaagacgataaatatgtcaacattttgccattctggttgcccgatttagaaaccgacatcagaaagaaccctcaggaggcttacgaagaagagaagaaaactttacaaaaacaaaagagcattcatgataaacttgataatatgagaaggttatccaaaatctctgtaccagatggaaagaccactgaaagacaagggcaaaaagatcagaatactcgccacgttattgcagatttagaagatcacgaatcatcagatgaagaaggtactgcattgcccaagaaatctgcagtcaaaaaagggaagaaattcaaaacgaatgcagctttcttgaaaattcttgctggaaaaaatatttcagaaaatggaaatgatccatactccgacgatacagacagtgcctcttctttccaattacctccgggagttaaaaaaccagttcaccttttgaaaaatgccggtcctgtcaaagttgaggcaaaagtttggctcgccaatgaacgtacattcaatagatggttaagtgtaaccacattgctgagtgtattgaccttttctatctataattcagtgcaaaaagccgaatttccacaactagctgatctgttggcctatgtatatttctttttgactttgttttgcggagtatgggcttatagaacctacttaaaaagattaactcttattaaaggtagaagtggtaagcatttggatgcacctgtgggacctattttggttgcagttgtattaatcgttaccttggttgttaactttagtgtggcttttaaagaggccgctaggagggaaagaggattagtaaacgtttcctcccagccttcgttaccccgtacactaaaaccaattcaagattttatcttcaatttggttggggaataa

SEQ ID NO: 4954 - DNA, 2508 bp, Saccharomyces cerevisiae
atgggtgaagaacataaaccacttttggacgcctcgggtgtcgaccctcgtgaggaggataaaaccgccaccgccattttaagaagaaagaagaaggacaacatgcttttggtggacgatgctatcaatgatgacaattctgtcattgctattaattctaacaccatggacaaattggaattgttccgtggtgacaccgttctcgttaagggcaagaagagaaaagatactgtcttaattgtgttgatcgatgacgaattagaagacggagcatgcaggataaaccgtgtagttcgtaacaatttacgtattaggctgggtgatttagttacaattcatccttgccccgatatcaaatacgctactagaatttctgtgttaccaattgctgatacgatcgaaggtataactggtaatcttttcgatgtttttttgaagccttattttgtggaagcctacagaccagtgaggaaaggcgaccattttgttgtcagaggcggtatgagacaagtcgaattcaaggttgtggatgtcgaacctgaagaatatgccgtcgttgctcaggatactattattcactgggaaggtgagccaatcaacagggaagatgaagaaaataatatgaatgaggtgggttacgatgatattggtggttgtcgtaagcaaatggctcaaattagggaaatggttgaactaccattgagacatcctcagttgttcaaggctatcggtatcaagccaccaagaggtgttttgatgtatggtccccctggtactggtaaaaccttgatggcaagagctgttgctaatgagaccggtgccttttttttcttaattaatggtccagaagtcatgtcaaaaatggctggtgaatcagagtctaacttaagaaaggcctttgaagaagccgaaaagaacgctccagccatcatttttatcgatgaaatcgattctatagctccaaagagagacaagactaatggtgaagttgagagaagagttgtctctcaattgttaactttaatggatggtatgaaggcaagatctaatgttgttgtcattgctgctaccaatagaccaaattcgattgatcccgctttaagaagatttggtagattcgatcgtgaagtcgacattggtatcccagatgctacaggtagacttgaagttctacgtattcacaccaagaacatgaagttggctgatgatgttgatttggaagcattggctgctgaaacacacggttacgtgggtgctgatattgcctctttgtgttctgaagctgccatgcaacagatccgtgaaaaaatggacttgatagatttagatgaagatgaaattgatgcagaggtgctcgattctttaggagtcaccatggacaacttcagattcgcattgggcaattcaaacccatctgcattgcgtgaaaccgttgttgaaagtgtcaatgttacttgggatgacgttggtggcctagatgaaatcaaggaggaattgaaggaaactgtagaatacccagtcttacatccagaccaatacacaaagtttgggttatcaccatcaaagggtgtgttgttctacggtccaccaggtacaggtaaaactttgttagcaaaagctgtagctactgaggtttctgccaactttatctcagtcaaaggtccagaattattgagtatgtggtatggtgaatcggaatctaacatccgtgatatttttgataaggcaagagcagctgcaccaaccgtcgtttttctagatgaattagactccattgccaaggcaagaggtggttccttgggtgatgctggtggtgcttcggatagagtcgtcaaccaactattaacagaaatggatggtatgaatgctaagaaaaatgtgttcgtgattggtgccaccaataggccagatcaaattgatcctgctattttaagacctggcagattggatcaattaatttatgttccattgccagatgaaaacgctagattatctattctaaatgctcaattaaggaaaacaccactagaaccagggctagagttaactgcgattgccaaggccactcaaggtttctctggtgctgatttactctatattgtgcagagggctgctaaatacgctatcaaggattctatcgaagctcacagacaacacgaagctgaaaaggaagtgaaagtagaaggtgaagacgtggaaatgacagatgagggagcaaaggctgaacaagaaccagaagtagatcctgttccatatattacaaaggagcatttcgcagaagctatgaagaccgctaaacgttctgtttcagatgctgaattgcgtcgttatgaagcatactcacagcaaatgaaagcatctagaggtcaattcagtaatttcaactttaatgacgctccattaggtactacggctacggacaatgctaacagtaataatagtgctccaagtggagcaggtgctgcatttggttctaatgcggaggaagatgatgatttgtatagttag

SEQ ID NO: 4955 - DNA, 2511 bp, Saccharomyces cerevisiae
atgctagacaaggcgcgctctcaaagcaaacacatggacgaatctaatgcggctgcctctctgctttcgatggaaacaaccgccaacaatcatcactatttgcacaataaaacatctcgtgccacgctgatgaatagcagccaagacggcaaaaaacatgcagaagatgaagttagtgatggagctaactcccgccatcctacaatttccagtgctagcatcgaatctctcaagacaacctacgatgaaaaccctttgctttctattatgaaatcgacatgtgcgcccaacaacactcccgtgcatactccgtctggttcgccgagtttgaaagtccaaagtggcggagatatcaaagacgatcctaaggaaaacgatactactactacgaccaatactacacttcaagatcgccgtgacagcgataacgctgtgcatgctgccgccagcccactcgcgccttccaatacaccttcggatcctaagtcattgtgcaatggccatgtcgcacaggctacagacccacaaatttccggtgctattcagccgcagtatactgcaaccaacgaggatgttttcccttactcctccacctccactaatagtaacactgccactactactatcgtcgccggcgccaaaaaaaaaatacatttgccgccaccacaagctccagcggtttcttcccccggtaccaccgcagcaggctcgggcgcgggcacgggctcgggcatccgttcccgcacaggatcggatttgccgctcatcattaccagcgccaacaagaacaacggtaagactaccaattcgcctatgtcgatactgagcagaaacaacagtaccaacaacaacgacaataattcgatacaaagctcagattcgagagaatcctctaataacaatgagattggcgggtatttgcgcggcggaactaagcgcggcggcagtccatctaacgactctcaggtccagcataatgtgcatgatgaccaatgtgccgtgggcgtggcgcccaggaacttctatttcaacaaggatagagagataacagacccaaatgtaaaactggacgagaacgaatcaaaaatcaacatatcgttctggctaaattcgaaatacagagatgaggcttattctttgaatgaatcatcctccaacaatgctagttcaaacacggatacgcctacaaactctcgacatgcgaacaccagctcttccattaccagcagaaacaatttccagcattttaggttcaaccaaataccttctcaacctccaacttccgcatcttcgtttacaagcacaaacaacaacaaccctcaacggaacaatatcaatcgcggtgaagacccgtttgccacttcgtcaagaccttctactgggtttttttacggcgatttgccgaatcgtaacaatagaaatagtcccttccatacaaatgaacaatacatcccaccacctccaccgaaatacatcaattctaaattggatggattgagatcaagattattgctcggtccgaattctgcatcttcatctaccaaactagacgacgacttgggtacagcagcagcagtgctatcaaacatgagatcatccccatatagaactcatgataaacccatttccaatgtcaatgacatgaataacacaaatgcgctcggtgtgccggctagtaggcctcattcgtcatcttttccatcaaagggtgtcttaagaccaattctgttacgtatccataattccgaacaacaacccattttcgaaagcaacaattctacagctgtttttgatgaagaccaggaccaaaatcaagacttgtctccttaccatttaaatctaaactctaaaaaggttttagatcccacttttgagtcaaggacaaggcaagttacttggaataagaatggtaagcgaatagacagacgcctttctgctccagaacaacaacagcaactggaagttccaccattgaaaaaatcgagaaggtcagttggaaacgcaagagtagcaagccaaaccaatagcgattataattctcttggcgaatcctcaacttcgtcagctccatcgtctccatctttgaaggcttcttctggcttggcatataccgctgattatcctaacgctacttcgccggatttcgctaaatctaaaggaaaaaatgtcaagcctaaggcaaaatcaaaggcgaaacagtcatcaaagaaaagaccaaataatactacttcgaaatcaaaagcaaacaattctcaagaatcgaataatgctacttcctcaacgtctcaaggtacaaggtcccgtactggttgctggatttgtagattaaggaaaaagaagtgtaccgaggaaagaccgcactgtttcaactgtgaaaggttgaaattggactgtcactatgacgcgttcaaaccagattttgtatctgatccaaagaaaaaacagatgaaactggaggaaatcaagaaaaaaacaaaagaggccaaaagaagagcaatgaaaaaaaaataa

SEQ ID NO: 4956 - DNA, 2511 bp, Saccharomyces cerevisiae
atggctcatagaaaattacagcaggaggtcgatagggtctttaaaaaaattaacgaaggtttagaaatcttcaatagctattacgaaagacatgaatcatgcacaaacaatccttcccaaaaggacaagctagagtcggatttaaaaagagaagtcaaaaagctgcaaaggctaagggaacagataaaatcatggcaaagctcacccgatattaaagataaagattctcttctagattacagaaggtctgtagaaatagcgatggaaaagtataaggctgtagagaaggcgtccaaagaaaaagcatactctaatattagcctgaaaaaatcagagactttagacccgcaagaaagggaaaggagagatatatctgagtacctttcccaaatgatcgatgagctggaaaggcaatacgattccctacaagtggaaattgacaagcttttacttcttaataaaaagaagaaaacgtcatctacgacaaatgatgaaaaaaaggaacaatataagcgttttcaagcgaggtataggtggcatcaacagcagatggagttagccttgagattgttagccaatgaggaattggacccccaagatgttaaaaacgtgcaggacgatataaattacttcgtggagtcaaatcaggatccagatttcgtagaggatgaaactatttatgacggtttgaatttacagagtaacgaagccattgctcatgaggtggcccagtattttgcttcacaaaatgctgaagataacaatacatcggatgctaatgaatctctgcaggacatatcaaaactttctaaaaaggagcaaagaaaattggaaagagaagccaaaaaggctgctaaacttgcggcaaaaaatgcaacaggtgcagctatacccgttgctggtccctcttctacgccgtcacctgtcattcccgttgctgatgcttcaaaagaaacggaaagaagtccttcatcttcccctatccataatgcaacaaagcctgaagaggctgttaaaacttctataaagagtcccaggagcagtgctgataatttgcttccgtcattgcaaaaatcaccaagttcagctacaccagaaactccaacaaatgtacatacacatattcatcaaactccaaacggtattactggtgccactacattgaaacctgctactcttccagcaaaacctgctggtgaattaaaatgggccgttgctgcatcacaagcggtagaaaaggatagaaaagtcacttctgcatcgtccaccatatccaatacctcaacaaagactccaacaactgctgctgctactacaacatcatccaacgctaacagcaggattggtagtgcgttgaatacacctaagttatctacttcatctttgtctttacaacctgacaataccggcgcatcatcttcagcagcaacggccgctgctgttttggctgctggggcggctgctgtgcatcaaaacaatcaggccttctatagaaatatgagctcctcacatcatcctttagtttccttggcgacaaatccaaagtctgaacatgaagttgcaactacggtaaaccaaaatgggcctgagaacacaactaagaaggttatggagcagaaggaggaagagtcaccagaagaaagaaataaattgcaagtgccaacttttggagtattcgatgacgattttgaatcggatagggattcagagacggagccagaggaagaagaacaaccaagcacaccgaaatatttaagcttggaacaaagagaagctaagacaaatgaaatcaaaaaagaatttgtaagtgattttgaaactttacttctaccaagtggtgtgcaagaattcataatgagttctgaactctataatagtcaaattgaatcgaaaataacgtacaaaaggtctcgtgatatgtgtgaaatttccaggctggtcgaagtaccgcaaggagttaatccaccatctcccttggatgcattcagatctactcaacagtgggacgttatgcgttgttcgttgcgtgatattattataggctccgaaaggctgaaagaagattcatcgtcaatttatgccaaaattctagaaaatttcagaactttagaaatgttttcgttattttataactattattttgctattactcctttagaaagggagattgcatacaagattctaaatgagagggattggaaagtttcaaaggatggtacaatgtggtttttaagacaaggtgaggtcaagttttttaatgaaatttgcgaagttggtgattacaaaatttttaaactggacgattggacagtaattgataaaattaacttcagactggattattcatttttgcagccaccggtagatacagcgtctgaggtccgtgatgtgagtgttgacaataacaatgttaatgatcagagtaatgtaactttagaacaacaaaaacaagaaatttctcacggcaagcagctcttgaaacaattgaaacagggaaaaattagtgtatga

SEQ ID NO: 4957 - DNA, 2514 bp, Saccharomyces cerevisiae
atgaacgacccttctttactaggctaccctaatgtgggcccgcagcagcaacagcaacagcagcaacagcagcatgccgggctactaggaaagggtacaccaaacgctctacagcagcagctacacatgaaccagctcaccgggatacctccaccgggactcatgaacaacagcgatgtacacacttccagcaacaacaactcgcgccagttgctcgaccaattggctaatgggaacgcgaacatgctcaatatgaacatggataacaacaataacaacaataacaacaacaacaacaacaacaacaacggcggtggaagcggggtgatgatgaatgcctccacagccgcagtaaattctatagggatggttcctaccgttggtacgcctgtgaacatcaatgtgaacgccagtaaccctttattacacccgcacttggatgacccttctttactaaacaatccgatctggaagcttcaattgcatctggctgcagtgtccgcacaatctctggggcaacccaacatttatgctagacaaaacgctatgaagaagtatttggctacacaacaggctcagcaagctcagcaacaagcgcagcaacaggcacagcagcaggtcccgggcccatttggccccggacctcaggctgcaccaccagctttgcagcccaccgatttccagcaatctcacattgcagaagcctccaaatcactggtagactgcacaaagcaagccttgatggaaatggccgacactctcaccgacagcaagacagcaaagaaacaacaacctacgggagatagcactccctcaggcacggcaactaacagtgcagtttctacaccattgactcccaagatagagctgtttgctaatggcaaggacgaagccaaccaggcgctcttacaacacaagaaactgtctcagtacagcatcgacgaagatgacgacattgaaaacagaatggtcatgcccaaggactcgaaatacgacgaccaattatggcacgcgctagatttgtccaacttgcaaatcttcaatatcagcgccaacatcttcaagtacgattttctaacgagactatatttgaatggcaatagcctcacggaactgccagcggagatcaagaacctaagcaacctacgcgttttggacctgtcgcataataggttaacatctctaccagcggaactaggctcatgtttccaattgaaatacttctacttttttgataacatggtcaccacattaccatgggagtttgggaacctgtgtaaccttcagtttcttggtgtagaaggaaaccccttagaaaaacagtttttaaagatccttacagaaaaatctgtcacgggattgattttctacctaagggacaacagaccagagattcccttaccgcatgaacgtaggttcatcgaaatcaataccgatggggaaccacagagggagtacgattctttgcagcaatccactgagcatctggccaccgatttagccaagaggacgttcaccgtcttatcctacaacaccttatgtcaacactatgccaccccaaaaatgtaccgttacacaccgtcgtgggcgttaagttgggattacaggcgcaataaattaaaggagcagattctctcgtacgacagtgatctgttgtgtttacaagaagtggagtctaagacttttgaagagtattgggtgcccctattggacaagcacggttatacaggcatcttccatgcaaaggcaagagccaagaccatgcattccaaggactccaagaaagtggacgggtgttgcatttttttcaaaagggaccaattcaagttgatcaccaaagacgccatggatttcagcggtgcttggatgaaacacaagaagttccaaagaactgaagattatttaaaccgtgcaatgaacaaagacaacgttgcactgttcttaaagctacaacacattcctagtggcgacaccatatgggcggtcaccacgcatttgcactgggatccaaaatttaatgatgtcaagacattccaagtaggtgtcctgttagatcatctggaaacgctgctaaaggaggagacatcgcacaattttagacaggacattaagaaatttcctgtgctcatttgtggtgacttcaattcatacatcaactccgccgtatacgaattgataaatacaggccgtgtccaaatacatcaagagggaaatggtagagatttcggttacatgtcggagaaaaatttctcacataacttggctctcaaatcaagttataattgtatcggagaactaccattcaccaatttcacaccgtcattcacagatgttatcgactatatatggttttctacacatgctctaagggtgcgtgggctattgggtgaagtggaccctgaatacgtgagtaagtttatcgggttccccaacgacaaattccccagtgaccatataccattgttagcaagatttgaatttatgaagacaaacacaggcagtaagaaagtataa

SEQ ID NO: 4958 - DNA, 2514 bp, Saccharomyces cerevisiae
atggttaaagtaaagtcgaaaaagaactcattaacaagttctctagataacaagatcgtcgatcttatctatcgtctcttggaagaaaaaactttggacagaaaaaggtctctgagacaagaatcccaaggagaagagggcgagaacaacgagggtgaagaagatgaggatatatttgaatccatgtttttcgctaaagatttaacagcaggtgagatttttaccttttgtttgactaaagatttatcacttcaaagagttaagaaagttgtcttacaaaagacaattgaccgcatgctaaaagacgtgattgaatcagaattggaagaatttggttcttacccaggttacaacaacgaagaggaagagaaaccaagcttggaagaagaactagctaagaaaaatatgatgattgagcgagacacaaatgagatgaacaaacgcataactagcacgtggtccaaatctggatctgtttccgagtctataacagaaactgatgatcctaagacagaagaggttaaaaaatctaaaaaaagatccaaagaaggtacatgtaaggtaaaacgtcaaaaaatcaaggaagatagatctccacctaattcgtctctgaaatccttaggtggtatggatgatgtcgttgcacaacttatggaactaataggtctacccattcttcatccagagatatttttatccacgggtgtcgaaccacctagaggtgttctgttgcatggcccaccgggttgcggtaagacgtcgattgctaatgcgttagctggagaattacaagtcccatttatatctatttctgcaccttcagtcgtaagtggtatgtctggggaaagcgagaaaaagattagggatttgtttgatgaagcgagaagcttggcaccatgtcttgttttctttgatgaaatagatgccattacaccaaaacgtgatggaggagcccaaagagaaatggagagaagaatagttgcccaattattgacctcaatggatgaattaacgatggaaaagacaaatggaaaacctgttattatcataggtgccacgaatagacctgactctttggatgcagcattgagaagagcaggtagattcgatagagaaatatgcctgaatgtcccgaatgaagtctcaaggttacatattttaaagaaaatgtctgataacctaaaaattgatggtgctatcgattttgccaaattggcaaaattaaccccaggctttgttggcgctgatttaaaggctttagttactgctgccggtacatgcgctattaaaagaattttccaaacctatgctaatataaaatccacaccaactacggcaacggacagttcagaagataacatggaaattgatgaaacagcaaacggagatgaatctagcctgaagaacactgcgaatatgatcgatccgttgcctttatccgtagtccaacaatttattcgtaattatcctgagcctttatcaggagagcagttatcattattatcgattaagtacgaagattttttgaaagcgttgccaacaattcaaccaacagcaaagagagaagggttcgctacggtacctgatgttacttgggctaatgtaggcgcattgcaaagagttagacttgaattaaatatggctattgtgcaacccatcaagagaccagagctttatgaaaaagtgggaattagcgcccctggtggtgttttattgtggggaccaccaggttgtggtaaaacgttactagcaaaagctgttgccaatgaatctcgtgcaaatttcatatcaatcaaaggtcctgaattattaaataaatacgttggtgaatcagaaaggtccatcagacaagtttttactagagcaagggcgtctgtaccgtgtgttatattttttgatgaactggacgctttggtgccaagaagagatacttctttgtccgaatcctcctcaagagtcgtcaacactttgttaacggaattagatgggctgaacgatagaaggggaatttttgtgattggcgccactaatagacctgatatgattgatcctgctatgttaagaccgggcagattggataagagtttgtttattgagttacctaatactgaggaaaaactagatattatcaaaactttgaccaaatcacacggaacacctctgagtagcgatgttgattttgaagaaattatcagaaatgagaagtgcaacaatttttcaggcgctgacttggctgctttagtcagggagagttcagtcttggctctaaaaaggaagttttttcagagcgaagaaatacaatctgttcttgataatgacttagacaaggaatttgaggatctatcggttggcgtatctggcgaagaaattattgtgaccatgtctgacttccgaagtgcattaagaaagattaaaccctctgtgagcgataaagatagactgaaatatgatagattaaataagaaaatgggtttaacggaggagatgaaggatgcggaagaaatgaaacaataa

SEQ ID NO: 4959 - DNA, 2514 bp, Saccharomyces cerevisiae
atgttttcatcatcatctcgaccttcaaaagagccattactatttgacatcagacttagaaatttggacaatgatgttttactgataaaaggcccccctgatgaggcatcttctgtcctactatctggaactatagtattgtcaattactgagccaattcaaatcaagtctttggctttgagactttttggtaggttgagactaaatattccaacggttttacaaactgttcatgggccgcataagcgatactcaaagtttgagagaaacatatattctcatttttgggatgattttaatataaaaagttatttccaaaacttgtacgataatcataataatggtaaaataacaatttctagtaaatcctcaacaaatttagcagcattgccaaagagaaaaagagccctttctactgcatcattgatatcaagtaatgggcagacaagcgcaagcaaaaactatcacaccttagtaaaaggtaactacgaattccctttcagcgcgattattcctgggtcattagtggaaagtgtagaaggcctaccaaatgctgccgtcacttatgctctggaagctactatcgagagacctaagcagcccgacttgatctgtaaaaaacatctaagagttattcgaacgttagctatagatgcagtcgagttatctgaaacagtatcagtggataactcatggcctgaaaaagtcgattatacgatctccattccaactaaggcaattgccattggctcttccaccatgatcaatattttaattgttcctatattaaaaggattgaagttaggccctgttaggatcagtttggtggaaaattcccagtattgtggtagctatggaggggttatcaaccaagaaagaatggtggctaaattaaaactaaaagatcccctgaagcacgttgcccaaataaagaagaagaggagcctaaatgaagctgccgacgaaggggttgatacggacacaggggaatttcaagataaatgggaagttcgagctttattaaacatacctgcaagcctgactaaatgctcccaagactgtcgcattttatctaatatcaaagtccgtcataagatcaagttcactataagtttactcaatccggacggtcatatttcagaattgcgtgcggcactgcctgtccaattattcatttcaccgtttgttccagtcaatgtaaagacctccgatgttattgaaagaacgctcaaaacgtttggaccctcatatcaagtaacaagtcagcacgataattcattcagcagcaaaaactttgtagacgatagtgaagaagatgtgatttttcaaagatctgcttctgcgttacaattgtcttcaatgccaaccatagtatctggctctactttaaatatcaatagtactgatgcagaggctaccgcagtcgctgacacaactatggtaactagtttgatggtacctcccaactacggcaatcacgtttacgatcgagtgtatggcgaggtaactaatgaagacgaaacttcagcatcagcttcttcaagtgccgtcgaatcacaggcaattcacaatattcaaaacctatatatatcggatagtaacaatagcaataatcctattttggcaccaaatcctcaaatcaagattgaagatgatagcctaaataattgtgactctcgaggggacagcgttaacaatagtaacctgaatctggttaatagtaatctaacaattagtgaaaattggaacaataactctccttctgcaaatagatataataacatcattaatgctggattgaatagtccttcactgacaccaagctttgcacatttatctaggcgtaactcatatagtcgccaaacatcttctacatcgctgaagaacgatttggaactgacagatttaagcagagttccctcgtatgataaagcaatgaaatctgatatgattggtgaggatcttccaccggcttatcccgaggaagaacttggagttcaagaaaataaaaaaattgaactagaaaggccacaaattcttcatcacaagtctacatcctctttgttgccacttccaggctcgagcaagagttccaataatctgaaaagatcgtctagtaggacacatttatcccactctccattaccaaggaataatagcggatcctcagtatcattgcagcagttggcgagaaacaacacagatagttcatttaatctaaatctctctttcacttcagcaaaaagcagcacaggaagcagacattttccgtttaatatgacaacatctttcactagtaattcaagttccaagaacaattcacattttgataaaactgattctacatctgacgctaataagccaagagaagaggaaaactatacgagcgcaacccacaatcgaaggtcacgctcatcgtcagttcggagcaacaatagcaactcaccattaagacaaggaacaggttcatttgctaatttaatggagatgttcacaaaacgggatcgctcatag

SEQ ID NO: 4960 - DNA, 2517 bp, Saccharomyces cerevisiae
atgtctgaatatctagctcagacgccctgcaaatttactatatggtcaagcgagattgatcttatcagaacaaacctgttggtgaacgctcaccctttaagcacggttgggcgactacttcaatatatccattatcaaatatacaagcaattaagagctatctatcaaccagaggaacagtgcacgaactcggaaatacctcacacacccttaaatagtatcaacacttacttcctaagttacgaaggcagagagttatctgcaacgtgtttattaaaggacatcacgtcatctagccacccagattcgaaccatttcataagactacaactggaaaagcgtacttctccttccggttcagcatttgacttggaatatgatatggagggcgaatttaactcgatgaatattcaatttgagataaatacactatcttctcaacgtatattcaattccatggaaccaaatttgcctattggcactacattggctagattagagaaactggcattggaacgtataaaggattttgaaaaatcagcagggaatctctgtggtattaaagaggaccattcagtgtctgatttgcagggatttataataaaggggaaacagacacccatgtttttaaattatggaagtgattctgattactataaagacttgaacctggtagatttgataggcattgattttgccccggcacacaattcttttttcacatttttgttcaagatgaatcacgaacagaattcacatatcgccaacgatgaagagagatttgtgttggaattcatatccgatgccacattatctataactcaaatgaatgttaagcccgataccacggtaaaacaagtgaaagatttcatatgttctgtttacactcactcattaaacttgaggagaaatgatatcaagttgatttataagggacagttgcttcatgaaaataattttgcaggcaactcttcaaagatcagcgagtacattaaagagccacatgaagtgaaggtccatgtacaaatcaaccaagagtatacagaatctgggcctggattttggaatgaagtgttcaacaatccgaatattttccaattcatgcctccagatacaaggtcacagtcacctgttagtttcgctccgacgcaaggacgatctcctgctgcaatacgtggcgaagaacggggtataccatacgtaaccgaatctggaaatgacatcgtgcccacagatgagctttataggaaatgcattatcaacggggatgaagtagtattcattcctgttagcgaactaaatccacaatcgagctatttgtccgtgatcaaaggcgattacggtgaaattaaaatccccatatctagtaatgactacagaattaatggcgataatattttgctatcaccatctgcgatagagcagttagaatctgctttgaacttcaaaatcgagagaccacgggattcgacactcttgcatccgtctggtgagcatgttcgagctgcagataatacctcttcggcaaatgataataatacagttgagaatgacgagtcagcgtggaatagaagggtagtgcgtcccttgagaaacagcttcccgctgctattggtattgataagaacattttacttaattggctataattcattggttcccttttttattattttggagtttggaagcttccttccctggaaatatatcattttactaagcttgcttttcatttttaggactgtttggaatacccaagaggtgtggaatttatggcgagactatctccacttgaatgaaattgacgaagtcaagtttagccagatcaaggagttcatcaattccaattcattgaccttaaatttctacaagaaatgtaaggacactcaatccgctattgatttactgatgatacctaatctacatgagcaaaggctatcggtctattctaagtatgatattgagtacgacaccaacacccctgacgttggacaattgaatttgctatttatcaaggtgctatcgggtgagattcctaaggacgcgctagatgagttgttcaaagagtttttcgaattgtatgaaacgacaagaaacatgaacacactatatcctcaagactctttgaacgaattgctgctgatgatttggaaggagtcccaaaagaaagacatcaatacgctacccaagtacagaagatggttccaaaccttgtgctcgcaaatagcggagcataacgtccttgatgtcgtactcagatacataattccagacccggtaaacgatagggtgataaccgctgtgataaagaacttcgtgctcttttgggttacactactcccctatgtgaaggagaagctggatgatattgttgcacagagagcaagggaccgtgagcaaccggctccatctgcccaacagcaggaaaacgaagatgaggccctcataatccctgacgaggaagaacccaccgccacaggtgcgcaacctcatctctacattcctgatgaagactaa

SEQ ID NO: 4961 - DNA, 2517 bp, Saccharomyces cerevisiae
atgttcacatttatacccatcacccatcctacatcggatacaaagcacccattgctgctagtccagtctgcacatggggaaaagtatttcttcggtaaaattggtgaaggatcccaaaggagtctgactgaaaataagatcaggatatccaaattgaaggatattttccttactggtgaattaaactggtcagatataggtggattacctggaatgattttgactattgctgatcaagggaaaagtaatcttgttttgcattacggcaatgacattttgaattacatagtttccacttggagatacttcgtctttagattcggaatagacttgaacgatcacattatgaaagacaaggaagtatataaagataagataatagctgttaaatcctttaatgttctgaaaaatgggggggaagacaggttaggcgtcttcgatagttttcaaaaaggtgtattacgttccatagtagcaaaaatgttccccaaacatgcacccaccgataggtacgatccttctagtgatccgcacttgaatgtagagttgcctgacttagacgccaaagtggaagtttctacgaattacgagatttcattcagtccagtgaggggtaaatttaaagtggaggaagctattaaactaggtgttccgaagggtcccttatttgcaaagttaaccaagggccaaacaattactttggataacggtattgttgtaactccggaacaggtattggagaatgaacgtcattttgccaaagtattgatcctggatatcccagatgacctatatttgaacgctttcgtagaaaaattcaaggattatgattgtgctgagcttggcatggtgtattattttcttggtgatgaggttaccattaatgataatctattcgcgttcattgacatatttgagaaaaacaattatggtaaagtaaatcatatgatatcccacaataaaatttctccaaacacgatatcatttttcggttctgcattgaccacattgaaattaaaggcactacaagtaaataattacaatttaccaaaaacagatcgtgtgttttccaaggacttctacgacagattcgatacaccactcagcagaggtacatctatgtgtaaatcccaggaagagcctttgaatacaataatagagaaggataacattcatattttttcacaaaacaagacagtaactttcgaaccatttcggatgaacgaagaaccgatgaaatgcaacatcaacggtgaagtggcggatttctcgtggcaagaaattttcgaagaacatgtaaaaccattagaatttcccttagctgatgtcgatacagttatcaataatcaactacacgtggataactttaacaattcagcagaaaagaagaaacacgttgaaattatcaccttaggaaccggtagtgcattgccttctaaatatagaaacgttgtctccacacttgttaaagttccttttactgacgccgatggaaataccataaatagaaacattatgctagatgctggtgaaaatactttaggtaccatacacaggatgttttctcagctagcagtcaagtcaatatttcaggatttgaaaatgatatatctgagtcacttgcatgcagaccaccatttgggaataatcagcgtgctaaatgaatggtacaaatataacaaggatgatgaaacgagttatatatatgtggttactccatggcaatatcacaaatttgttaatgaatggttagttctagaaaataaagagattttaaagagaatcaaatacataagttgtgagcatttcatcaatgattcgtttgtaagaatgcagacacaatctgttcctttggcagagttcaatgaaatattgaaagaaaatagcaatcaagaatcaaacagaaaactggaactggatagagattcttcatatagggatgttgacttgatcagacaaatgtatgaggatttatcgatagaatattttcaaacttgcagagctatacattgtgactgggcatattcgaactcaattaccttccgaatggacgaaaacaatgagcataatacattcaaggtttcatattcaggcgatacaagacctaacatcgagaaattttccctcgaaataggctataattcagatctattaattcacgaagctacactagaaaatcagctactggaggatgccgtgaagaaaaaacactgcactattaatgaagcaatcggtgtttcgaacaaaatgaatgctaggaagttgatcttaacacacttttcccagagatatcccaaattgccccaattagacaataatattgatgtgatggcgagagaattttgttttgctttcgacagtatgatcgttgattatgagaaaattggtgaacagcagcgtatttttccactgctgaataaggcatttgttgaagaaaaggaagaagaagaagatgttgatgacgttgaaagcgtacaagatttggaagtcaaacttaagaaacacaagaaaaattag

SEQ ID NO: 4962 - DNA, 2520 bp, Saccharomyces cerevisiae
atgctggagacgttgcgcggaaataagctgcattctggcacctcaaaaggcgccaacaaaaagttgaatgaactcttggaatcgtccgacaatctaccatcagcatcctctgaattaggttcaattcaagtaagcattaatgaattgagaagacgtgtttttcaattgagaagcaagaacaaagctagcaaggactatactaaagcccactatttattggctaacagtggcttaagctttgaagatgttgatgctttcatcaaagacttgcagacgaatcaatttttggaaccaaatccaccaaaaataattgaaagtgaggaattagaattctatataagaactaaaaaggaagaaaacattttgatgtctatcgaacagcttttaaatggcgctacaaaagattttgataattttattaatcataacttaaatcttgattgggctcagcataaaaatgaagtcatgaaaaattttggcatccttatacaagataagaaaactgtagatcacaaaaaatccatcagttctctagaccctaagcttccaagctggggtaataagggcaataacattttaaatagcaacgaatccagattgaatgtcaacgaaaataatatccttagggaaaagtttgaaaattatgccagaattgtgtttcaatttaacaatagtagacaagcaaatggaaattttgatatagccaacgaattcatctcaatattatcttctgcgaacggaacaagaaacgctcaattgctagagagctggaagattctcgaatcgatgaaaagtaaggatattaatattgttgaagtcgggaaacagtacctggagcaacagtttttacaatataccgacaatttatataagaaaaacatgaatgaaggattggccacaaatgtcaataaaatcaagtcattcattgatacgaagttgaagaaagcagacaaatcatggaagatttctaatttaactgttatcaatggtgttccaatatgggccttaatattttatcttttaagagcaggtctaatcaaggaagcattgcaagttctagtggagaataaggcgaatatcaaaaaagtagaacaatcattccttacttatttcaaagcatatgcttcttcaaaggaccacggcctaccagtggaatattccaccaagcttcatacagaatacaaccaacacataaaaagttcactagatggtgatccttatcgtctagctgtctacaagttgatcggaagatgcgacttgagtagaaagaacattcctgcagttactttaagcattgaagattggttgtggatgcatctcatgttgatcaaagaaaaggacgcggagaatgatcctgtttatgaaagatattccttagaagacttccagaatataataatatcgtatggaccatctcgcttctcaaactattacttacagacccttttgttaagtgggctctatggattggctattgactatacttatacatttagtgaaatggatgcggtgcatttggcaatagggctagcaagcttgaagctatttaagattgatagctcaacgcgcttgaccaaaaaacccaaaagggatatcaggttcgcaaacatactagctaattataccaagtcctttaggtattcagatcctagagttgctgtcgaatatttggttttaataactctaaatgaaggacctaccgatgtcgagttatgccatgaggcgttgagggagctagtattggaaactaaggaatttactgttcttttgggtaaaattggacgcgatggagctagaattccgggggtgatcgaagaaagacaacctttattacacgttcgtgatgaaaaggagtttttgcatacaattacagaacaagcagcaagaagggcagacgaagacggcagaatatatgatagtatattactgtaccagcttgctgaagaatatgacatagttattaccctcgtcaatagtttattaagtgatacacttagtgcgtcagatttagatcaaccattggttggacctgatgacaatagcgagacgaatcctgtcttgttggctaggaggatggcgtccatatattttgataatgctggtatatcgagacagattcatgttaaaaacaaagaaatttgtatgctgctcttaaatatctcctctatcagggagctatatttcaataaacaatggcaagaaacactatcccaaatggagttattggatttacttcctttctcagacgagctatctgctagaaagaaagcacaagatttctctaatttagatgacaacattgtgaaaaatattccaaatttgttgattatcactctaagctgtatatcgaacatgattcatatcttgaacgaaagtaagtatcaatcgtccacaaaaggtcaacaaattgattccttaaaaaatgttgcgagacaatgtatgatttatgctggtatgattcaatacagaatgccaagggaaacgtacagcactttaattaatatagacgtctctctatga

SEQ ID NO: 4963 - DNA, 2520 bp, Saccharomyces cerevisiae
atggatttcgttgtagactatcagacctacgcaatggcggatactgccacgccagaattaccagaacctgagccaagactaaacttaacctcagatgcacagtcacagcccaccggtaaactagatctacagtttaagttgcccgaccttcaacgttattccaataataatgcaactttgccagtagataatgatggtgctggttcgaaagacctacataagaaaatgacacattacgcaatgtcttccattgataaaatacagctttcaaatccaagcaaacaattagggcaaaattcccaggatgaaaaactatcgcagcaagaatctcaaaatttcacgaattacgagccaaaaaaccttgatttatcaaaattagtatccccgtcaagtggttccaacaaaaataccacaaatttggttctttcgaataaactatccaagatattgaacaattacacattgattaactatcaggccacagtccaactaagaaaatccctaaaggttctagaagagaataaagagagattgtcccttgatgaacaaaagctcatgaatcctgaatatgtaggtactttggcaagaagagcattgaggactgatttggaatctcaactgctaaaggaacatattacggtacttgaggaattcaaacctatcattagaaggattaaacgattatcttcttccgtcgaaaaaatacaaagaacgagcgaaaaattactaagtaatgagacaaatgaggttccaacaaataacgtggtacttcaggaaatagatcaataccgtttaaaggcagagcagttgaagctgaaaaaaaaaatactgttatctataagggataggtttactttgaatcaggtagaggacgatgtaatcaccaatggtactatagacaacatctttttcgaggtagtaaagaaagtaatcaatattaaagatgaatcaagtttcttgctgacgcttcctaatttgaatgctggaaatgctttgataatgggagttaatgaaattttagaaaagacaaacaaaaaaatcttcaattatttgatcgattttttatatagttttgaatcctcttcaaatttattaaatgaccatggtactactgaacaagaaagcttaaacatttttcggaagagtctggtcttcctgtcaagtgatctagaattatttaatgagttgttgaaaagagtgaccacactgagatccaagagtattctggatgagtttttgtctcaattcgatatgaattcaactacctctaaacccatcatattatcggcacacgatccaattaggtatattggtgacgtactagcgtccgttcattccatcatcgcaaatgaagctgatttcgtgaagtcactatttgactttcaggatgaagacttaaaagataccccaatttctatacttcaacaaaacaagacattcttgaaaggcatcgacaacaaattgctgaacgatatcatccagtcgctatccaattcgtgtcgtattcgtatcgagcaaatcgtgaggtttgaagaaaatccgatcatcaatttcgagattgtgaggctgctgaaactttacagagttatgttcgagagaaagggaattcaggacgatagttctattattaacaatttaaagtcgttggaagacatttccaaaaacagaattattggatactatgaagactatatgaagcaaacagtcatggcggaaacaaaaaattcttcagatgatttactgccaccagagtggctatcagagtatatgaataaattggtagagttatttgaaatttatgaaaagacacatgctgccgaagatgaggaatcagaagataataaattgctctcatctaagaatttacaaacaattgtagaacaaccaataaaagatgttctgttaaaacaattgcaaacatcttttcctttggcgaaaaaaaatgaaaaagaaaaggcatcattgctaactatagagataaactgtttcgatttaattaaatctagacttcaaccttttgagggattgtttgcacaagatgatgacagccggaaaatcaccatctgggtttgtgataaactgaaggaatatactaagcaaatgctaactttacaaataaaattcctatttgagaatacaggtttagacctttacagcaatttggtcaatatgatttttcctgtggactcagtaaaggatgaattggattatgatatgtacttagccctgagggataattcattgatggaattagacatggtcagaaaaaatgtgcatgataagttgaactattatctacctcaggcgttaacagatgttcaaggtaatttactatttaaattaacgtcaccaatgatagctgatgaaatatgcgatgaatgtttcaagaagttgtcgctattttataatatcttcaggaaactgttgattcatttgtatccgaacaagaaggatcaggtattcgaaattttaaatttttccactgatgaatttgacatgttgataggtattgatcactga

SEQ ID NO: 4964 - DNA, 2523 bp, Saccharomyces cerevisiae
atgaaagtggtaaagtttccatggttggctcaccgtgaagaatcgcgaaaatatgaaatatacacagtcgatgttagccacgatgggaaaaggttggccacaggcggcctagatggcaagattaggatatggtccatagattccattttgcgttgcatggaactagaatctctaactcctgagatacctcttccgcaagacttgcagatgccgttatgtagcatgagtaggcataccggctcgataacatgtgtcaaattctcaccggatggaaagtaccttgcaagtggatccgatgatcgaattttactgatatgggctcttgacgaggagcaaagctcacaacccgcctttggttctgagcatgagagagagcattggacagttcgtaaaagattggttgcacacgataacgacatacaagacatttgctgggcgccagactccagcatactagtgacagttggtttagatagatctgtcatagtctggaacggttctacatttgaaaaactgaagagatttgacgtacatcaatcacttgttaagggcgttgtttttgatcccgctaataagtattttgcgactacatctgatgatagaaccatgaagatatttagatatcacaagacgggggatatttcttttacaatagagcatataatcaccgagccattcaaagaatcacccttgactacttattttagaaggccatcgtggtctcccgatgggcaacatattgcagttccgaacgccactaatgggcccgtaagttctgtggcaattgtaaatagaggaacttgggatacaaatgttagtttaattggtcatgatgcacctacagaagtcgcaaggtttaatcctagattgtttgagagaaatgcgggtgtcaagcaaaaaaaagacgatgacccagaaaatgctctagtggggcaaaacgatgataaagttcaccattttgataaaaacatcgactctgttgtggcaacagctgggcaagataaatccttagcggtctggagtacaagtagaccaaggccaatattagttgctttcgatatcgcaaataaatcaattactgatatgtcttggaatccagacggctctttattatttgttgcgtcattagactcttcaatcaccttgtttaaattcgaaaataatgaactaggcaagccaattcctttggaaaaaaatatggagcagttatataggtacggtgttgacaaggactcattagatttccctgaaagtatcaaccaactgttactcgaagatcagacaaaatcatttaagcatacaaaaatttcaacatcgaaactaggtgaaaaccacccgacacttgcaacaaattcagcttcaaatcaaaaagataacaatgatgcttctgtctctagaagtgaacatataaatatcttgattccaaagaggaaaaaggatgctatactgaataaagccgtaactcttaaaagcggtaaaaagcgtgtggcaccgacattgatatcgacttcatcatcttctcccttttctaatggaatcaaaaagcctacattggatagtaaaaggattgaaaataatgtaaaatcatccaccaagaccattaacagtaaaaatacattgctaaatgtgccagaaggcgttgaaaagaaaattagtatctcatcgttcccattgccaaggttgggcatacattctttgattatgggtacaaaagaaaggagtgcatggaaaatctcaaattcagagctggagaatgatgatgcagataatgcgggtggtaagggttcagatggtacgagcaacagtattgacgacattgcagttctctcagaggaagaaaatgactttcataggatgactttgaacgccaagctaacccaggagaagatctggagcgaagagccgacaacacgatgccttctgcagtccgatgtcataccagacacagatgttgtcgttcttgaggggggtagtttagacgatatagccgttttagaaataagaaacggtgttgagagatcaatacaatttgattctgaagcacttttagataatcctaccagaatcttaggctatcaaggaggtaaaagaaccatcgagacctttattccagaagttatcatttgtgcaataggatcaaaagattgtaagtgctggtgcctagcttcagctaatggctctatttacatactttcatacaatggacagcagagaatcccaaaaatttgcctaggacataaagttattaaaatggtaacatcaagcaaatacctccttgttctaactgaaagaggtttattttttgcatgggacttgctggatttaaaattagtactgcgaaatgtacctatattaccaattttgaacggtcagccaattcatggaaacaaggtaagaatcaacaaggttattaaatgctttcgtttggatggttctagttgtgatttgcttttagaggttggcgatcctaaaaatgtgtataaatggactaaggatctgggttgttggtcgttatataaataa

SEQ ID NO: 4965 - DNA, 2523 bp, Saccharomyces cerevisiae
atgaagttttgtctttattgctgtcattgttatatcgttatttgtggaaaggctacacattattacaagtcatcaaaagccacatcaaacttgaaatcgtcaaacagggtacttatgagaaaccccatgtcgccttcggagcaacattcacaacataattctacattggccgcctcgccatttgtttctaacgtatctgcagcaagaacacaacagagtttaccaaccgatgctcagaatgatcgtttgcagcaaccctggaacagaaccaatacggctacgagtccctaccagtcgttagcaaatagccctttaatacagaagttgcaagcgaatattatgactccgcaccagccatctgctaattctaattctaattccaattccattacgggcaatgttgtgaacgacaataatttgttagcttctatgtctaagaatagtatgttcggttctaccataccgtccacattaaggaaggtgagcttacagcgtgaatataaggattcagttgatggtgtggttcgtgatgaagataatgatgaggatgttcataacaatggcgatgcagctgcgaatgctaataatgatcgggagagtaaactagggcataatgggccattgacgacaacaacattaacgacaacaactacagcaactcaactagatgtttctgaattgtcagctatagaaagattgagactttggaggttcgacgcattgatgcagcatatgtataggaccgcagaatatattgctgataaagtgtataacatatccaatgatcctgatgatgccttctggctcggccaagtatattacaataataatcagtacgtaagggctgtagaacttattaccaggaacaacttggatggcgttaatatcctgtgtcgatatctgttgggactctcctttgttaaattacagagatttgatgacgctctagatgttataggcgaatacaatccattcagcgaggacccatctacgacggcagcaaacaccatgagcaataatggcaataacagcaatacgtcacagccagttactgacggcggtataaaaatggagtcatcattatgttttctgagagggaaaatatattttgcacaaaataattttaacaaggcaagggatgcatttcgtgaagcgattttggtagatataaaaaattttgaagctttcgaaatgctcctgtccaagaacctgttaactccacaagaggaatgggacctgtttgactctttggatttcaaagaatttggggaagataaagagattatgaagaatctttataagatcaacctatctaaatacatcaacacggaagatataacgaagtccaatgagattttagcgaaagattataaattagctgacaatgtagatgtcgtaagaagtaaggtggatatctgctatacgcaatgcaaattcaacgaatgcttagagttgtgcgagaccgttttggaaaacgacgaatttaatacgaatatcttgccagcatacattggatgtctatatgaactatcaaataaaaataagcttttccttctgtcgcatcgattagcggaaactttcccgaagtctgcgataacatggtttagcgttgcgacctattatatgagcttggacagaattagtgaagcacagaaatactattccaaatcctcaatactggatccaagctttgctgccgcatggctgggatttgcacacacgtatgccctagaaggtgaacaagaccaagcattaacagcatactctacagcctccagattctttcctggaatgcacttaccaaaactgtttctcgggatgcagtttatggcgatgaattcattaaatttagcagaatcgtattttgttctggcatatgacatttgtccaaacgatccattagtactcaatgaaatgggtgtaatgtattttaagaagaacgaatttgtcaaagccaagaaatacctgaagaaggcgttggaagtggtgaaagatcttgatccaagttcaagaacgacaatatcaattcaattaaatctaggacacacttacagaaagttaaatgagaacgaaattgccattaaatgttttagatgcgttttggagaaaaatgataaaaactctgaaattcattgttccttaggttacttatatttgaagacgaagaaattacaaaaggccattgatcatttgcacaaatcattgtacctaaagcctaataattcatctgcaacagcgcttttgaaaaatgccctagagctaaacgtgacgttatcattggatgccagccacccacttattgacaagtcgaatttaatgagtcaggcaagtaaggacaaggcttcgctcaataaaaaaagatcttcattgacttatgaccctgtcaacatggctaaaaggttgagaacacaaaaggagatctttgatcagaataacaaagctctaagaaagggaggtcatgacagcaaaactggaagtaataatgccgacgatgattttgacgcagatatggaactggaataa

SEQ ID NO: 4966 - DNA, 2523 bp, Saccharomyces cerevisiae
atggatgatctgctaaaagttcccgagattgtaaccaatattgcctcatatttatctactgtagattatctgagttttcaacaagtgaataaacgggtttatgcaatcattaacggcaaaaatgattcaaagtattggtcattgaaattgactagaatgggtctccaacaggtgcattcaaatgaagaagaagaaattacgttgctggatgaaaatgataatcaaaattcccttcgcatcttcgaaatatacaaatctttcactgctcaaaattctaaaaaaatctttgtgaaattttaccgttgttataactcatacgctaggaagctatataataataatctagcaaatttctttcctacttcatattccaacgatccgttgaaacaaacaagaattctaaattttatcaaaaagtacaatttctcgaataaaaatgatatagaaacatttactaggattgaaactaatttcaacattcttagggaaatcttcattaattctgttctcaaagagtcagaattgaattaccagtctaataatttagctgccgtcgctcgtttcatgaaaattttattgatatctaatgaggaaagcaatgctatcgaatttttcaagtcaaaggctgatttgcctcccagtttaacggttttgccgtctaatgatgaattattttgggccgaacaaccaagggaagaggacagcggtgggagtaccgtgatatttaattctaaaaatttagatacgtttctcaatcagctaagggatttcctcaacgaaaagattaaattagcggacattttattcaaagatgagttccctgtaatattacagttcatcgagtcctttatccaagatattttattagatattttaaacaatatcttattaagctatagtgaatttttaaaagaaaatggaaaggatagtaaagccaattatgaatgcgtacccgaactttatttcacatttataaaaaagtttgatactgaattaaacgactcagtaaacgcaggcgcaaatttccgtaaagttgttcgtgaccttttaaacctgtatctcgagccctttgttgtcaactatatgaatcagacaactagagtatttgaatcattgatcaactcacaattagctaattatgacacacaagttcaagacaagcagcgtgagcaaaacgcaaaaatttataacactttaaaagatcaaacggatgcttcgagtgcaagtaacaatgaattgccgaatgacctctcaataattactgaaacctccaaaactgtcccagaagcggattcaaaaccaagtacgatccatcaatcagttcattcaactgatatttctaatgataaactagactttctaagttccttcaccaagattttcaagttctcgaacaatgaaaatcaaaggctaaagcaacaactacaactagcctacaacttaaatttaatttccaataacttgcaaaacattaaatcgttaataagtctcgatttatgttacaaaattttacaggaaacaagcgaaaagacggatcaaatttacaaatttcatacgattgaaagtttgctaccattgatcaagctacgctgtcaagagattttcaaaattttaattacacaattgaataaaaatcacgttaaacctgcatttgaaaaggcaatcctgctactacaaaaatataatcctaacgaaatagaacaaatagaaataaaattcaattcactttcgccagccaatactcaagtcgaacctttagtacaattcactgaacttatcaatataggtgacataatattacaaatgatttccattttttacaagaacgaattgattcccaaaaaaattatcgataaaaataaagattttcttaatgatgttatccaattaaaaaaaaattttgagacttctatcgatgattttgtagccgaaggtttaaatatcggtataaacaaactaatggatgaaatctcatttgtattcaagactcttcaattgcctgacgattataatccaccgccaccctctaggaattctccaataagggatataaagccaaccaaatgtgctatcagggtagtcgagttactttctaatcattgctttctactgactggtgccacagacaagggtactattgacgtgtaccaacaagaaattggcgagagattctttaatgaaatcgtcaaacatctgaagaagtgcttcatatctacggagggcgcaatttggttaatctgcgatttaaattacttttacgattttattgctaacaaattaaaacaaaaaaatgttgttccctattttgttgggcttaagtctattggccagttatacatcatttcaggcaaggactcgaaagagttgggaaagcttatttctgatcttgggaaattcaatggcatttttacgcaagaggaaatttatgaatttgttcagaggagaagcgattgggttcgtgtacggaaagacgttgaaaaggtaatgtacggcctaggcatacgagattgctgcattatgtaa

SEQ ID NO: 4967 - DNA, 2523 bp, Saccharomyces cerevisiae
atggcagagaaggaggaagcgatttttcgctctgctgaaatggctttagtccaattctatattcctcaagaaatttcaagagactctgcttacactttaggtcaattgggtcttgttcaattccgtgacttgaactctaaggtgcgtgcgtttcaaagaactttcgtgaacgaaattagaagactggataatgtagaaagacagtatcgttacttttattctcttttgaagaaacacgatattaagctctacgaaggagacacggacaaatatttggacggctcaggtgaattgtacgttccaccaagcggttcagtgatagatgattatgtccggaacgcttcatatttggaagaaagattgattcaaatggaggatgcaaccgatcaaattgaagtccagaaaaatgacttggaacagtatcgctttattttgcagtcaggtgatgaatttttcttgaagggtgataataccgacagcacttcctatatggatgaagacatgatcgacgctaatggggaaaacattgctgctgctatcggtgcttctgtaaactatgtcactggtgtcattgctagagacaaagttgccaccttagaacaaattctttggagagtattaagaggtaaccttttcttcaaaactgttgaaattgaacaacctgtttatgatgtcaaaaccagggagtataaacataaaaatgcttttatcgtattttctcacggtgatctgattattaaaagaatcagaaagattgcggaatcattggatgccaatctttacgatgttgactcttccaacgagggtagatcacaacaattggccaaggtcaacaagaatttgagtgatttgtacacagttttgaaaaccacttctaccactttagaaagtgaattatatgccattgccaaagaattggactcttggttccaagatgttacccgtgaaaaggcgatttttgaaattttgaacaagtctaactatgataccaatagaaagattttgattgctgaaggttggataccaagagacgaattggctactttgcaagctcgtcttggtgaaatgatcgcaagattgggtattgatgtcccatccattatccaagtcctggatacaaaccacactccacctaccttccacagaactaacaagtttactgctggtttccaaagtatctgtgactgttacggtattgctcagtacagagaaatcaatgctggtttacccacaattgtcactttccctttcatgtttgccatcatgtttggtgatatgggtcacgggttcttaatgaccttagccgcattgtctcttgtattgaatgaaaagaaaatcaacaaaatgaaaagaggcgaaattttcgatatggccttcactggtagatacattattttgttgatgggtgtcttttccatgtacacaggtttcctttacaacgatatcttctctaaaactatgactattttcaagtctggttggaaatggcctgatcattggaaaaaaggtgagagtattactgctacatcggtgggtacataccctatcggtttagattgggcttggcatggaactgaaaatgctttgttattttctaattcttacaaaatgaaactatcaattttaatggggttcatccacatgacctattcttatttcttttcgttggctaaccacctatactttaactctatgattgatatcatcggtaactttattcctggtttgctatttatgcaaggtatctttggttatctttccgtttgtattgtttacaaatgggctgttgattgggttaaggacggaaagcctgctccaggtttgttaaatatgttgatcaacatgtttttatcaccaggaactattgacgatgaattataccctcatcaagcaaaggtccaagtgtttttgttgttgatggccttggtttgtattccttggttgctattggtgaagccattacatttcaaattcactcataaaaagaaatctcacgaaccactgccatcgactgaagcagatgctagttctgaagatttggaagcacaacaattaatttccgcgatggacgccgatgacgctgaagaagaagaagttggttctggatctcatggtgaagactttggtgatattatgattcatcaagttattcatacaattgaattctgtttgaattgtgtttcgcacactgcatcctatttacgtttatgggccttatcattggcacatgctcaattgtctagtgttttatggacaatgacaattcaaattgcctttggatttagaggatttgtgggtgtgtttatgacggttgcactttttgccatgtggttcgcactaacatgtgcagttcttgttttgatggaaggtacatctgccatgcttcattccttacgtttgcactgggttgaatctatgtccaagtttttcgtgggtgaaggtttaccatacgaaccattcgcatttgagtataaagacatggaagtcgctgttgctagtgcaagctcttccgcttcaagctaa

SEQ ID NO: 4968 - DNA, 2526 bp, Saccharomyces cerevisiae
atggacctcccaactgttaatagcacaacaagcatttccgacaatgtggatttaaagaactactatgaggacttgcttttcaagaataacagcggaaaatcgctatccgatttaccccgtaaactgaatgataactccaataattcaggaagtgatacggttgatccgcttgctggcctgaataatttgagaaactcaataaaaagtgcgggaaatggtatggaaaacaggaggacttttgacgatattgattttatgggtaggtttccgtatttgccaccagtgccaaatcaacaacagcaaccgttttctcaccagaacgggttcattcaagaacacccttccagtaatttgacctcttttcaaatgtcttcgtctaattcagagccgatgtccgcaccgcccatttcatccaataacaataatttaaactctactcaaatgggtaattatcaagctcaacaacggtcgttcccgcaatttaatggaaattcatttcattcaaatggaaacgacctaatggggaatcggatggattcagactacatgcgtttaatgaataaaacaaacataggttttacttccaatagcggcagcaattttgctgccccatcacacagtgctggcaacccatctagtatgaacaaccaacaagtaccatcatttaattggcaacagccatctcatccagagtctaccattaggagatcctcctacatatcagatactctaatcaaccatcaaatgcctgacgctcggcaaaagcaaacatcccaagtgcagcagcaacacgctcaaggtttcaatcttttcaatagcagattcaactatgacaacttgaactcaacccatttgaccgccaaaggtgtgcccgagtttggaaatggtgtacaacctccgtatccttatgataacgagcctaataatgccagtatcagcaatagtaataacaacaacaacagtcacaatatggttccaatgcaacagtttcgccggaatacacaaccggtagcgagcttcaatccatcccttcctacttttcaacaacaacagcaacaaccacaacaaccacaacaaccaagaaacgttaatgtacctacttctttcaatggcgaacgtgttgatgatgttcagcttgttcaacttcaaagaagcagttctgtcccttcttctacaaactcacataaccttcagaacgagaacagcaatgaaggaaatgtatctttggacaatggtttagttttaattcagggtaaacacttgacttcgtccaaaaccttacacgatttatacagcgactgtggcagcggctattttgctagctctgcagtttttgaattcacagataatattaagaaaatgctgaagttgcacgattctaatgaaagttacgacgcgaagaacatgggcttaatcgatgaagaaggtaatacataccaatctttattaaatttcttggacattttaagaagttgcaacatgaattacgttaatgatccagagtcgaataatggaattgtttccaataatggaggcaataaaaataggaggaagggctctttcacaacagaactatcatgcaggaatgctaataactcctttttaccttatacaccattggtactggttgctttgaaaaatgggaaacttgaactactatctactccacaagctaccaatttgttgttaaagagaggtgacttggttattattgatggtgaccgtggaagggatttagtattggttgttgagccctctgtcgatttgaatttagcattatttataaattttctgaaaaagaaaattcactttgactctttaattacaagtgagtcacagcactatcgcaatgatgagtttattcaaatgttgattgactcaaaaaatgggcaaaagaaaaaattaaatcccaaattgtatgatgttgttgaattaactgagttaatcataccatctaaacaagtcttacgttttgccaccccgtgggaggtaacaacgaatttgcacaataaatttgaagatgaattaaaagccttgcatattgctcagagtaaattacaagcgttaaatgataattcaaaatctcaaaatacaaatgacagttcttccaataattttacgaatgctgcaacttattcaaagcctaaattgaatatcaagattttaaacgcagaattccaatttgatagaaagaaattaacgttttactacgtttgtgaggagagaaatgattttagagacttgataaaagagctgttcaaatattacaagacaagaatttggttgtgtgccatcccgaataatctgtctattgattctaagtattatgataaacaacaaaaagagctgaaattatatcaaaacatagtaaaaaattacaatgctgaagatttaatgaatgtcaatgagttttcgcagaacagggggaataacagagttaattttgcacctccgttgaacgaaattgaactcgacaactttcagattgctgtgtatgaagaattagttcacgaattatttcattaa

SEQ ID NO: 4969 - DNA, 2526 bp, Saccharomyces cerevisiae
atgggtaagacacaaaagaagaatagtaagggacgtttagatagatactattatctagcaaaggagaaaggttatcgtgctcgttcatcctttaagattattcagattaatgaaaagtatggccacttcttagaaaaatcgaaggttgttattgatctgtgtgctgctcctggttcatggtgtcaagttgcatccaaactctgtcctgtcaactccttaattattggtgttgatattgttccaatgaagccgatgcccaatgttataacttttcaaagtgatattacaacagaagattgtagatcaaaattgaggggttatatgaagacttggaaagctgatacagtgttgcatgatggtgctcctaatgttggtttgggttgggttcaggatgctttcacccaatctcaattaaccttacaagctttgaagttggccgtcgaaaatttggtggtgaacggtacttttgttactaaaattttcagatccaaggattataataaattgatttgggttttccaacaattgtttgagaaagttgaagccacaaaaccacccgcatcaagaaatgtttctgcagaaatttttgtagtgtgtaaaggtttcaaggcaccaaagaggctggacccaagattactggatccaaaagaagtttttgaagaattgccagatgggcaacagaatatggagtccaagatttataatcccgaaaaaaaagttagaaaaagacaaggttatgaggaaggtgataatttactgtatcatgaaacctcaattttggattttgtcaggacggaagacccaataagcatgcttggagaaatgaataagtttacaattgatgagaatgaccatgaatggaagatcttgaagaaattgaaacaaaccacagacgagttccgttcctgtattgaagatttaaaagtcttgggtaaaaaggattttaaaatgatcctaagatggagaaagattgcaagggaaatcttgggcatcgaagttaaggacgacgctaaaacagaaattgaagtagtaccgttaacagaagaggagcaaattgaaaaagatttgcaaggtttacaggagaagcagcgtctaaatgtcaagcgcgaaagaagaaggaagaacgaaatgaagcaaaaggaactacagagaatgcaaatgaacatgataacccccactgatattggtattgaagccgcaagtttgggtaaagaatcgttgtttaatttgaaaactgcagaaaagactggtatcttgaacgacttggcgaagggtaagaaaagaatgatttttacagacgatgaattagccaaagataatgatatttacattgatgaaaacatcatgatcaaagataaggattctgccgctgatgcggacgatttagaaagcgagttgaatgccatgtatagtgattataaaactagaaggtcggaaagggatgccaagtttagagctaagcaagcacgtggtggcgataatgaggaagaatggaccggttttaatgagggaagtctagaaaagaaagaagaggaaggtaaagattatatcgaagacaatgacgatgaaggtgtcgaaggagactccgatgatgatgaagccatcaccaatttgattagcaaattgaagggacaagaaggtgatcacaaattgagtagtaaggcacgtatgattttcaatgatccgatatttaataacgttgaacctgatttgccagtaaataccgtcaatgatggcataatgagttccgagtctgttggtgatatttctaaattaaataagaaaagaaaacatgaagaaatgcaccagaaacaagatgaagcagattcttcggatgagagttcaagtgatgactccgatttcgaaattgtggccaacgataatgcatcagaagaattcgattctgattatgattcagaggaagaaaaaaatcaaacaaagaaagaaaagcattccagagacattgatattgctactgttgaagccatgactttggcacatcagttagcattgggtcagaaaaacaagcatgatcttgttgatgaaggtttcaatagatacaccttccgtgacaccgaaaatttgccagattggtttttagaagatgaaaaggaacattcaaagataaataagccgattactaaggaggcagcgatggcaattaaagaaaaaataaaggcaatgaacgcccgtcctattaagaaggttgctgaagctaaggcaagaaagaggatgcgtgccgtagctcggttagaaaagatcaagaagaaggcgggcttgattaacgatgattcagacaagacagagaaggacaaggctgaagaaatttctagattgatgcgtaaggttaccaaaaaaccaaagaccaagccaaaggttactttggttgttgcctcaggtaggaacaaaggtttggcaggtagaccaaagggcgttaagggtaagtataagatggttgatggtgtcatgaagaatgaacaaagagccctaagacgtatcgcaaagaagcatcacaagaaaaagtag

SEQ ID NO: 4970 - DNA, 2529 bp, Saccharomyces cerevisiae
atggttgctttcactgttgaccaaatgcgttctttaatggacaaagttaccaatgtgcgtaacatgtccgttattgctcacgtcgatcatggtaagtccactttgaccgattccttggtccaaagagccggtattatttccgctgctaaggctggtgaagctcgtttcaccgataccagaaaggatgaacaagaaagaggtatcactatcaagtctaccgctatttctctatactctgaaatgtctgacgaagatgtcaaggaaatcaagcaaaagaccgacggtaactccttcttgatcaacttgatcgactctccaggtcacgttgacttctcctctgaagttactgccgctttacgtgtcactgacggtgctttggttgtcgtcgacaccattgaaggtgtctgtgtccaaaccgaaactgttttgagacaagctttgggtgaaagaatcaagcctgttgttgttatcaacaaggtcgacagagctttgttggaattgcaagtttctaaggaagatttataccaaacctttgccagaactgttgaatccgttaacgtcatcgtttccacctacgccgatgaagttttgggtgatgtccaagtttacccagccagaggtaccgttgccttcggttccggtttgcacggttgggctttcactatccgtcaattcgccaccagatatgctaagaaattcggtgtcgacaaggccaagatgatggacagattatggggtgactctttcttcaacccaaagaccaagaagtggaccaacaaggacactgatgctgaaggtaagccattggaaagagctttcaacatgttcatcttggacccaatcttcagattattcactgctatcatgaacttcaagaaagacgaaattccagttttgctagaaaagttggaaattgtcttgaagggtgacgaaaaggacttggaaggtaaggccttgttgaaggttgttatgagaaagttcttgccagctgccgatgccttattggaaatgattgtcttgcacttgccatctccagtcactgctcaagcctacagagctgaacaattatacgaaggtccagctgacgatgccaactgtattgctatcaagaactgtgatccaaaggctgatttgatgttgtacgtctccaagatggtgccaacctctgataagggtagattctacgccttcggtagagtttttgccggtactgttaagtccggtcaaaaggtcagaatccaaggtccaaactacgttccaggtaagaaggacgatttgttcatcaaggccattcaaagagttgttttgatgatgggtagatttgtcgaaccaatcgatgactgtccagccggtaacattatcggtttagtcggtatcgatcaattcttgttgaagactggtactttgaccaccagtgaaactgctcacaacatgaaggtcatgaaattctctgtctctccagttgtgcaagtcgctgtcgaagtcaagaacgctaacgacttaccaaaattggtcgaaggtttgaagagattgtccaagtctgatccatgtgtcttgacctatatgtctgaatccggtgaacatatcgttgctggtaccggtgaattgcatttggaaatttgtttgcaagatttggaacacgaccacgctggtgttccattgaagatctccccaccagttgtcgcttacagagaaactgttgaaagtgaatcttctcaaactgctttgtccaagtctccaaacaagcataacagaatctacttgaaggctgaaccaattgacgaagaagtctctttggctattgaaaacggtatcatcaacccaagagatgatttcaaggccagagctagaatcatggctgacgactacggttgggatgtcaccgatgccagaaagatctggtgtttcggtccagacggtaacggtccaaacttggttattgaccaaactaaggctgtccaatacttgcacgaaatcaaggattccgttgttgctgctttccaatgggctaccaaggaaggtccaattttcggtgaagaaatgagatctgtcagagttaacattttggatgttactttacatgccgatgctatccacagaggtggtggtcaaatcatcccaaccatgagaagagctacttacgccggtttcttgttggctgatccaaagatccaagaaccagttttcttggtcgaaattcaatgtccagaacaagccgtcggtggtatctactccgtcttaaacaagaagagaggtcaagtcgtttctgaagaacaaagaccaggtactccattgtttaccgtcaaggcctacttgccagttaacgaatctttcggtttcactggtgaattgagacaagctaccggtggtcaagctttcccacaaatggttttcgaccattggtccactttaggttctgacccattggacccaacctctaaggctggtgaaattgttcttgctgctcgtaagagacacggtatgaaggaagaagttccaggctggcaagaatattacgacaaattgtaa

SEQ ID NO: 4971 - DNA, 2529 bp, Saccharomyces cerevisiae
atgataaatgagagcgtttccaagagagaaggattccacgagtctataagcagagagacgagtgcaagcaacgctttaggactatacaataaatttaacgatgagcgaaatcccaggtatcgaacgatgattgctgagctgcacgagttttttcaccttactttagctgaaactataactgaaactgacgtgaaagaattggagtgtaataaagaaaaggccgctaaatttagaaagctaatgcctaagatgttgaacaattgccgtgaattaacgcaaaggaaatcatacattccttacaactcagaatttaatgggaatgacgaaaagcaaaagaagtttcagctgctacatcaacaccaaattgtgctgagttttcaagaattttgtgatgaattggcaaagttaataattgacgcgcacgtccttagctttttgaccagatgcgactattcttatgaaattatacccaaaaattggacctctttttacaagctatttcagtacgtaatgggtgccgttggtcctattatatcgtatgtgccggtaaattatcccatgataagaaaagaactaggatttgagaccttaacgatatttcagtattatgattccaaacttttcgaatgtatgaagtcacattttggaagggaattttccacccttgtaagcgctactattcatcactatattcatatgtttccaataacgaatacaatgttagagaaggaagttcctatgctccgtataatgtctaactgcaattttagtatagagggcttgagccccaaagatttttatatgaaaactctcagacaatattactgtgaggaatcaaatttaaggccgaggctggaaactttcaagaattttaaggtactattgacgaggaatgcattattagcatctttattttcccctgaatgggtcagcgatgcaaatgacctatttataagccatctactgttgaacaagaagtctattagcgaatacatagaaattgggaaggacacttatgatgaagaaaaagagagatatttcaaaactgagacacactttagcttattgatgtttagaaatgcttttgaagcaaaaaatatgctgtcaaaattcaaggaattctgtgatgatgccgtttcagaaaagttaaaggcagcatatggatccaatcatgatactgaaaggctatttgatgaggtagttcagctagctaatgtagatcacctcaaaatatactccgattccatcgagtaccatttatgtaatttacttggaagtaccagcaaagccatagaacagtatgtcaaatattttgagtcacatttattcatcatcgtcagaaagataaaaacaactaaaaaagacctacccagagatatgaaaataaagtatctcaacgaaaatcttcctatattgagactgaagttcgttaaccttcccacatttcctaattttttcgaaagatcaattttcagaaagacgatcttacaaagtgatcaaaattcctcatttattaaggatatattacctgtttacaaagacagcctcatggaacttttcaaacaaagaatcataacaaatgtctcacaagaggatgaaatgcgataccgagatcaatatcaaccctatttatcgcaattctttcagccggtagaggttatggcagatctgagaatcaaatatgcatcgttcttgtcgttttatgagaatatcgaggctgctgtgaagttcgggaagacatacaatgaaaacaacagcaagtcatttttcccacttatctttgatagagaaagaattcccaaagtttttcagcaatccaacgaagtaaagaaaaattttgtcctacctcaagagatggatgatacgtggaaccaatttctccgtaattatcacgagcagaataaagtggaagattcagatgcttccaaaaaagagctatatccgatgtggaacttgcaccactgcgaagtggagtcgccttatatcatacaggatggaactaacctaatatttgaattgacccttttccaaacatgtgtgctgactttattcaacgaaagcgatcatttgaccttgcaagttatatcagagcaaacgaaactggcgtacaaagacttagcgctagtcttaaaatccttctgcaattataaaattctgacaagagatattgacaacacatacagtatcaacgagagcttcaaacctgatatgaaaaaagtgaaaaatgggaaactacgtgtggttctaccgagaaccgcgtctctccaaagtagcaacacaggcggtgaaagaaccagttctgcacaccacgaaggaagtaattcccaatggacccaagaattactaaaggcatgcataactagatccgttaagagcgagaggaatgggctagactacgaccatttatttgaaacggtaaagcagcagataaaaggctttagtgttggtgagttcaaagacgccttggccaagttgttacgagacaaattcataactagggacgaatcaacagcaacttacaagtactaa

SEQ ID NO: 4972 - DNA, 2529 bp, Saccharomyces cerevisiae
atgtctctttcagctgcagcgaataagatatctgacaacgatttccaaaatatcggaccggcacctagacctcccagttcaaatagccagggccgtacttgctataatcaaacgcaacctataaccaaacttatgagtcaactggatttaacatcagcgtcccatttaggtacaagtacctccaaaaaaaaaagcgggtgggtgtcctacaaagatgacggtatactttcatttatatggcaaaagagatacctgatgctacacgattcgtatgtagccctttacaagaacgataaacaaaatgacgatgcgatcttgaagataccactaactagtattataagtgtaagcaggacacagttgaaacaatattgttttgagttggtgcgctgcagtgaccgaaattctgtatcatcaggatcctcgtcctctttgaatgtatcatcagacagtaactccaaaaaatcaatatacattgctacaaagacagaaagcgatttgcatagttggttagacgccatttttgctaaatgtccattattaagtggtgtatcttctccaacaaacttcacacataaagttcacgttggttttgatccagaaacaggtagttttgttggtatgcccaccaactgggaaaaattattaaagcactccagaattacaggagaagattggaacaataattctgcggctgtcattcaagtgttgcagttttatcaagagtataatggagccggaaatcccacaaatactttagacaagcctcaaagtggtgaaacttcctcctctcaaaaatcgctgccaaacagctataatgataacaaactcagaaataattcagtaaattcaaagtcatcttcaggcgtttcttcaagtatggtatcacagaggaaaacctcacaaccaccaaataccaaatcgcctgtttctctaggaagcggctcactgccaccaataaatacaaaattgcccactagtcagtcaaatattccaagacacttacaaaatgttcccaaccaacaatatcctaagatgagaaacggacactccccaaccaatggccaatttcctaggggacctatgcatccaaacaattctcaacgatctttgcagcagcagcagcagcagcagcagcaacaaaaacaacagcatcaacaatatccataccaccatcaaggaccatctccatctccatccccatctccgtctccattaaacccttataggccacatcacaatatgataaatccttattccaaacaacctcaatcgccattaagttcacagtcgacccaaaaccaagcaattccacgttatgcacaaaactcaagtcctacagccgcacactttcaacctcaaagaacagctccaaagccaccaatatcagctccaagggcgccatacccatcaaatcaaaatgctactagtaacacacatgtacagcctgttgcacctaagaatgaccagtcaaccccacaaacaatgaggcaggccccaaagagaccggatgcagatgtcgcacaaccgggtggtgtggccaaaccgaagaagccagcaaggcctaccatgtcaactgcagaaataatgagtaagctgaagaaagtcaccgtaaatgcggatccatctcaatgctttaaagtgatcgagaaggccggtcaaggtgcaagtgggtccgtctaccttgcagagaggacgcatattccgacagaaagtaatatgatcgaactcataaacaatgatattgatgagccgcacgtaggagataaagttgctatcaagcaaatggtcttatctaaacaacctcgtaaagaactcatagtgaatgaaattttggttatgaaggattcacgtcataaaaatatcgtcaattttctcgaggcttatttgagaacagacgatgacctatgggttgtgatggagtttatggaaggaggttcactaacagacattatcgagaatagtcccaccaacgataattcacattcaccactaacagaaccccaaattgcatatatcgtacgagaaacttgccaaggcttgaaatttctacacgacaagcatatcattcatagggatattaaatcagataatgtcttgctggacactagagctagggtgaaaattaccgattttgggttttgcgccagattaactgataaaagaagcaaaagagccactatggttgggacaccttactggatggcacctgaagttgtcaaacaacgtgaatacgatgaaaagattgacgtatggtctttgggtatcatgaccattgaaatgctggagggtgaaccaccatatttaaatgaagatccactaaaggcgttgtacttaattgcaactaatggtacaccaaagctcaagcatccagaaagtttgtctttagaaattaaacgctttctaagcgtttgcctttgcgtagatgttagatatagggcatcaaccgaagagcttttacaccacggttttttcaatatggcatgtgatccaaaggatttgacatcactgttggagtggaaggaatga

SEQ ID NO: 4973 - DNA, 2532 bp, Saccharomyces cerevisiae
atgacggacgttgaaggctaccaacctaagagcaaggggaaaatctttccagatatgggtgagtcctttttctcatcagatgaggattcaccagctactgatgcagagatcgatgagaactatgatgataacagggaaacgtcagaaggacgtggagaaagggataccggcgccatggtaacagggttgaagaagcctcggaaaaagaccaagagtagcaggcatacagcggcggattcctctatgaatcaaatggacgctaaggataaagcgcttttgcaggacactaatagcgatataccagcagatttcgttccagattccgtctctggaatgttcagaagccatgactttagttatttgcggttaagaccagaccatgcttccaggcccctttggatctcgccaagtgacggtaggatcattctggagagtttctctccattagcagaacaggctcaggactttctggtcaccattgcagagcctataagtagaccctcccatattcatgaatacaagatcacagcatactctttgtatgcagctgtttctgtagggttggagacggatgatatcatttcagttctggatagattatccaaagtacccgttgctgaatcgataatcaacttcattaaaggggctaccatttcatacggtaaagtgaaactagttattaagcataatagatatttcgtggagactacacaagcagatattctgcaaatgttgctgaatgattccgtcatcgggcccctaagaatagatagcgatcatcaagtacagccaccagaggatgtactacagcaacaacttcagcaaaccgctggaaaacccgctactaatgttaatccgaacgatgtggaagccgtgtttagtgcagttataggtggtgataatgagcgggaagaagaagatgatgatattgatgccgttcactcctttgaaattgccaatgagtctgttgaagtcgtaaagaaaagatgtcaagaaatcgattatcccgtgttggaagaatacgactttagaaacgaccatagaaacccggatttagatattgatttgaaaccttccactcaaatcagaccctatcaagaaaaatcgctgagtaaaatgtttggtaatgggcgtgctcgttcagggattattgttttgccatgtggcgcaggtaaaactttggtcggtattaccgcagcatgtactataaaaaaatccgtaattgttttatgtacttcatcagtctccgtcatgcaatggaggcagcaatttttacaatggtgtaccttacaacctgaaaattgtgctgttttcacctctgataataaggaaatgttccagacagaatccggtttggttgtttccacttattcaatggtggcaaacacaagaaacaggtctcatgattcacaaaaagttatggatttcttgaccggtagggaatgggggttcattattcttgacgaagttcatgtggtgcccgccgcaatgttccgtagggtggtctccaccatcgcagcacacgccaaattgggactgaccgcaacgctggttagagaagatgataaaattggtgatctgaattttttaattggtccaaaactttatgaagcaaattggatggaattatcccaaaaaggacatattgcaaatgtccaatgtgcagaggtttggtgtcccatgacagcagaattttaccaagagtatttaagagaaactgcaaggaaaagaatgctactgtatatcatgaatccaacaaagtttcaggcatgccaattcttaattcaatatcacgaaaggaggggtgataagatcatcgttttttcagataatgtttacgccttacaagaatatgctttgaaaatgggaaaaccatttatttatggttccacaccacaacaagagcgtatgaacattctgcaaaatttccagtacaatgaccaaatcaataccatatttctatcaaaagttggtgatacttccatcgatttaccagaagctacctgtttaattcaaatatcttcgcactatgggtctcgtcgtcaagaagcccaaagattaggaagaattttaagagctaaaagacgtaatgacgaaggtttcaatgcgttcttttattctctggtttctaaggatacgcaagaaatgtactactcaacaaagagacaagcgtttttggtagatcaaggttacgcattcaaagtcattacacatttacacggaatggagaacattccaaatttggcatatgcttcacccagagaacgtagagagctattgcaagaagtattattgaagaacgaagaagctgctggtatcgaggtcggtgatgacgctgacaattctgttgggagaggttcaaatggccacaaaagatttaaatcaaaggccgttagaggtgaaggttcattgtctggtcttgctggcggtgaagatatggcatatatggaatacagtaccaataaaaacaaagaactgaaggaacatcatccattaatcagaaagatgtattataagaatttgaagaagtga

SEQ ID NO: 4974 - DNA, 2532 bp, Saccharomyces cerevisiae
atgagcattgcatctcagaaaaaggttaagccatcgtttgtttgcttgcggtgtaagcaaaggaaaatcaaatgtgataaactttggcctacttgctccaaatgcaaggcctcatcctcgatttgtagctacgaagtggaaccaggacggattaacaaatctcccactatcgaaaatgccccacatagagacattagaaacattactcctgcatcgatgtccgcaagtggttcctttacttccatacttaatccaagtactaaagactgggaaatgaaaaattttgccatgaatttatcgaatgcacacgacaagcttgttgtaatgaataacacaaccatcgttgatagtccttttgccttccatagcattcttcaacatgatttgtatgcgaaggccttgaccacctgcatacatgagaggatactgattgatgtcgaacgccatcgtgaaaacgtttctgccaacaataaaaaaagagaacttaacttaacaatcggtgatattggacctttgttttttattgataaagctgcacttaaatttattgaaaatacctcaaaaacaagcaaattgtatcctccaatagattttctgtataacacgtatgattatgaacaagcgcatcctgaagaaaataatgataaaatttccataaacatccttttggaagagttatccaaatatttcctcaataagaatgaggttgatggcttaatcgtggacttttacaaaacaatatatccggtctatccgttactggaaatatcattattcgaagataacataagggagctgttgcaattgaatgaatttaatgggtataacattgtatttgcgggcaaagactctagaagaaaactggagacaataacactgctaactatcatattggctttttcttacagacgtttgagtctaagtactagtcattcatttaaagaatcttttggtgtaaaatcgaataatttaacgctactcgctcataaacttcttgctctcatgaacgtttttcaatatgttaatgaacatacactttgttgtctgctctattttttcatattgcggtatttgaatccagatcaagctgacatgtatcctactcacagtgacatactaaacctaaaatttttggagaatgtagcaataaagctaggactgaatgaagaacccttccaatacactcgatacgtcagcgaatcggacgattatccaagattattcaatttaagaaggaaattatggcttggcgtgcaatttttgaagtttggaatattgattccagaaggagattctgacattctaagtttggaatatttaagatcctttatgaaaactgacgaatctctaccagaactatttgagagaaattacgcttctactaataatctagacttatcgttgatggctacagcagagaatatctatcatttacatttatctttacaggtattactgacttcttgttttccaataaatggcccttcctacttgaaggaagtattggataacatcgacaagacaaaagattttttaaatcagaaattccctctcattttaagttctcttggagaaccaaggatgaagagcttacatatcaatgttccctcttccttagcaaatgaagaatcttttgactttagcacttttgaggaaaatgaaacattcatagctaatgtgattagctacacttgtacaatgaacatctatgatagcttatctttgcattttgaaaatcaatgtttcaaaaacgctttggagtacaaaacatattatcaccgctttacttttaccgctatacaagattatttaacgttgctaaaattaatctcggaatactttaatggatctcttctgcatttacgggaaccttttgggtttgccactcagaaagttgttcgcttttcgatacatcgattactcatattccaggccaccttgctcgtgagattattttataagaaggatacatgcgacagatcctctgcagccatgggaatgttgaatgatagaaacggaagacttagtcgagtcattgaaaaaatgatcaagttgatgtcatatcatatgaaattacttgtagaaattgttatctcgaaactggaaaagagttatctcggttcgttcatttctgtctctattttcaggtatatcatttatttggtggatactgacgcgctgtctgcgtttatatccgactactggaagagtgacgccgttatggatgaaagatattcaagaatccataggattgtcggtttaaaatggggtatgggaagggataagtccttttcgttcacatcaaaattaaacaatccacaattcttgggaagtcttgatttggagattttggaagaattagaaaaactcatttccgcacaagaattttccagaaacttcactgaagatgttgacgaatctttacagagtgaaattgacctcatgaattatgacaatgaagccttgaatcaactaatggcaattgatcttgataagctacttggaattttccctaacctgagtaacttttga

SEQ ID NO: 4975 - DNA, 2532 bp, Saccharomyces cerevisiae
atgtctttaatttcagctgtagaagatagagacatacataatataggaaagacttctggtggagggagcaggacttcgtctataacttcgtcgaaaaagtcgctgaaacacggctctaaatctttgagaaaaccaaaggtataccagacaacaggcgaaccattaagcagggaggctttatataaggcgaagttgaagtacggggtttaccagtcacctgcccaaagttactcaattggcgtcagcgacgctcatgcagcttccgacaaggcagctaatttagctcatgacaatcaaaccacggtagaagcttacaaacgtatgtttattgaccctaatgccactaaagctgcatccaaaatgggacccaaagttgtacgtaacaactcaataacttctgctacttctaaaacttcaaaagaatctcagacgaagagaaagtccaaagaatctccaggggccgccgcatcgaaagcttattcgatgacaatggaaactacaagtttaagctctcaaacaaacagcaggtcatattctatcacctctgccagctctgtgttaagcggcgcgagtggcagtttcaacagtactgttaatcctaaaccaaagactttgaatttggagaaagtcttagtgggtgctgaaaaaaaggcagaatctcgtattaaggaaagatgggaaccggaaaagacgaacttccaatacggcgtcaagactgatgagcatggtaatttaaatcaattcagtttctccaatgagatgatgaataacattatggcgaaagttgatgctccaaaagcacaagatttacaaaaggtcaaaaaagtttctgctgagaaagaagccaagtcgatgaaatttgcattaggagctgctaatgctgtgaaagacatgcatcctggtgaggatatcgacaaaagtatagctcttaaggcgcagaagagggaaacctatctgagccaattaacttctcagcaagttttgactttggcaagagccaatgttgacagacaattggatatcattgaaaaaagcgatatgcatagaaagctattcactaatatggaatacaacaaagctgctgtcgctgtcgcacagtctaatcatcagaaaaagacagaattccataacaagattaacatgggtggtggcctgtttttgtcaccagaagatatcactaaaatcgcatccggattgatttctcctgtacttggtgaagtgagtgagagggcggaggcgcaacgtgctatggatgaagaaattgcagaaagaactgaggcctataataaatcatcaaatgaatgggaaacgatggaacgttctatcatttctaatgacgccaaagtattgactactacggctaataggcatcaaaccgaaaaaaagacctcccaggaaaagattaaagccagctttgatgcacttgtggccagaatggataccaaagtcgctgaaagggaaactctgcttgaagataccaagagcaaagagatcgaatttaaaaagcaaatgcagcaagagttaaaggacgaaaaagctcgtctagatcaagatttggaggaatggggtaagaaatgtgaacaagatatcactgaagcgcgcaaagagcaagaagaactattgaaaccttaccatgacgatctggcaaatgcagaagcggaacacaaaactttagtggaagagcgcgatgaaattaacgcagaaatctcaagattgcaggatgctatagttgaccataaaagaaagatctctggttacggaaatgatcttgacgcccagaagaatagaaatatcagagaggatgacaaattactggaactaggtcaaactaaagaaagcttggaatcccatttgaatgatgacgttattattcttgctaataaggctaaagagcaggctgagttatcaaccaaggaggcccgtctgaagcaattggaagtggattcgttgattaacgaacgtaagagcgagttgaacgcgaccgaaatcgagttaaagaaggaaaaactaaatttgttggaagctatgaaagatgttgcttctgcacgtggcgatgataagattgacgaagagaaggttaaaaaattgattggtatgacttctgaggagtatttaacacaaaacaaatccgtcgagaaaaatgttgaagatttaccaacccaacttgaaaaaatagaggaaggtgatgaactaaagaaggaagagatagtgggagccgaaacgaaaaattcaggtggtgatggggttccggtgagtactgccgcaaaagaagctaccgaaactagttctgctgttcaaacaaaggaacctgaagaaaaaatttcgatcggaaataaatcaagtggaaaagaagacgctaatgattgtaaatcagcggagcattcaaaagaaatctcggtttcacagaaagcaggaaacaataaatcattgggagttagccctgatagtttggaacatacatttagtggcttttcacagggttcttcgatcgaagacgatcaggatgcaattagtaatcaagagaaaaaataa

SEQ ID NO: 4976 - DNA, 2535 bp, Saccharomyces cerevisiae
atgaaaccttacttatttgacctaaagctaaaagacacagagaagctggattggaaaaaaggcctctcctcatatctcaagaaatcatacggctcctcacaatggagaacattttatgatgagaaagctacttcagaactggatcacttaaggaataatgcaaatggagaactagcaccttcttcattgtcggaacaaaatctaaaatattactcatttttggagcatctttattttcgcctgggtagcaaaggatcaagattaaaaatggatttcacttggtatgacgcagaatactcatcggcccagaaaggattgaaatacacgcaacatacgttagcatttgaaaagtcttgtactttgttcaacattgctgtaatctttacccaaattgcgagggagaatatcaatgaggactacaaaaactcaatcgcaaatttgacaaaagctttttcctgttttgaatatctatcagaaaattttttgaactcaccttcagtcgatcttcagtcagaaaacactaggtttctggctaatatttgccatgcagaagctcaagaattgtttgtcttgaaattattaaatgatcaaatatcatccaagcaatatacattaatcagtaaactttctagagccacgtgtaacctctttcagaaatgtcacgattttatgaaagaaatagatgacgatgtggccatttatggtgaacccaaatggaaaacgacagttacttgcaaactgcatttctacaaatcgttaagcgcttattatcacggtttacaccttgaagaagaaaatagagttggcgaagcaattgcttttctcgatttttctatgcaacaattgatttcatcccttccattcaaaacgtggttagtggaatttatagactttgatgggtttaaagaaactttagaaaagaaacaaaaggagttgattaaagataacgattttatatatcatgaaagcgttccagccgttgtgcaggttgattccattaaggcgctcgatgcaataaaatctccaacatgggagaagatattagaaccatatatgcaagatgttgcaaataaatgtgactctttgtacagaggaattattcccctagatgtctatgaaaaggaaagtatttactcagaagaaaaagcgacgctgttgagaaagcaagttgaagaaactgagacagcaaatttggaatattcttccttcatcgaatttacaaatctacccaggctcttgagtgatttggaaaaacaatttagtgacggaaatattttctcgaatacggatacacagggacaattgatgagggaccaaattcagacatggtgtaaatttatccaaacaaatgaatttagggatatagaagaacagatgaacaaaattgttttcaaaaggaaacaaattttagaaatcctttctgccttacccaatgatcaaaaagaaaatgttacaaaactaaaatcttctttagtagctgcttcaaactcagacgaaaaattgttcgcatgcgtaaaaccacatattgtcgagatcaatctattgaatgacaatggaaaaatatggaagaagtttgacgaatttaatcgcaatacgcctccacaacctagcctattggatatcgatgataccaaaaacgacaagatattagagttgttaaaacaagtaaagggccatgcggaagacttaagaacattgaaagaggaacgttcgagaaatttgtctgaactaagagacgaaatcaacaacgatgatatcacaaaattattaattattaataaggggaaatccgatgttgagctcaaagatttattcgaggtggaactggagaaattcgagcctttgagcacaagaatagaggcgacaatttacaaacaatcttcaatgatagatgacatcaaagccaagctagatgaaatttttcacctttcaaatttcaaggataaatcttctggggaagaaaaatttttagaagatcgtaagaatttttttgataagctgcaagaagcagtgaaatcattcagtatttttgcatccgacttgccaaaaggaatagagttctatgattcattattcaatatgagtagagacttagcagaaagagtgagagttgcaaagcagaccgaggattcaacagctaattctcccgctcctcccctccctccacttgattctaaagcgtctgtcgttgggggtcctccattactgccccaaaaaagtgcagcctttcagtcattatctagacaagggctcaatttaggggaccaatttcaaaatctcaaaataagtgccggcagtgatttacctcaaggacccggtattccaccaagaacttatgaagcttcgccatatgctgcaacgcctactatggcagccccaccagtaccaccgaaacaatcgcaagaggatatgtacgacttgagaagacgtaaagcagttgaaaacgaagaacgtgaactgcaagagaatcctacgtccttttacaatagaccctctgtttttgatgaaaatatgtactccaaatacagcagttag

SEQ ID NO: 4977 - DNA, 2538 bp, Saccharomyces cerevisiae
atgagtgcggcacttccatcaattcagcttcctgtcgactataataatctttttaatgaaatcaccgattttttggtgactttcaagcaggatacgttgtcttctgatgcaacacgaaatgagaacgaagatgaaaatttggatgctgagaatatcgaacaacatctattggaaaaggggcccaagtacatggcgatgctacagaaagtggctaatagggaactgaattccgtgattattgatttagatgacattctacagtatcaaaacgaaaagtttctccagggcacacaggcagacgaccttgtgtctgccattcaacaaaacgctaatcacttcactgaattattttgccgtgccattgacaacaacatgccgctaccaacaaaagaaattgactacaaggacgacgttcttgatgttattttaaaccaaaggagactgaggaatgagagaatgctctcggacaggaccaatgagatccgaagcgaaaacctcatggataccacgatggatccaccctcttccatgaatgatgcgttaagagaagttgtcgaggatgaaactgagttatttcctcctaatttaactagacgctatttcctttattttaagcctctatcgcaaaattgtgctcgtcgttacaggaagaaagcaattagttctaaaccattatctgttaggcagattaaaggtgacttcctaggccaattgattaccgtcagaggtattatcaccagagtttctgatgtcaaaccagctgtggaagttatcgcatatacctgcgatcaatgtgggtacgaagttttccaagaggtcaactctcgtacttttactccgttgtcagaatgtacttccgaagaatgttcccaaaatcaaacaaagggtcaattgtttatgagtacacgagcttccaaatttagtgcctttcaggaatgtaaaattcaggagttatcacaacaagtgccagtgggtcatattcctaggtcgctaaatatccacgttaacgggacgctggtaagatctttatcgcctggtgatatcgtcgatgtaactggtatattcttgccagcgccctacaccggtttcaaagctttgaaagctggcttactgacagaaacttatttagaggcacagtttgtccgtcaacacaagaagaaatttgcgtctttcagtctgacttctgatgtagaagagagagttatggaattaatcacctctggtgatgtttataataggctggcaaaatctattgcaccggaaatctacggtaacttggacgtaaagaaagcgttgctgctattacttgtcggaggtgttgataaaagggtaggtgacggtatgaaaatcagaggtgatatcaatgtttgtctgatgggtgatcccggtgttgccaaatctcaactgctgaaggccatttgcaaaatatcacctcgaggagtgtataccactggtaagggttcctcaggcgttggtctgaccgctgccgtcatgaaagatcctgtcacggatgaaatgattctagaaggtggtgccttagtactcgctgataacggtatttgttgtatcgatgaatttgataagatggatgaaagtgacagaacggcaatccatgaagttatggaacaacaaacaatttcgatatccaaggcgggtatcaatacaactttgaacgccagaacctcaatcttagcggcagcaaatccgttgtatggtagatataatcctagattatcacctctggacaatataaatctaccagctgctttactatccagatttgatattctcttcttaatgttagatataccaagtagagatgacgacgaaaaattagccgagcacgttacatatgtgcatatgcataataaacaaccggatttggacttcactccagtagaaccctctaaaatgagagagtacattgcctatgctaagacaaagaggccagtgatgagtgaagctgtaaacgattatgtggtgcaagcttacatcagattaagacaagactccaagagagaaatggattccaaattttcctttggtcaagccactccgagaactttactaggtattataagattatctcaagcgctagcaaagttaaggttggctgatatggtggatatagatgatgtggaggaagccttgaggttggtccgagtctccaaggaatcattgtatcaagaaaccaacaaatctaaagaagatgaaagccccacaacgaaaatctttacgatcatcaagaaaatgttacaagaaactggtaaaaacacgctatcatatgaaaatattgtgaaaactgtaagactaagagggtttaccatgctacaattaagcaactgtatccaagaatattcttacttaaacgtctggcatttaattaatgagggtaacactttgaaattcgtggatgacggtaccatggacacagaccaggaagactcactagtgagcacgcctaaactcgcaccacaaacgaccgcttccgctaatgtgagcgcccaagattctgatatcgatctacaagacgcttga

SEQ ID NO: 4978 - DNA, 2541 bp, Saccharomyces cerevisiae
atggaactagagcccactctttttggtataatagaggcattggctcctcaattattgtcgcagagtcatttgcagacatttgtatctgatgtagtcaatttactgcgatcatccaccaaatcggcaactcaattaggccctttaattgatttttacaaattacaatcactagattcgcctgaaacaacaattatgtggcataaaattgagaaatttctcgatgctttatttggaatccagaacaccgatgatatggtaaagtacctctctgtctttcaatctttgcttccatcaaattacagagcaaaaattgtccaaaaatcatctgggctcaatatggagaaccttgctaaccatgaacatttacttagcccagtgcgggctccaagtatatatacagaagcttcatttgaaaacatggaccgattttctgaaagaaggtccatggtatcttcgcctaatcgttacgttccctcttcaacctacagttctgttactttgagacagttgtcaaatccttattatgtgaacactatacccgaggaagatatcctaaaatacgtatcatatacattattagctacgacatcggcactatttccgtttgatcatgagcaaatacaaattccgtctaagatacccaattttgagagtggacttttacatttaatatttgaagcgggtttattatatcaaagtttgggttataaagtggagaagtttaggatgttgaatatatctccaatgaaaaaagcattgattatagaaatttcagaagaattacaaaactacacagcatttgtgaacaatctggtctcttcagggacagtagtgtcattgaaatcgttatatcgtgaaatatatgaaaatataataaggcttcgaatatactgtaggtttacagaacaccttgaagaattgagcggagatacattcttgattgaattaaatattttcaaatcccacggagatcttactataagaaaaatagcaacgaatttgtttaattcaatgatttctctttattatgagtatttaatgaattggttgactaaaggtctactccgagctacttatggagaattcttcattgctgaaaacactgatacaaatggtacagacgatgattttatttaccacattcctatagagttcaaccaagaaagagttccggccttcataccgaaagagttggcatataaaatattcatgatcggcaaatcgtatatcttcctagaaaagtactgtaaagaggttcaatggacaaacgaattttctaaaaagtatcatgtcctgtaccagagcaattcttatcggggaatatcaacgaacttttttgaaattataaatgatcaatattctgaaattgttaatcatactaatcaaattctaaatcagaagtttcattacagagacgtggtatttgcgttaaagaatattcttctcatgggtaaatctgattttatggatgctcttatagaaaaggccaatgatattctcgcgacaccatcggattcattgccaaattataagttaacaagggttttacaggaagccgtgcagctttcttccttaagacatttaatgaatagtccccgtaatagttctgtcattaatggattggatgcgagggtactcgatcttggacatggatccgtgggttgggatgtttttactttagattacatcctctacccccctttgagtttagtattaaacgtaaatcgtccttttggcaggaaagagtatctacgaattttcaattttttatggagatttaaaaagaacaattatttctatcaaaaggaaatgttgaagagtaatgatataatcagatcattcaagaaaatcagaggttacaacccgctcatccgtgatattatcaataaactttctagaatcagtatacttagaactcaattccagcaattcaactcgaagatggaatcttattatttgaactgcattatagaggaaaattttaaagaaatgacccggaaactgcaacgcacagagaataaaagccaaaaccaattcgacttaattagattaaataatggcaccatagaattaaatgggattttaaccccaaaagctgaagtactaacaaagtcttcaagcagtaaaccccaaaaacacgcaatcgaaaagacgctgaatattgatgaattagaaagtgtacataacacgttcttgacgaatattctttctcataagctttttgcaactaacacaagtgaaataagcgttggtgattattctgggcaaccatacccaacttcattggttttacttttaaattcggtttacgagttcgtcaaagtttattgtaatttgaacgacattggatacgaaatcttcattaaaatgaatctcaatgatcacgaagcatctaacggattattgggaaaatttaatacgaatttaaaggaaattgttagccagtataaaaattttaaagacagactgtatatttttagggcagatttaaagaacgatggcgatgaagagcttttcttattgagcaaatcgctccgttaa

SEQ ID NO: 4979 - DNA, 2550 bp, Saccharomyces cerevisiae
atgaatcctatcaactctctagcgtttgaccttcacagtgttaaacttgcagacgcgaactcagacactgctgcattatcaaatagcaatactccaaccatgaacaatgcggctcttttgcaaaggccctcctccattatggattctattggcgtccaaagagttccatctccttttgtgccagggagtaatgcgattagtggagccagtactgttcccttcaatgcatatgacgctgaaattactggatctccgctacaaatatctgctaatcaggaaaacaatagtgcatttagtgcagcatcatccaacctgcatatgaacgccagcagcccttccgttctcaataaaccctcgagcacatttccaaatgtagctccttatctctacaacgcaacagggcctgcccccaacgttggtaatcaacccccaccaccggggatagaatctcagtggaaatacattgactctaatggtaacattcaggggccttttggtaccaataatatgtcacagtggtatcaaggaggttattttactccaactttgcaaatctgtagattagcaacatctcctgagccatttggtgtaaatgatcggtttattagactaggtgaattgactactctggtgaataattatcaagacccttttgtcgcctttgatttcattgttattagagctttgaatgctgttccacttgttgcaccaacttcatcagaaaagcaaaaagttgagtcaagagatttgatacctgttgctgatgtgcatagtgatgattttacgtatgaagaaatccttggccttaaatttgaagatggaagttactatcatgaaactcaggtttgggttccggttgacggccgtcatatcacaaaggtagatcgcataccaaagatatctgcatataccgctcctctatccacgacttctagtagatctaataaaaccacttcttcccatgaagagaaggttccttcccacgaggaagcttctccagaggagcaagaggttttttcagaagagggcagaactgtttctaacataacaaatgaagaggaatctattgtcaaaaatcctactaagcaggaggaagaatctcgaggaagcgagaaagagcaaaatatattggatcaagttcaaccagagattgaagaggtagaccgtaaggatgtaatatccactgctgatgagccgaaaagcaaagatacgccgcaaatgacttctgaagagcagaaaaggtttgcaaaggcagaactgatggcacaaaaattattggaagaacaacaaagacaagaagaagaaaaaaagagaagagaagaacagcgcaaattaaagaaggagaaaaaattgaagcaaaagcagaaaaaggaagaagagaagttaaaaaagaagaagaaggaagaaggaaaattagagaaagaaaagcaaaaagaattgctaaataacattttaactggagatacagaaactccatcttccgaaaacaccgcaacttccataaccactaatttggcgccttgggctaacaagaaacccgagggtgctgtttataatcagatttcatctgctcttgaagatttgaagaaggagaactcgtccaagaaagaaaaaaaacctaatcgtactcagttagatcgtgagcaggcattaaaactacagaaagaaatattaagctcggcgcaaattccgaaaactcaaactggttctgcctggggtataaagccacagcaaccgatcaaagttgatattaaaggagaattgatgaaagacagtaccaaaattaacagtcagtctaaaattaacaaggccaacaatggtgatattaaaccagattccacttttattgaagagcagaaaaagctgtgggaacaagttcaaaagaaaacaaagaaattcaaccgcgcttcttcactcgatgatttcatttcaagaacgccttccccatcttcttcggcattgaactcttcgaatactagcaatgcgtggaccacggtttcttctaagagcacaacccacatcgcttccaccatgcctgtcgctggtaaccagtcaaagtcatatatcagtttggacacactgcgttcttctggggggttatctaccgcaacaaaaactaaaatgagcgataagagtaaacaaattggctcatccactagtatcccgactttaaaggcccgtcaagttaaaccgtctcgcatccctgcctatcccggtaacgcttctgtctctaagcgtcaagaatttttgagatggtgccgatcccaattaaaactaaatacgggtgttcagcccgataatgttttagaaatgctacttagcttgcccccaggttcagaatccaaggaaattatcgcagataccatatattcctacagttcaacaatggacggtaggagatttgccactgatttcatcaaaaaacgtctagaatgcgaagaagaaattaatgaccccttgagctggagtgaagtattagctatgcctgaaggcagttccgaagactgggaatttcaagttgttggtaaaaagaaaggaaaaagattttga

SEQ ID NO: 4980 - DNA, 2550 bp, Saccharomyces cerevisiae
atggaaactattgattcgaagcaaaatattaatagggagtctttattggaggaaaggaggaaaaaactagcaaaatggaaacaaaaaaaagcacaatttgatgctcagaaagagcatcaaacttcacgcaatgacattgttactaacagtttagaaggtaagcagactactgaaaagtttacggaaagacaggaacgtgtaaaagaagagcttcggaagagaaaaaatgaatttaggaaatctgacgaacctgtatcggttaagccttcgaagaaaaagtcgaagagaagtaaggtaaagaagaaaatatccttcgacttcagtgatgacgatgattctgaaataggagtttcttttagatcgaaggagcacattcaaaaagctccagagcatgataatgaaaaagatccactggatgagtttatgacgtcattgaaggaggagaaaatgagtaatagtaaaggcatgtacgacagaggcgacattcttgatgtagaggatcaattgtttgaacttggaggaaccgacgatgaggatgttgaagataatacggataattctaatatagcgaaaattgctaaactcaaagcaaaaaaacgtgtaaagcaaatttattactctccagaagagcttgagccgttccaaaaaaatttttatatagaatctgaaacagtttcctcgatgtcagagatggaagttgaggagcttagacttagtctggataatatcaaaataaagggaacaggttgccccaaaccagtcacaaagtggtctcaactgggactatcaacggacaccatggttttaattacagaaaagttgcactttggctccttaacgcctattcaatcccaggctcttcccgctattatgtcaggtcgtgatgttataggaatatcaaaaactggctccggcaagaccatctcctatcttttaccattgctaagacaagtaaaagctcaacggccattatcaaaacatgaaacagggcccatgggtttaattctggctccaactagagagctagctttacaaatacatgaagaagttactaaattcacagaagcagatacatccattagatcagtatgctgtacaggaggttctgaaatgaaaaagcagattactgatcttaaaagaggcactgagattgttgttgccacaccgggacgatttattgatatattaacactaaatgatgggaaattacttagtactaaaagaataacgttcgtagtaatggatgaggcagacaggctgttcgatttaggttttgaacctcaaataacgcaaatcatgaaaactgttcgaccggataaacagtgtgttctatttagtgcaacttttccgaacaaactacgcagttttgccgtaagagttttgcattccccaatatctattacgattaattcaaagggaatggttaatgaaaacgtaaaacaaaagtttagaatatgccattcagaagatgaaaaatttgacaatctggtgcagcttatccatgagcgcagtgaattttttgacgaggttcaaagtgaaaatgacggacagtcaagcgatgttgaagaagttgatgctaaagccattatatttgtatcaagtcagaatatttgcgacttcatttcaaaaaagctgttaaatgctggaattgtgacctgtgctattcatgcaggtaagccatatcaagaaaggcttatgaacttagaaaagttcaaacgagaaaagaacagtattcttctctgtacagaggttctctcaagaggtttaaatgttcccgaagtgtcgttggttattatctataacgccgtcaaaactttcgcgcaatatgttcatactactggaagaactgccagaggtagtcgctccggtactgctattactcttctattgcatgatgaactgtcaggtgcttatatcttgagcaaggcaatgcgcgatgaagaaataaaagctttagaccctctgcaagcaaaagaacttcaggaaatgagtgccaagtttgaatccggtatgaaaaagggtaagtttaggttgtcgaaagggttcggcggcaaaggactggaaaatatcaaaagtaaaagagaggaagctcaaaataaagatttggagctcaaaaagaatgataagaggagcgatgacttggaaaagaaaatcagcaatccacgcgaagggcatgacagtgtgtctgagtcttctgcgcttattccgagactcaattatgaactattcaaagagtctacagacgggtcgatcatcttttacgccaaggtttatattaatgatttaccccagattgtaagatgggaggctacaaagaatacaaccttattatttatcaagcatgaaaccggatgtagtattactaacaagggtaaattttaccctgaagggaaggaaccaaagaatgaaaacgatgagcctaaactatacttattgatcgaaggccaagatgagaaagacatacaattaagtatagaattgctggagcaaaaagttaaagagggggtcgtaaaggctgcaagcttgtctttgaagagtactaaatactag

SEQ ID NO: 4981 - DNA, 2550 bp, Saccharomyces cerevisiae
atgtccatagcgcgattagtatactctcttttcagaagagtacgatcggttctcttacttttcattaccatatcgctattgttttactatacgttccagaatgaaatcgatatcttgaattcgtacgctttaaacgactcactaccgtccataaacaactatgagcacaatacagaaggttcttcgaaactggatcctccagacctatcgtcaaccggttctgaccgaatagccaccgacaaggaaaatggcaacgttgcagtggatttgtcagatccagctacattgagagaaaaaaacaagtactttcccttgctgttaaagggatcgtctcaccagattggttcgaatttaccaatttcgtctcttttgacatataaggaaaagtatcccgtcttgttcgaatactcatcaccttccttaacttctataagccagaatgacgttcataagatacagccggcaatgcaattgccaccagatgttgatatgataaaacagataaaggacattttcatgaaatcatggaaccaagagcagttgctgctgaaaagtaacctcagaagggaatctacttggcccatagatctaattgattctctagatacattgtatctatgtggcgagacgaaactttttcaagattctgttaatataatagaagattttgactttcgagtacctccgttagcaatggaagttattgatattcctgacatcactacccgtgtcctagaagggttactgtctgcatacgaattatctatggataaacgattacttaacaaagcaaaacatgttgcagatttcatattaagatcatttgatacccctaatagaattcctattttgaaatatttttggaaatctgatctgagaaatcgatttccagaccgtactgttccatcaggtcaattgactactatggcactcgcgtttatcagattgtcacagttaacccgtttgaataagtattttgatgctgttgaaagagttttcaccactatacgtcaatcatataacgaatttgatatggagtttatgctgcctgacgtcgttgatgcctctggttgccagttattaactcaagaggaaattgagaatggtgcacacctaaagggatccagcatcatgaaaagtatcaatgaaaatttcaagttcgtacactgtcagcagttagggaaattcttaaatcctccaatagatgataatagcctccaagaacaatctcaataccaggcttatagaattaatgaaaaaacagtacccattctagaaaatctattcaaaatcaatgacctcttccaatcttcttatgatatcctggacggctcaagtaaaaatgctaatgctgcaacgatggaccccagtattggttcagaggtagaagcagtcgacgaaataattgagaaaagaaactttaaagacggtactaaaaaagattcgacaaaaaacaccgtaggtgataaatcattaatagactcgcaaacgtttttaacaaattccatcagtaacatttttaaattcatgacttttcgacccatgttgcccaagcaaacggaaaacaaaaagtttaattttctgaattccattctaacaaaatctcaattcatgcccacgactaatgagctagatgtcacgataagaaaatcttacgatgtctcgttatactcatgcagacttggcggcattctaggtttaagttcacgtgttccccaccgaggcggtgtcaacacgaaatatattttaccatcgtcactattggaaatgagcgaaataataacagaaagttgttttatgctaatggaggagttcgacgggctgctccctcaaaaattcgagttggacccttgcactgatgagactaatgggaattgcgagtttaacggcgaaactaaatcacgaatgattgccaacggcgaatatgaaacttttgaaaatgacctagatgtcgggatcaaagtttcgaattatgggaaaggtgggaatgaccagaaagctaagagaaatgtactaagcaaagatgggataacagagactcaaaacataaaaggtgatactgttggaagctcgaaatcgattgctgaaatagacggcgacgaagtaacgcaaatacgtagagtttttacgcttggtaaggatatcaaaccgcatattacaacggacgataccatgggttctcagtggaaaaaccatccagactggccattttgggtcaacaaggtagaatccagaagattgttggattcgaatatcattgaatctatattttatatgtacagaatcagtggagaacaaaaatggagaagcatgggtaagcagtcttttggaatcttaatgcaagaattaatggaactaaacagtggtgccaaaggattgtggcaaataaaggaattttatgaaaacggtgaaaaagtgaacaatgatttacctagctattggttctccagaacattaaaatactatttgctactattcagcgatggtgacaaggtttccctggacaaacacatcttaactcaaggagggcacataatcaaaaagaaatga

SEQ ID NO: 4982 - DNA, 2553 bp, Saccharomyces cerevisiae
atggctctgccaatagagggcaaattatccatggcaaataataggatcgaaaggttaaaatcaccctcgtcttcatcaacatgctcaatggacgaggttctcattacttcaagcaataacagcagctctatatgtttagagaccatgcgtcaacttcctcgggaaggtgtttctggtcagataaatattatcaaggaaactgcagcttcgtcctcttctcacgctgctctcttcatcaagcaagatctttacgagcatatagatcccctccctgcttatccaccgagctatgatctagtaaatcccaataaagaggtccgctttcctatatttggtgacacggcaccatgcccaaagtcttctctccctcctttgtatgcacctgcagtatatgaattgacgttgatatccttaaaattggaaaggctttcaccttatgaaatttctagtaacaggagctggaggaatttcatcattgaaattaattcgactcaactaaatttttaccatattgacgaatctttgacgaaacacattaggaattattcaagcggggaaacaaaatctgaaaaagaggatagaattcatagtgacttggtccatcgcagtgatcaatcacaacatctgcatcaccgtctcttcactctaccgacgagatcagcttcggagtttaaaaaagcagatcaagaacggatctcttatagagtgaaacgtgatcgatcgcggtatttaaccgatgaagctctttacaagtctttcactttacaaaatgcaagatttgggataccaacggattataccaagaagagttttgtgttaagaatgtcttgtgaaagcgaacagtttttattacggttctctcatatagatgatatgattgactggtctatgtacctatcaatcgggatatctgtgtctttggacttggaagtcagggagtatccagattatcgaattgttcccagaagaaggagaaggagaaggaggagaaggaggagaagaagacacactcatagaagtgagagttcgatggggtctttttcgcagagattcattcgttcgaattccagaccggacttaatccaaagatatagtaccgggtctagcactaataacaatacaactatcagggaacgctcgaatactttcacagctggtctactagatcattactgcactggcctctcaaagacgcctacagaggcattgatatcttcggctgcatcaggagaatccagtgataacagtaccctgggatcaacaaggtcattatctggttgctcagcttcccgttcgattgcatctagaagtttaaaatttaaaattaagaactttttcaggcctaaaaattcttcacgcacagaaaagcttcacagactcaggtccaactcaagtaacttaaatagtgttattgaaacggaagaagatgatgaacaccatgaatcaagcgggggagatcatccagagcctggtgttccagtaaataccaccattaaagtagagcgtccaatgcacagaaatagagctatttccatgccccaaagacagtcattgaggcgtgcaattagcgaggaggttgtccccatcaaatttccaaatagcacagtgggtgaatcagttcattcaccctctcctattgagcatctttccgttgatggctgcgagattatgctgcaatcacaaaatgcggttatgaaagaggaattacggagtgttgcgtcgaatttggtagccaatgaaagggatgaggcatctattagacctaaacctcaaagctcttcgatatacctatcaggattagctcctaatggggaatccgccacagatttatcccaaagcagtaggtcgttatgtctcacaaaccgtgacgctgaaatcaatgacgatgaaagcgctactgagaccgatgaggacgaaaatgacggtgaaaccgatgaatatgctggcgatgatactaatgatgatactgatgacagtaatattggttatgcttatggcagtgaaagtgattattcatgtttaattgaagaacgaataagaaatcgaaggcgagcatcttctactctaagttgcttctccaatataccttacggaacggatgatattaaatggaaaccagctattaaggaaatttcaagaaggcgttatttgagggattctctgaagtgcatcaaaccatttctagatagtaacgactgtttgggtaaggttatctatattccagtttcgggaccaacctttgaaacaagtaataaaattcactttagcaaccgccagagcttacagaagcagaagaatcattttttaaaaggcttcatcgtgggacctacggcgttgatagaacttaattgtaaaaataagaatgcaattgttggaacaacaaaggacgctgaagatcatggggaggacgacggtgacggtgatgatggtgaggatgatgatgacgacgacgacgatgatgatgatgatgacgacgacgaagacgacgacgatgatgatgatgatgatgatgacgacgacgatgacgatgatgatggacagattactgcataa

SEQ ID NO: 4983 - DNA, 2553 bp, Saccharomyces cerevisiae
atggttatggcggatactattgccacaggagacaaaactagccagtttgatggaaaacatatgcaggatttagaaagaatttactccactagggatacactcgatgataatttctttggagaacgtggacaaaaagatgcaaacggtgattattacgatgaattaaacaatgaggaaaccaattacagtggaagtagttactatggtcactcagatgattcggaagtggttgggttgataaagaatgatactgtgagccagctcccgcctctcgacagttttatattcccagattctagggctttgttcttgttagatttaggcaactatgctgatttaacttatgaagaaattatcgtacacgggtttgaaatatatattgtggagcaatgggtagcatgtaggaatttgtcaacattgattacgtcatatacaggaaactctcaggatacaatatcgggagtcagagtcgttttgccaaaggatacgagtatgtggccagggagatttagactgtattttgaagaattaatggaatttgcgcggccaaaatttacaccaaagggcactctatttattaccaatctttcgggtgtgtcctttggcttgaatctgttgcatgtggaatgtggtgacttgagaacaatttggaaggatttcgaggttaattttgatctgaaaaacctgcattgtggtggaagatcggcaaatctgttatgccctccaactatggcatcacttgataagttttcacaactgttcaaaatccctacaaatggttttattgcacagtatccccaaatgattcagcagcagcaaccgcgtttgcctgaggaagaatacaagacggttggaaattcaaagtgtcgaaataccgatagtaaatcaccagtcgtggagatggtaactttaattcaaatttcgttgagttatttcaatttgttatctaagaactaccagacggatggtcttttgtgtgaagacaccaagcgagctatagatgaatggtgggaaacttacgggaaactgtaccttggtacagaaaagccaaggaatgaatgcacactgggtccgacgacagtagctggcctaattagtttgatcctttgttgctatttcaagttgatgatagaaaattgcatttcctctaaggatccctttgatgaagctggtttcttccaaggtatttataatttccaaaaaaagcatggcctcaataaaagaaaatctagagtttatttagacccaagaacgttagagaaactctttgaagtgacagcgaaagtttctagcaaagacatttttaaactgaagaaaatggtgacatcaacggtacaggacatcataggaaagggaaatcccatcaacctgtcacacaaaattcttacaacagatctagatacacttattcataatattcatggaggctctgtaggactactatggaaaggtaagggacacccaaggaaatgctgtacggatatttctaatgaagaatttttgaaatttaactaccagagaggcgatcctgatgggcagataagagaaagggaaatgctactagaaaaatttcgtttggaaagaatcgcatacgctcaaaagcacgcctccaaaaaggttagttcttccagtcttgatacatctgaagacatagggaggaccaatgctatgccctcatctgcaacagtgtcatcaatgtttccaaactacgataataccaaatatgcatataattttggcatcaacaaattatatcaaggagaatactaccgaagaaattcgtttccctattgtaaagatcgcacacacgacaacatttatgaagatctttcagagctgaaggaaaagtcatctcgtttgtatagatgcaactcttcttctgctgtacagaatattgtggaaaaatgggatttaccatttgatccatctgttgttcgaatagctagagatttgttacgaatgaaatacgacatccaagcgcagcaacacatacaagaaatggatgagcattatatgggtaaattaaataaggagggaactgttggtcagtactctaaattcaacgaaagatataaaagactgcaagaactatataagaagtattcagatggtgcaaaagtgtttgaagggagatttgaagacattgacaataagcaacaacttcttctccatgagatgcaagagttaaattccttatcatctaggttgaaatatgatatgaggatattggaagttcgtgtacgagatattgaaagtagtgttgctcagtttgattccaaattaattgggttgaaaagctctcttcagggacagggtaaaactggaatatgctctgcaatagatcccaagagtgataaagacgaatatgatagatgcgtaaatgatttgatgaccactaacaaccccacctatgaagctctttgtttaaagatgctgagccgccgttattttaaagatttaaagaatgatactgtggggtggttcaggtggttatttggtaataattctttacacaataatgccagtgaagacgatagaggaatacgagtatga

SEQ ID NO: 4984 - DNA, 2553 bp, Saccharomyces cerevisiae
atgttgctagtacgaacgacttccctgaatgtgtcaaggatgccagtgccatgcctcgccagaggaataggcatcctcaagggcaaatatagactagcgaacctgatgaatgcccaaccctcagtgagacatgtgtcgagcgagatccagcaaaaggatcagcaggcaggagagtcaaacaccgccaccgatactggtgttattcacaaatcagatgaagaaactctgatatatttcgataatgtttacgctagaaccacctcggtttggaatccaacactgtggtacaatctcctgctaagaaaccagtcacgggatgcagtgagggagaaaataaggaatttagccagtccacccaataaccccatttatggactggagttgaagtctaccattccagtgaaaagggatggtggtgtatttgccacatttgtcgttccacccaagtatacaaaagctcaggtaaattctctaatccaacagaatacagccagagaatcctctaaaaacttactctcgtacttcactcgagcttctgccttcccagtaaagggttcgccttggattgaggatttaagaagactaccaagtaccactatagtcatcaagttccaagggcccgccttaacagaagaagaaatatactctttattcagaagatatgggacaattattgatattttccctcccactgctgctaacaacaatgtggcaaaggtaagataccgttcattccgtggtgccatttctgccaagaattgtgtttccggtatcgaaattcataataccgtcttacacatacaatacgaaaatatcagaagaggccatctagttagtaattttttcaccaaccatacaaggattgctattccagttttatttgcgctactttcaatctttgctgttttagtgtttgatcctataagagaattttcgattgaacagaagatcactcacaaatattctttatcgtgggacaataagttttggaaacaactgaaaacgctaacctcatctaccatgacttctatcaagtactactggggcggccctgatgataatcaccaaagaaagcatttatgggaggaaagaatagagaaagtgaatgacctgaaaatgtggcttgaagaaaataataatacttttgtggttataagggggcctagaggttcagggaaacatgatttggtcatgcaacacactttgcaaaatagagcaaatgttttgtatttggattgtgataaattgattaagtccagaacagatcctatgtttttaaaaaatgccgctagtcaattgggttatttcccaatattcccatggattgactctgtcacaggtgtccttgatttaacagtgcaaggattaacagggcaaaaaactgggttgtctgagacgaaggaatctcggtttagaaacatgttaactacctcattgatgtccattagacgtattgctctcaagaattacaaggcttttgtttccaccggtgatgggacagttaatgttaaggaagaagattacctacagcaacatccggaagctaaacccgttatcgtcatagataggtttgagggcaagtcggaaataaatggatttgtgtataaggaactatccgattgggcagctatgctagttcaaatgaatattgctcatgtgattttcttaacggaaaccgttgcatccaaccaaagattgagcgaatcactacccaatcaagtcttcaaaaacctaatcctatcagatgcctcaaaagagaattcgaggaactatgtattatcccaattggaggattacttatattacaataaaaaatccaagggtgaaaacgtaaaagaacctgaatcagaaaaggaaactgctgaaaataatgattctgatagtgaggccgatacgagtgtcaaaaaagctgaggttattttaaatgaaaaggaattacaggaaattgacgcttctttagagccattgggtggtaggatgttagacttacaggcatttgtaagaagggtaaagtcaggagaagagccctcggaagcagtagacaaaatgattgaacaggcttctgagcaaataactcaaatgtttttaagtgacaagattgacagcaataaaagtgcacaagcctgggaattaatcgaattattgagtgcgaacccagtcattccattccatgaaatcgttaacaagccattattcaaagccgcaccagaaacgggaatcatggaattggagaataatggtttaataactgtatctagagataggggtgttttacaggaaatcaggcctgccaaaccgctatacagggcagcattcacatacttgatcaacgatcctgaactcgcaaaagtgctaaaaacccgttacttattaaaggttgtgggttttgaaactggtagaatcaagaaatgggaagaagaattaaaacctttggggaaagttcctgatcagaaacttttcaagaccagattggactatttatccggtaaaatcaatgccagtaatgcagtcattaccaaatgtgaagaagaaattaaaaacctatctaagtga

SEQ ID NO: 4985 - DNA, 2556 bp, Saccharomyces cerevisiae
atgccgaagaatagtcaccaccatcgttccagttcggttaattccacaaagagtcgttctacggaatctacgaataaatggaaaattccgcactattatcgcagatccgctagcggcagcacacaagcttcgccggacaggaactcctcaacaggctcatgtagcactccagtattacctactatgaatgttatgtctagcccgaaaaaagttttgctagaggatcccagagacaaccatactaaggcgaagaagagtagtagaaagaaatcaggtgaaatggtcttcgtcaattatactgtacaggacacggctaacgaaaatgatactgacttgcaaacccagccggtttctgtgccagcaccaaaggcgaaattaaagaagaaatcctccaaaaggagaatgctgaagatatttggatcgtcaaagaacgaacacatagaggacatcgttgaagagcaaccaatggtgcttcaaatggattcagaatctaaacccctttcgggaacccctatctcagaaagcggaatcgacgcctcgtcactaacaaccaaaagatcttataactcgttcttaaaacacaataggctaaacggtaaaactccgttctctggaaacttgtcctttccatcattaaacatgatgggtaacactactgatctgcctattgacaataacgatttttgttccgagaaagaagtcgttccgaaatcaactcatgatccttcactagcaaaaccgccatcaaggttcactgaaagcgaaacaaattctactcccaacttatcaagtatacctctcatgaacacaaaaaatacaagattgaagtacaataaagtggcgcctcagagttcagaccgacaaaagtcacaggaaagtgggctatatcattctaccgaatcattcaacttcaaagatcaaaactacagtaacaataaatcctctttaagtctgaactccgatttaagtacaccccactttgcaaagcattcacctgattcaccaagaacttcaagatctttcaactgcggagactcacaaagtaaagttaaattaccggaagaaaatgacgcttctattgcatttagtaagatgtttactagaaaacgagccaacactggcgggtccacgtgttcgctagcctcacccactattgcacaaactattcagcaatcaaatataaaagttaataaattgccaactcagcgaaccacttcagttggctcattatcatccatgtcaaatcgttattcaccaataagagttgcatcgccaggaagagcaagatccgcaactcgtgggtcttccctttatagattatccagagaccttaattctttaccaagcgtcactgatctaccagaaatggatagtacaaccccagttaacgaaatattcttggatggccaaccacagcataaaagtggcagtgtcaaaggagggcataggaagaaacaagaatctatctctgatgctcaaagaattcaacattctaattcgtacattacaacaccttcatcttctctggtgactcctccttactacatgacaggttacacattaccaagttctgcatctgcttcttcaactccaaatgtgcttgaaacacacaatatgaactttgttccaagtaccagtactgttacaagttatcgcccatctagcaatttttcctcatttgacaaagaatacagtaacgaaaacgacgctagtggggaattctctgctttcaatactccaatggagaatataccggcactaaaaggtatacctagatccacgttagaagaaaatgaagaagaggatgtcctagtacaagatattccgaatacggcacacttccaaagaagggatattatggggatggatactcacagaaaggatgacagtttagattttaactctttgatgccacacggtagtacaactagtagcagcatcgtagattctgttatgacgaactcaatatccactacaacaagcaacgcgaccggaaactactttcaagatcaagataagtatacattggtaaatacgggattgggattgagtgatgcaaacctcgatcattttattagatctcaatggaaacacgcttctcgatcagaatccaataataataccggaaatcgcgtttcttacagtggctcaacaccaaacaatgttgatacaacaaagactaatttgcaagtgtataccgagttcgattttgaaaacccagagtcgtttttccatgagcaatcgaagctactaggtgagatgggccacagcaataacaacagcaacagcgccatcaacatgaatgaacccaagtctgcggatacatacattggaaatatatctccggatacttcagcaactgtttcattaggcgacctgatgggctcaaacgtttcaaacaacagtgaaagaaatttttacgatggtcatactttcgttccacagtatcaggcgaactcatctgtggaaaactcaaataatcaaaatgcagcaccaattgcaaataacgacattgataataatttacagtctttttattttgataatagcaactaa

SEQ ID NO: 4986 - DNA, 2556 bp, Saccharomyces cerevisiae
atggatatggatacgcaggaggcagaactatcgagccagctggagaatcttacaataaattcaccacgaaagctacgctcgaacgcgcacagtaacagtggtaaagtgtttaaggaatatgaaagtaaccacgattttcaagattcaaattttacttcccaagttgtggaacctgcaatatccgattctgtcaaaaaacctcctacaatgacagttttgaacaactatagcacggtgcatcagaaagtgccgtcaggtttttcaggcacgactgctacatctcatcaagaagctcaatggaagcagtatttccctggtattggtagcggcggtggtaccaactttggtggcgctgttggtactgcaaacaaagttcctgaatcggatctcattgtgagcgacttggttaaggatttatctggagttcttgaaacaaatacatttaaaagacatttagatatgaagaataaaactactactatgcagacccatgaaaaccatgatacgattagtatttcacattctaaagatttctttaacgctgagaaggtctcatcgtcgttttctgatgacagcgattctggcccagcagctgaggcacatgatgtatttgatggcatattacaaaagcaaaaatcgaattatttggtgggttcttatccaagtaatagcaacaacaaaaacaataataataataataataataataataataatagtattaatattaataataaggataacgctagaacgaaggaggaggacgaagaggacacttccaattcttttgaattttcatcatcgtcatccatgtcgtcctctcaaactcaatcaggcagaaaatcaaaagttctcaagaaacctccattgaacactatttcacccggtcaattgggatatcagtttaaccatacacacggcgcatgggatccgccgctgaaccagggcttagatgtgtcgagttcacattctctggacaatacatcttccaaccagtcccagttcgccacaatggtaccaactggagataatcacactaacggtaaggcaccttcaattctagataagaaggcgtatgaattaaccagtaccaaaccaggtgatgttggctaccgccaaaagaaaatacaagaagaagaaaatctagcaaatagcgatgacacgcccctagacacaccaaaatttaatgacctttttacgaaaaatggcactagagcgaaggttaaaggacaaatgcgtacctctcgttcaatctctaattccaatctactagaagctcacaagaaactaaagaccttccccgctgaacgggttgaagatattacgtccatttccgaagtaaacacctcgttcaacgaaactgaaaagcagctaatatcaatcttgactagtaaactatctggttctccaagctatgattccgattgggaaaaaatcctgaaagttgacctatcaaggggcaaactgaagaatatgtttggcatgcaaagactactaccgaatgtattagtgctaaaccttagtgacaatgaaatgaacactctagaaggtataccctcgaacgttgtacagctattttgttcaaacaacaaaataacgagcgcacattgttcattagccggattccacgatctggaatgcctcgacttatcgtacaacctcttgaatacaagtttaaaatttttgtcactttgtcatcacctgcaagaggtgaacctttcttacaactccatccaatccttagaagggataggatcctccaggatgaaaaaactgaacctttctaacaacgagattaatggtatcatcgatttcgaacaattgatactaacaaacaactctgtcgtgggcggctggttgaccgtggaagtcttagatctaagcaacaataacataattggcgtaagaaacatcaattgcttgccccgcctgaaggttttaaacctcaatggtaacccgctagtttccatcgtggaatcttctaagatggagaacggaacgttgagagcgctttccatcaaaaatacaggaggcgcgctatccaaattacaaaattacaagttggatgatcaattcacgttcccctaccaaaatctaaagattctaaaactggacggcttcgctcaacttagcaaatggcaaaaatggcctgccactttgcaaattctggagatcaacggcggcctggcctcctctttgccgcgattctcttctctaaaatccaccaacttatattctctaactatagctaatgttagagacttcacacacttaccagtggacctctccaaggaactaccgttcttgcaagagctacatctgccaggcaacaacctacaaaacgcacacaagttaacaaaaactctcccacgccaatcagtaaaatttcttgatctacgaaataacccaatcacgacaccacgccacgatcgcgccagcacgagcttgcattaccggcagttgctccagcttgctggcctctgccagcagcaatgtcccgccctggcgaccctctggttagatgacactcctgccccaactgccacgaatctgtaa

SEQ ID NO: 4987 - DNA, 2559 bp, Saccharomyces cerevisiae
atgacctcgattcaggagcgaggcacaagcgctcatctgcattcgcttaaagaaggtgaggctagtgatcgttccagcgagatgcttcctaaacaaagaagtatcataggatcccacgtgcaacgtccaccgtctcaaacaactttaggaaggtcaagggctggaagcaatacaatgaataaagtttcaggcttagatattgctcgaagaccaagtgagaatttattatcaaacatgaactgtagcgacaacggcaatgggggaaatatgctaaattcattcgttaactcggctttaccaccgccaaaagtcaaccctgctcaaacaagacgtgaacgtcccgcttcaaatagctcaataggtaccaagactaccgaggtattttcatccacttctgcatcttcctccttgggagataccagcgatgagggagaaggcagtgatgccgacaaatctaaaataaatacttttcccagcatattgatggaaaaggctactcaaggtagaggcgctgatggaaatggaatgagaagcgcaagcaataataccattgtggaagcaactacggacggttccaaaatggcactgcaaaaaagcatgtcgtttgatgatacagccgcagagaaaactatgaataaatctagacattcttaccaagaacagttctcctcgaagaaaagccagtcatctttactgaacagcaagcaaagatcacgtgctaaatcgcaaacatgctcgtctacgggttataacaacagcagcattctgaaaacgtttggcataagctccaaaatttctaattcaagtgatcggatagaggcttcgtcattagaatttaacgttccatctcagaaacctttgaattgcaagccattaactccgtctcagaaatacagacttcgtaaagagcaatcggagatgaatttaagaaatacaatcaaaagaaaagagaaattttatgatagtcaagaacaaattcttgagttacaagagggagacgttgatgattcgttgatttggaacgttcctatggcatcattatctactaattcatttctagcgtctgctaagcccgatgatatgaataacttggctggcaagaatgacttatcagaatataccggaggtttggtaaatgataactctgaaatttcttatacaaaacaaaatcataggtactcgaacatctcttttgcgagtacaacatcaaacgcctcattattggactttaatgagatgcctacgtctccgattccaggtttgaacaaagtaactgattttcagttcattcaagacacaaccaagagtctagcctctgtttatttgcattcttccaataggctttcaagatctaagctgtccgaaagaacaaagtcttccgatttcttgccaattgaactaaaagaagctcaaaatcaaggcatggaagatttgatacttgtctcggagaacaaactagatgtggtcagccattcaagaccgagttggttaccacccaaggatcgccaggaaaaaaagcttcatgaaaggcaaattaacaaaagcatgagtgttgcttcccttgaccaactaggaaaaaataaagacagagaagaaaagttgattagagatgaaacaaataggcaaaaatatgtgttattattggacagagatataactagaaactcctccttacaaagcctaagtaaaatggtttgggacactccatttagtgacgaaactaggtcaacaatttacagcgaaattttacagagcaagactaggtttattaccaaaaactatattcaaccatttcatgagctacaggagcttttaacaaaaatgggagactttcctaaaaacaaggaaattgaaatatcgcagctaatcgaaacaagtttgaggcgaaaagtgagcggtttacatgatatatgtcctgatttgatgcttttattgaagataaaatctatctcatcacagggtatagtcaccggtgatgaactccttttccatcatttcttggtgagtgaatcatttcagaacctggggctaaacgagatttggaatattgttaatttagtacaaatgacgtgttttaatgatctttgtaaagaaaagttcgatgcaaaggttttagaacgtaagggtgtcgtagccggttatttatcgcaaaacgaggagttcaaggatgaatttaatacggagtgtataaactctaccacctggtggaacatcctagaacgtattgatcataagctttttatgtggatcatggatattatagtagtcaacaattcccagagctacaaaaatagcccaatcaacgaagatgagtttgttaacaaggattgggaatattaccgctcgaagaaagtggtaataaactacaagatcttgatttcatttgcattaaatgtattgttaaattaccactttggattcactgatttaagaagtctttgtaacgtgaatgaccagagattttgcattccagtattcatcaatgatgaattcgtagacgcagatactgtaaatgccgtgttcatcaagaaatgggcgcattactacaagaagttttga

SEQ ID NO: 4988 - DNA, 2559 bp, Saccharomyces cerevisiae
atgagttctgtcaaccaaatatatgacctatttcccaataagcataatatccaatttacagattctcattcacaggagcatgatacttcgtccagccttgctaagaatgatacagacggaactataagtataccaggtagtatagacactggcattttaaagagcattattgaggagcaaggttggaatgacgctgagttatatagaagttcaatacaaaatcaaagattttttttaacggataaatacactaaaaagaagcatttgactatggaggacatgcttagcccagaagaagaacaaatatatcaggaacctattcaagatttccaaacatataacaaacgtgttcaaagggaatatgagctcagggaaaggatggaagaattcttccgtcaaaacaccaaaaatgatttacatattttaaacgaggattcattaaatcagcaatattccccgttaggacctgcagattatgttctgcccctcgatagatactccagaatgaaacacattgcctcaaactttttcagaaaaaaacttggtattcctagaaaactgaaaagaagaagccattataatcccaacgcagagggccacaccaaagggaattcttctatattgagttccactactgatgtaattgataacgccagctacaggaatattgcaatagatgaaaatgttgacataacacataaagaacacgccattgacgaaataaacgagcagggtgcatcaggtagtgaatctgttgtggaaggtggatcgttattgcatgacattgaaaaggttttcaataggtccagggcaactaggaaataccatatccaacggaaattaaaagtgcgccatattcaaatgctttctatcggggcttgctttagtgtcggattatttttaacctcagggaaagccttttctattgccgggccatttggtacactacttgggtttggactcacaggtagcatcattttagccacaatgctgtcatttacagagttatccacccttattcctgtgtcttctgggttctcaggactggcttctagatttgtagaggatgctttcggatttgcattgggctggacgtattggatttcctgtatgcttgctcttcctgcccaagtttcctcaagtacattctatctcagctattataataatgtcaatatatcaaagggagtaacagcagggtttatcacgctgttttctgcatttagcattgtagtaaatttactggatgtcagcataatgggtgaaattgtatatgttgctggaataagcaaagtgataattgcaattttgatggttttcacgatgatcatcctaaatgccggacatggaaatgacattcacgaaggagtcggttttagatattgggatagctctaaatctgtccgaaatttgacctacgggctatatcgtccaacatttgacctggctgatgctggcgaaggaagcaaaaaaggaatttcaggcccaaaaggccgatttttagctacggcatcagtaatgctaatttcaacatttgcgtttagcggtgttgagatgacttttttagctagtggggaagctataaatccaaggaaaacaattccttctgctacaaaaaggacattttccattgtactgatatcttacgtttttttgattttttcggtaggcatcaacatatacagtggcgatccaagactactatcatattttcctggtatttccgaaaagaggtatgaagccattataaaaggcacaggaatggactggagacttaggactaattgtcgcggcggtattgattataggcagatttcagtaggaacaggttattctagtccttgggttgttgcattgcagaactttgggctatgtactttcgcatctgcttttaacgcaatactgatatttttcactgctacagcagggatatcctcgttatttagttgttcaagaacactatacgccatgtctgtacaacggaaggcaccgccagttttcgaaatttgcagcaagagaggtgttccttatgtttcagtgatattctcctctttattttcagtcattgcttatattgcagttgaccaaaccgcgattgaaaacttcgacgtcttggccaatgtttctagtgctagtacgtctattatatggatgggattgaatctttcctttttgcgattctattacgccctaaaacaaaggaaggatattatatcaagaaatgattcatcatacccatataaatcgccattccaaccatatctagcgatttatggtctagttggatgttcattatttgttatatttatgggatatcctaactttatacatcatttctggagtactaaagcttttttttcagcatatggtggcctgatgtttttctttatcagttacacagcttataaggttctcggaacgtcaaagattcaaagactagatcagttagatatggacagtgggaggagggaaatggacagaactgactggaccgaacatagccaatatttgggaacatatagggaaagagcgaagaagttggttacctggctgatttag

SEQ ID NO: 4989 - DNA, 2559 bp, Saccharomyces cerevisiae
atgttcaagtcgaaaacaagcactttaagctatgatgaaaccccgaactccaacgagggtgatcgcaatgcaacccctgtaaatcccaaagaaaagagccaaacgaaacatttgaacataccaggcgacaggagccgacattcctctattgcagattcaaaaagaagctcttctagatatgatggaggctactctgccgatataattcctgctcaattaaggttcattgataatatagactacggcacgaggctgagaaaaacacttcacagaaactcagtggtttcaaatgggtacaataaactcagtgagaatgaccgatggtatttcgacctattcgataggaaatatttcgaaaactatctcgaagaacccacatatattaaaatatttaaaaaaaaggaaggattagaacagtttgatagaatgttcttagctcaagagttgaaaattcccgacgtttacaaatctacaacctaccagggagaacctgcagttgctaattcagagctattcaagaattcaatatgctgctgtacgttcagtcatgatggtaagtatatggttattggttgtaaagatggctctttgcatctttggaaagtcataaactcaccagttaagagatccgaaatgggacgctcagaaaagtcagtcagtgcctctagagcaaactcactaaagattcaaagacatttggcgagcattagttctcataacggctccatatcaagtaatgatttgaagccgagcgaccagtttgaaggaccttccaaacaattacatttatacgcaccggttttctattctgatgtgtttagggtttttatggagcacgctttagatattttggatgcaaactggtccaaaaatggatttctaataacagcatcaatggacaaaactgcaaaactatggcaccctgagaggaaatactcattgaaaacttttgttcacccagattttgttacatccgcaatattttttcccaatgatgatcgtttcataattaccggatgcttagatcacaggtgtagactgtggtctatactggacaatgaggtttcttatgcctttgattgcaaagatttgataacatccctaacattatctcctcctggtggggaatatacaattatcggtacattcaatggatacatttatgttttactgacacatggattaaaatttgtatcttcattccatgtatctgataaaagcactcaaggaaccactaagaatagctttcatccatcttccgaatatggaaaggtccaacacggccctcgaatcacgggtttacaatgcttcttttctaaggtggacaaaaatttaagattgatagttacgacaaatgattcaaaaattcaaatctttgatttaaatgaaaaaaaacctttagagctttttaaaggattccaaagtggttcctcacgtcatagaggccaattcctaatgatgaaaaatgaacctgtagttttcacgggaagtgatgatcattggttttatacctggaaaatgcagtcctttaatctttcagcagaaatgaattgcactgctccgcatagaaagaaacggctgagcggcagtatgagtttaaaagggctgttgagaattgtatctaataagagtacgaatgatgaatgtttgacagaaacgtcaaaccaaagcagctcacacacatttaccaactcatcaaaaaatgttcttcaaactcaaactgttggttctcaagctatcaaaaacaatcattatatatcatttcatgcccataactcccctgtcacatgtgcttccattgctcccgacgttgcaattaaaaatttgtccttgtcaaacgatttgattttcgaactgacttcacagtacttcaaagaaatgggccaaaattattcagaatctaaggaaacatgtgataacaaacctaatcacccagttacagaaacaggaggattcagctcaaacctatcgaacgttgtgaataatgttggaaccattctaataacaacagacagtcaaggtctaatccgtgttttcagaactgatatcttaccggaaatacgaaaaaaaataatagaaaagttccatgaatacaatttattccacctcgaagctgctggtaaaatcaacaaccacaacaatgacagcatattggaaaatagaatggatgaaagaagttccacagaggataatgagtttagcacaaccccaccatctaacacgcacaatagtaggccaagccacgatttttgtgagctgcatcctaataatagcccggtgatttccggcatgccatcaagagctagtgctattttcaagaattcgatctttaataaatccaatggaagttttatatccctaaagtcaagaagtgaaagtacgagctccacggtgtttggaccgcatgatattccgagagtttctaccacttatccgaagttgaaatgtgacgtctgcaatggatctaattttgaatgtgcttccaaaaaccccattgctggcggtgatagcggtttcacgtgtgctgattgtggtacaatcctcaataatttcagatag

SEQ ID NO: 4990 - DNA, 2562 bp, Saccharomyces cerevisiae
atgagcagatgctcaaacgcggcgctgatgactgttgttgaggatgctgttggggccagggtggctgcaaggacgagaaacatgagcaatggcgtcaattaccgggagaaggaagtcaatgacctaacggctgacatttcagattcagattcagatttggattcagaggacaataaacatggcaaaggcgacaatgacactgcccccatatggttacaagatgatgtgcattcagacgaagatattcagctggactcagaggacgattccgatacagaagctgttcaagcccaagtggtggataaattggcaaaagacacgaaatcagagcaaaaatccttggatgatgagctctccgagatggataccaagacggtttctttaaaacttaagaaactaaacgagtttgtgaggcagagtcaggtatattccagtataatcgccgatactttactacatcgatctaatgaagtggctaacgctaatacaaaagataacagcaactctgatgatgaagaacattcttcaaaaaaacgtaaaacaaaaaaaaaatcaataacagatttcttcaaaaaacagaaaaagaacgaagatacaaccacccaaaacggcgcaccagacgatgcagcaataaagcaacctcgcctattgaaaaactgtattttaaaaccttaccaactagaaggtcttaactggctgatcactctttatgaaaatggcctgaacggaattcttgccgatgaaatgggtcttggtaagactgttcaaagtattgctcttttggcgttcatatatgaaatggacacaaagggtccttttctagtgactgcaccattaagcaccctagataattggatgaacgaatttgcaaaattcgctcctgatctaccagttctaaaatattatgggaccaatggttataaggaacgttctgccaagttgaaaaatttctttaaacaacacggcggcacggggatcgtcatcacatcatatgaaattattttaagagataccgacttaatcatgagtcaaaattggaaatttttaattgttgatgaaggccaccgtctgaaaaatataaactgtagattgattaaagagttaaaaaaaatcaatacttccaatagactgctactaacagggacgcctttacaaaataacctagctgaattatggtcacttttgaatttcataatgcccgatatctttgccgatttcgagatattcaataaatggtttgacttcgacagcttaaatttaggctccggttccaactctgaagcattgaataagttaatcaacgatgaactacagaaaaatttgatttccaatttacacacaattctgaaaccattccttttgagaagattgaaaaaagttgttttggctaatattctgccgccaaagagagaatatatcataaattgtccgatgacgtctgcacaggaaaaattctataaggctggattgaatggaaagttgaaaaaaaccatgttcaaagaattaatcaaggattttttcacattgaacgatgaatacatcggccacgtttctaatcggtccatacgagatttcatcaattataaactatctggtaatgaaacttcaaatacagacaataaaatcaatccaaccttgttgcaaatggacaaactatataagaagaacctgcaaatggaaatttcaaataagaaattgcaaaatatgatgatgcaattgagacaaatcattgactcaacttttttgttttatttcccatatttacacccagaagacttgactttggaaactcttttaaagacgtctgggaaattacaaatcttacaaaaattaatccccccattaatatctgaggggcacaaagtgcttatttattctcagtttgttaacatgctcgatttgatcgaagattggtgtgatttaaattcgttcgcgacatttcgaattgatggttcagtaaacaatgaaacaagaaaggatcaactcgagaagtttaatagctcgaaagataagcataacattttcctattgtccacaagggcggcaggactgggtattaatctagtcggggcagatacagttgtcttgtttgatagtgattggaatccacaggtggatttacaagccatggacaggtgtcaccgtattggccaagaatcaccggttatagtatataggttgtgttgtgataacaccattgaacatgttatattgaccagagcggccaataagcgaaatttggaaagaatggttatccagatgggaaaattcaataacctgaaaaaattggcgttaaatgaaggttcttttttgaaggcaaacaaagcgggtgttaatgtcactaataaggacttagtccaggagttatctatgcttttaatgagcgatgaatccaatataggctttgaaaatgggggacagaaagaaaataaggctactgagggccaactgactgataaggaggttgaagaattgaccaacagatctcttgaagcgtacaaggccaacagagtcgtagatctgccgcacgtcaagctatttgaaacaacctccggtctttaa

SEQ ID NO: 4991 - DNA, 2562 bp, Saccharomyces cerevisiae
atgatctcaacagcttctgcattttatcagaagcatagagtaaatttactgcgttcttcatacataatattgttgctagccacgctttacaattcaaattccagttctagtaacaacaaaactgataagaaggattctgagtcaacggttttagaaaataagaaaattgaagagggaaaagaaaccgcagtagatagagaggaagatgaaagtagcaaagaagagttaacgatagtctccaaacatagcacagattcagaagatggtgcaataataattgataaagaaagcaagactaatcataaggggggagagcgaaaaggaaaggtagattttttgttcaaacttttgcttcatgataagaagtgcctcattttatttattacacaggctattcttctgaacatcagaacattgctgtctcttcgtgtggctactttagatggtcaattagtgtccacactagtaagagctcaatacgcaaacttcacaaagatattgttggggaaatggatgatccttggaattcccgccagttttattaattcactgatcagttacacgacaaaactttgtgctgtcactattaataggaaagtttcagactttctactctcaaagtatctatctaatcaccatactttctattccgtagcttctgctgaatctgtttcagaaattcaggataatttgacaaaagatatttacacattttcaatgaactcgtcattattactgaatcagctattaaagccaatgctggatttgatcctctgttcattcaaattattaacctcaaacactagtgttatgggtgaaggaactttggcactgggcttaattgtctacgcctccaattcattactaaaattgattcaaccgaatttcactaggttaactatggcaagcgcatctttggaaagttggttcagatctttacactcgaatctacattcaagcaatgaagaaattgcactgctaagagggcaaaagagggaactagaaaacgttgattattcattttaccgtttggtgctatttttaaacagagaaataaaggcaagagctatttatgatgttgctactgcatttgtcattaaatatacttggggcgcagctggcttggtactatgctcgattccaatatttttcaaaaacaaacctagtgaagacaccttacagcttaaggaacccgggaatgatatgacggctgatttcatcacaaatagaagattattagtcactgcatctagctctatcggaagatttgtggaactgaagagaaatatacaacaattacgcggtatcagattgagattgaacaagttcaatgatttgttggatgctaataaaggtgatgacgaaaaagaaccaagagatgaaaggtgtatagtggaatatgatgattcaaggataaagtttgaaaatattcctttaataacacctgccaatcaagttctagtaccggagctaagttttgatctgaagcatggaaatcatctactaattattgggcccaacggttgcggtaaatcttcattatttcgtattctaggcgggctttggccgataagggcgactcccaataaaaatcatcaatccaagttaataatgccgcgtagaactgtggatagagattgcgcaatattttatttaccccaaaggccgtatatgggcaataggtcgacattcagggaacagattatttatccagacagtattgaacaattcaaagaaagatatcacaatgattatgatctaggcgatgcagatttaataaaaattctgcaattattagatttggaggatttagtcactgaaaatatgtcacttctgctggcgcaaaggacttccaaaaatgattcacagcagttgtcgacggaagacaatcagtcaccatgcgccattaaagttcgtgatgcattcagtatagtaagaaattggtccgaagaattaacaattggtgtccaacaaaggttagctatggcaaggatgtactatcataaacccaagtttgctgtgctcgacgaatgtacatctgcagtagccccagaaatggaacaaaggatgtacgaaaatgcgcaaaattttggtatctcgttaatatcagtttgccacaggacaagtttatggcattttcataactatctgttaaaatttgatggtaaaggcggataccaatttggaccgtttaacccgaaggaaaggttatgtaatgaagaaaaacttcttgaactaaatgccatcttggatcaacaggtgccactttgggagcggaagttgaaagatctgacaattgctaaagaatccaacatcattcgtaaatcagaaactaacctgaatctttttgaaaagatcgaagatccaaaaacgtccaaatctaatgcattgtttaatgcaaataaagggcagcgaatcacatcacctacagggcaggagactagtaagagattaccactattttcccaaccatctagttcagcatcatcaaatttactaagaaacaataaaagcttgaacaaaaaagttaaaacaaaaaaggaagaaggaaaggagaggtaa

SEQ ID NO: 4992 - DNA, 2562 bp, Saccharomyces cerevisiae
atgtcatttcagattaccccaactcgagatttgaaagttattacagatgagttacaaacactttcctcatacatctttcacacaaacatagtcgatgatttgaactctttacttacatggatgagccctaatgatgccaagagtaaccatcaactacgtcctccaagccttcgtattaagaatatcattaaggttctcttccctaataacgcaaccacatcgccatatagcatgataaacactagtcaggcaaacaattcaatagttaatgagggaaatacaaacaaagagttacaactacaacttttttccacgctcaaagagttttatattttccaggttcgttatcattttttcttacattttaacaacattaattatctaaaagatatccaacgatgggaaaattattacgagtttcctttacgttacgttcctatttttgacgtaaatgtaaacgactgggcacttgaacttaattctttaagacattatctgttgaatagaaatataaagttcaaaaataatttaagaacaagattagacaaattaataatggatgatgatttcgacctggcagacaatttaatccaatggctcaaatctgctaatggttccttatcctctacggaattgatagtcaatgctctttacagcaaaatcaataaattttgtgaagataacatgagtagagtatggaataaaaggtttatgattatggaaacattcaacaaatttattaatcaatattggtctcagttctctaaattagtcggttgtccagaggatgatcacgaactgaccactacagttttcaactgttttgagtccaattttcttaggataagaacgaatgaaatctttgatatatgcgttttggcttatcctgattcaaaggttactttattggaattgaggaaaattatgaaagattttaaagactacacaaatattgtaacaacttttttgtctgatttcaagaaatacattctaaaccccagcgtaactacggtggacgctttgttgagatatgttaaaactatcaaagcatttttggtcctggatccaacagggagatgcctacattcaataaccacgtttgttaaaccttactttcaggagcggaagcacttagtaaatgtattgttatacgcaatgttggacttacctgaagaagaactaaaggagaaaattaatttcaatgtagatatgaaggcactgctctcacttgtagacactttgcacgattctgatatcaatcaagatacgaacatcaccaaaagggacaagaataaaaaaagcccctttctatggaacctcaaggtgaaaggaaagagggaattgaacaaggacctaccaataagacacgccatgctatacgaacatatactcaattattatatagcttgggtaccagagcctaatgacatgattcccggtaacatcaaatcaagttatattaagacaaatttgtttgaggtgcttttggatctatttgaatcaagagaatttttcatatcagaatttcgaaatctcttaaccgacagattattcactttgaaattttatacgttggatgaaaaatggacccgatgtttgaaattaataagagaaaaaatagtcaaattcacagaaacaagtcattccaattatataacaaacggtatattaggactcctagaaacaacagcccctgcagcagatgcagaccagtcgaatttgaatagcattgatgttatgctttgggatataaaatgtagcgaggagctctgccgtaaaatgcatgaagtagccggactggatcccataatatttccaaaatttatctcactcctctactggaagtacaactgcgatacacaaggttctaatgatcttgcatttcatttaccaatagatttagaaagggagctacagaagtattctgatatatactcacagctgaaacctgggcgcaagttacaactatgcaaagataaaggaaaagtagaaatacaattagctttcaaagatggtaggaaattagtgttagacgtttctttagaacaatgcagcgtaataaatcagtttgattctccaaatgatgagccaatttgtttatcactagagcagctttctgagtcactaaatattgctcctcccaggctaactcatttgttagatttctggattcaaaaaggtgtgcttttaaaagaaaatggaacctattccgttattgaacatagcgagatggattttgatcaagcacaaaagaccgccccaatggagattgagaacagtaactatgaactacataacgattctgagatagaaagaaaatatgaattgacacttcaaagaagtctgccattcatcgaaggaatgctgactaatttaggcgcaatgaaacttcataagatccattcttttttgaaaattaccgtgccaaaagattggggatataaccgaattactcttcaacaattagagggatatttaaacactctggccgatgagggtaggctgaagtacattgccaatggttcatatgaaatagtgaaaaatgggcataaaaactcatga

SEQ ID NO: 4993 - DNA, 2565 bp, Saccharomyces cerevisiae
atggcgatccaaacccgttttgcctcgggcacatctttatccgatttgaaaccaaaaccaagtgcaacttccatctccatacccatgcaaaatgtcatgaacaagcctgtcacggaacaggactcactgttccatatatgcgcaaacatccggaaaagactggaggtgttacctcaactcaaaccttttttacaattggcctaccaatcgagcgaggttttgagtgaaaggcaatctcttttgctatcccaaaagcagcatcaggaactgctcaagtccaatggcgctaaccgggacagtagcgacttggcaccaactttaaggtctagctctatctccacagctaccagtctcatgtcgatggaaggtatatcatacacgaattcgaatccctcggccaccccaaatatggaggacactttactgacttttagtatgggtattttgcccattaccatggattgcgaccctgtgacacaactatcacagctgtttcaacaaggtgcgcccctctgtatacttttcaactctgtgaagccgcaatttaaattaccggtaatagcatctgacgatttgaaagtctgtaaaaaatccatttatgactttatattgggctgcaagaaacactttgcatttaacgatgaggagcttttcactatatccgacgtttttgccaactctacttcccagctggtcaaagtgctagaagtagtagaaacgctaatgaattccagccctactattttcccctctaagagtaagacacagcaaatcatgaacgcagaaaaccaacaccgacatcagcctcagcagtcttcgaagaagcataacgagtatgttaaaattatcaaggaattcgttgcaacggaaagaaaatatgttcacgatttggaaattttggataaatatagacagcagttattagacagcaatctaataacgtctgaagagttgtacatgttgttccctaatttgggtgatgctatagattttcaaagaagatttctaatatccttggaaataaatgctttagtagaaccttccaagcaaagaatcggggctcttttcatgcattccaaacatttttttaagttgtatgagccttggtctattggccaaaatgcagccatcgaatttctctcttcaactttgcacaagatgagggttgatgaatcgcagcggttcataattaacaataaactggaattgcaatccttcctttataaacccgtgcaaaggctttgtagatatcccctgttggtcaaagaattgcttgctgaatcgagtgacgataataatacgaaagaacttgaagctgctttagatatttctaaaaatattgcgagaagtatcaacgaaaatcaaagaagaacagaaaatcatcaagtggtgaagaaactttatggtagagtggtcaactggaagggttatagaatttccaagttcggtgagttattatatttcgataaagtgttcatttcaacaacaaatagctcctcggaacctgaaagagaatttgaggtttatctttttgaaaaaatcatcatccttttttcagaggtagtgactaagaaatctgcatcatcactaatccttaagaagaaatcctcaacctcagcatcaatctccgcctcgaacataacggacaacaatggcagccctcaccacagttaccataagaggcatagcaatagtagtagcagtaataatatccatttatcttcgtcttcagcagcggcgataatacattccagtaccaatagtagtgacaacaattccaacaattcatcatcatcctcattattcaagctgtccgctaacgaacctaagctggatctaagaggtcgaattatgataatgaatctgaatcaaatcataccgcaaaacaaccggtcattaaatataacatgggaatccataaaagagcaaggtaatttccttttgaaattcaaaaatgaggaaacaagagataattggtcatcgtgtttacaacagttgattcatgatctgaaaaatgagcagtttaaggcaagacatcactcttcaacatcgacgacttcatcgacagccaaatcatcttcaatgatgtcacccaccacaactatgaatacaccgaatcatcacaacagccgccagacacacgatagtatggcttctttctcaagttctcatatgaaaagggtttcggatgtcctgcctaaacggaggaccacttcatcaagtttcgaaagtgaaattaaatccatttcagaaaatttcaagaactctattccagaatcttccatactcttcaggatatcatataataacaactctaataatacctctagtagcgagatcttcacacttttggtagaaaaagtttggaattttgacgacttgataatggcgatcaattctaaaatttcgaatacacataataacaacatttcaccaatcaccaagatcaaatatcaggacgaagatggggattttgttgtgttaggtagcgatgaagattggaatgttgctaaagaaatgttggcggaaaacaatgagaaattcttgaacattcgtctgtattga

SEQ ID NO: 4994 - DNA, 2565 bp, Saccharomyces cerevisiae
atgtctaggaaaagaagtactaagcccaagccagcagctaaaatagctttgaaaaaagaaaatgaccagttcctcgaggcattgaaactatacgaagggaagcaatacaaaaaatctctcaagctgctagacgcaattttgaaaaaagacggtagtcacgttgattccttggctttaaagggtcttgatttatattctgtaggtgagaaagatgacgctgcttcctacgtggctaatgccatcagaaaaattgaaggcgcttcagcatcaccaatctgctgtcatgtattaggtatctacatgagaaacaccaaagagtacaaagaatctattaaatggttcacggcagctttgaacaatgggtccactaacaagcaaatatatagagacttagcaactttgcaatcacaaattggcgatttcaaaaatgctttagtgtccaggaaaaaatattgggaagcattccttggttaccgtgccaactggacatcattggctgtggcacaagatgtgaacggtgagaggcaacaagctattaacactttatctcagtttgaaaaactcgctgagggaaaaatatctgattccgagaaatatgaacacagcgagtgtttaatgtacaaaaacgacattatgtataaagctgccagtgataaccaagacaagttacaaaatgtattgaaacatttgaatgatatcgagccatgcgtctttgataaatttggtttattagagagaaaagcaactatttacatgaaattgggtcaattgaaagacgcgtccattgtttatagaactctgatcaagagaaatccagataattttaagtactacaaattactggaagtatccttgggaatccaaggtgacaataaattgaagaaggctttgtatggaaaacttgaacaattttatccaagatgcgaaccacccaaatttattccattaactttccttcaagacaaagaagagctcagcaaaaaattgagagaatatgttttgcctcaattggagcgcggtgttccagcaactttttccaacgtgaaacccctttaccaaagaaggaagtccaaggtttcaccactattggagaaaattgtccttgattatttgtccggattagatcctacgcaggatccaattccttttatttggaccaattattacttgtctcaacatttccttttccttaaggattttccgaaagcccaagaatatattgatgctgcccttgaccacaccccaactttagttgagttttacatcctcaaggcacgtatcctgaagcacttaggcctaatggacacagcggctggaattttggaggaaggtaggcaacttgatttgcaggatagatttatcaactgtaaaacggttaagtactttttaagggctaacaatatcgacaaggcggtggaagtcgcgtcccttttcaccaaaaacgatgattctgttaatggtattaaggacttacaccttgtggaagcttcttggttcatcgtagaacaggcagaagcctattatagactatacctggatagaaaaaagaaattagacgatttagcatcgctaaaaaaagaggttgaaagtgataaaagcgaacaaattgcgaatgatatcaaagaaaaccaatggcttgttcgcaaatataaaggtttggcgctgaaaagattcaacgctattccaaagttttataaacaattcgaagatgaccagttggatttccattcatactgtatgagaaaaggtacgccaagagcctatctggagatgttagaatggggaaaggcactttataccaaacccatgtatgttcgcgcaatgaaggaagcatcaaagctttactttcaaatgcatgatgatcgcttaaaaagaaagtccgattctttagatgaaaattcagatgaaatccaaaataatggccaaaatagtagcagccaaaagaaaaaagctaagaaggaagcagccgctatgaacaaacggaaagaaactgaagccaagagtgttgctgcttatccgagtgatcaagataacgatgtattcggcgaaaagttgattgaaacctccactccaatggaggacttcgctaccgaattttataataactactccatgcaagtcagagaagacgaaagggattatattttggactttgaatttaactacagaattggaaagttagctttgtgctttgcttctctaaacaaattcgctaagagatttggcaccacgagcggtttatttggtagtatggccattgttttgttacatgccacaagaaacgacaccccctttgatccaattttgaagaaagtagtcacgaagagccttgaaaaagagtattctgaaaatttcccattaaacgaaatatctaacaatagcttcgattggctgaatttctaccaagaaaaattcggtaagaatgatataaatggcctgctatttctgtatcgctatcgcgatgatgttccgatcggaagctctaatttgaaagaaatgattattagcagtctttctcccttggagcctcactcccagaacgaaattctacagtattacttgtag

SEQ ID NO: 4995 - DNA, 2565 bp, Saccharomyces cerevisiae
atgtgggtagtacgataccagaatacattggaagatggctctattagctttatatcatgttgtcttcaggccttcaaaacttatagtataggtagatcaagtaaaaacccactgataattaaaaatgataaaagtatttccagacagcatatcacattcaaatgggaaatcaataatagttcggatctgaaacacagtagcctgtgtttagttaacaagggtaaattgacatcattaaataaaaaattcatgaaagttggcgaaacatttactattaatgcctcggacgttttaaagtccacaataattgaactgggtacaactcctattcgtatagagttcgaatggataaatgaagtctggaacattcctcctcatttgacacaattcaggacgatgctttctgaatatggtatctccactgagatttctattaatgatattcccgctaatctgatgattagcgattacccaaagagcgaggacaacagcatacgggaattgtatgcccttgttagtactatacccatgaaaaaatcacggtttctgatggaattgtgtaatactcttcttcccacatctaaaactaatttaaaatttgatgaaatgtggaacgatatgattagtaatccggagtacaatgtttttgattttgatccaaatattttgctttcgaagtttatgaggctgaataatatcagagtgttaactactatcaaaagtgaaccacgtctatcatctctcctgcggacgttcaatataaatttatttgcatttgacaacattgatagtttatataaatatgttgacagcttggaagcatcaacagaatacctgattttgacaactacagataagaaagaaaatgggaaaattctatgtactatcaaaacgatgttaacatcaataatagatggcaccttaagcgcagtgattaatatgaagggtgcatcttcaagaactctagataacggtaaatttgatcaaatttctgaaggaatgtctactattttgaaaacatctcgtgcacctgaagttgaagctagtccagtagtctcgaagaagcgaaaattaaatagacgtagagtactaccactcgatagtcttgatttttttgctggaggtttgagtactaagactctatcagaaaataggtctttaactgacgctaagagacttaattgtggcgcagaatcaaagactgtcatttcaagtcccaacattgcagaggcagatgaaaagcacgccccatttcttcaaaacgcactaaagccgactgaagatattggaaagaaaagtggtcacagtagccctggtgctataattgtcagtagccccaacttaggtactgtgaacacgagtgaggattcgttggataagtcgctacagtcacataagttaccacagccgtcattgccggaggtagcagggattggctctcaaaccatatcttcgaactccgctgactatgaaacagctgctgtgaattcgatggatgatgctgaagttactaagaattttagggtgaatcatcaccagaatatagagcaaccctctaaaaacatccgtaaactttctaattattcacgagaaatttcatctccattacaagaaaattgtaagtcacctgtaaaagagttatctattaaagagaaatctggtacgccgcacgcatttgttgaagctattcaagaaactaaaaatagagaggtcaaaagagttaagtcaaccattgttgaattgaaggatgaggagttgagcgaggaagctattaatcagctaaaaaatttggctattgtagaacctagtaacaatttactgaggaaatcatttgatagtgagggaaacaaaacaagcagaacaactgaaaaatgggaaaatagcctaatggagccagaatggcataaacgcaagaatttcaagacttttgtcaaggtacgtccaaaatcaaaggcgcacaaagaagagggtaaaaataacactcaaagctcagattttatacgaaatgcagcctttttaatcactagaaattatgttccgttaaaaaaatactccaaaaaggatacaactacaaaatggggcacagaagaaaacgaagatatgtttgctttgacggagatggaaagatttggatcgaatacatttatgtccgataatataaactcaaacactatccagaaaagatctcaagctctaaacagattcacgaatgaggatagttcaaatgaaggagaagaagattcgttttctttttctcgttgttcaggtactgcagccagcgttcaaccactaaaaaacaaaatttttattactgatgaagatgatctgggtgatattgatgataaaagcgatagactaaatcacagagaaaataatcgtaatctttttgtggtgaaggaaatgaacttacggccaaacttgtcagaagaatgttccaagcaaagtagacacagtagaagcgcaactagtagatcacgtggctcttttggggcttctaataacggtgatggcgacgacgacgatgacgacggtccgaagtttacgttcaaaagaagaaaaggataa

SEQ ID NO: 4996 - DNA, 2568 bp, Saccharomyces cerevisiae
atgggagatgagaagctttcacgccacacatctttgaagagggccagatcgctctccgaatccattaagggtctatttaagccttcagggatatcaggcagtaataatgctgcggctccttcatctcgtcccggtcaggaccaagcacattctcatcaaacagcaagaataataactagcaacgtatcttccccgtctatatcccccgtacatagccctgttctacaagcggctcctaagcatcacaaactgggcgtccctaatattgcaaaactctcgttgtcacctagtagggaaccatctttgaattcagaaaatgaaatgttttcacaagaatctttcataagtgaaaaagatgaagatgaagccaatttgttagagagagaggatcttcaaaataaaaaggaagagaaagctcgtgcaaaacatgtacgttccaaggaagcttatgtgcctcatcaccgctatacagttggtagcgatgaggttgaaagacaaccaagggaacggctgaaaaacttcccacaaaacgcaggttcttcaaaccctgcaaatagtaatgccaaccatgttttggatcaggaaaataacttttctattgatgctatgcttgattatgacgaagaatcaaaacttagaaggagaaacagtctgggcgtacgtaatcatagcaatcgcacaagaagtaggaagaacagtttgtccacaccaaggtcaccaccaatgaaaaatggaaatggtggaatgaattcaaatgccaccaacaatgttggtaatggtacaggaaatagaatatacatgaggggaagaaatcactcagactctatcagtgcttccagcttaccgaaatttcaagaaatcgaatgtaaatgtattttggatttaggtcatttcaaagtctttgaaaacggataccacgaacattctttgagagtgctgccaattattacaaacaataaaaatgtggatagtggcgatgaaaaggatgctgacgcttctgtaaacagcggcgatgatggtgacaatgacagtgaggcaaatatgcataaacaaaaatctgtgttttctttaagtggattattcaaatctcataaggatggaaaccaacaacagcagcaacagcagcaacaagaagaaaacggcgaacaaatcaatctagaaaaagcattttcaataataccatcccagagattcatcaaatcgcagactttaaagaaatcgagaacgagtaaccttaaaaatggcaataatgatgaattgatgaaaaacgatggtaaaaatattccgcaaatcgtgaatcctaacgctgctgtaggtgttgaagagttgaagctaatcaatgcattatcggaaaaaatacgaaagggccttaaaagtgaaaatacaaaaggcaacaatggcgaaggcagaagcaatagcaataaacaggaggattctgatgacacagagggcaaggcaggaacaaccaatgacgatacatctcataaaccttgttcacaaaaatacggaaaatctattggggtcgtcggtgcaggtgcatacggggtggtcaaaatttgcgcaaggtgcaagactgctaaagatgtcctaccatacagtacctactctaatggaaaaaaactattctttgccgtcaaagagctgaagcccaagccaggtgaccaaattgataaattttgcacgagattaacctctgagttcattattggacactcactgagccatccgcattttgaggcaaatgcgatgatagcaggaaatgtttcaagaaccactccaccaaaacatgtcttcaatgccccaaacattttgaaaattttggacctaatggaatatagcaattccttcgtagaagtgatggaattttgtgcttcaggtgatttatattcgttgctaacaaggaataacatctcaaatgaatcgaataacgggagttcaagattgatccaaactgttaaagaaggttctgggagtccgttgcacccattagaagcagactgttttatgaaacagcttttgaatggtgttcaatacatgcatgatcatggtatagcacactgtgatttgaaacccgaaaatatccttttccaacctaatgggttgttaaaaatttgtgattttggtactagttcagtttttcagactgcctgggagaaacacgtccacttccagagtggagccatgggttcagagccatatgtggcacctgaagaatttataagggatgcagaatacgatccgcgtctggtagattgttggagttgtggtattgtttactgtacaatggtcatgggacagtatctttggaaaatcgccattcctgaaaaggattctctttttaaatcatttctcagtgaaattaaagatgatggacagttttatctatttgaggaattaagacatgttagtagcgaactgaataggttgaggaaaattgcactatatagaacgttccaggtcgaccccacgaagagaatcaccattgaacaattactacaaagctcctggatgaggaaaacaaaatgctgtgtagtttatagacacttacataccaaggttagtaaataa

SEQ ID NO: 4997 - DNA, 2568 bp, Saccharomyces cerevisiae
atgtctgaaggaaaacaacaattcaaagacagcaataaaccgcacaaggactccacagatcaggacgatgatgccgccacaatagtaccacaaactcttacttactcacgcaacgaaggtcattttttaggcagtaatttccatggagtaactgatgaccgtaccactttgtttgatggtgaagaggggcgtagggaggatgatttgttgccctcattgcgttcctccaactcaaaagcacacttaatttcttcacaacttagccagtggaattataacaacaatagagtacttttaaaaagatctatattaaagacacaagcttttatggatcaacttcaagaagaaaataatattcgcccgatttttattgctgcaaatgatgaacgggaaaaattacatgttctacaactgaatatcaagctagatggtcagtacaataccaaagaaaagaacggtttcaacattgagaaaaaagctttatcaaaattatttcactctcagatcgtatcagtgacaaatcatttaaacgctttgaaaaaaagagtggatgacgtttcatctaaagtattcatcacaggtgatgtaaatactggtaaatcagctctttgcaactctctattaaagcagcgtttgctacctgaggatcagctaccatgtaccaatgtattttccgaaatactagaggctcgggaaaatgacggcatagaggaggttcatgccataccactaaacattgctccgactctcaaggaagccattgatatgtattcaatacaaaatcccaagacttatgaaatacacactttgaaagaacttcccgatttggttccccaaaacggaaaatatgctttactgaagatttacataaaggacgataaaaggcctgcctctactagtctattaaggaatggtactgttgatatttcattaattgactcccctgggttgaacatggactcgttacaaaccgccgaagtaatgtcccgacaagaagaaatcgacttagttatatttgttgtcaatgcagagaaccagctaacactatctgccaaggagtttatttctttagcatctcgtgagaaaaaattaatgttttttgttgtgaaaaaatttgacaaaatcagggacaaacaacgttgtaaggagttgatcctaaagcaaatccgtgacctgtccccagaaacatataaacgtgcagctgattttgtccactttgtttccaaaaacggagatgaattgccacattatcataatgaaaatgacaatgaagatcatggtgaccgaaaacctgacgacgacccatattctagcagcgatcccgatccggattttgacagtctggaagattctctacgcaattttgttttgaagaaaagatcactttctaaattgttacctgccaagacttatctatcgaaattattaagcgatataataatgatctccaaatctaatatgaaaatgtatagtgaagaagaaataaaaattaacgaacaactggaaacattgagacctgaaattttgagcgctagagcaaagtgcaatgatttaacaacttccgttgatcaaatggccgagcaaacaattacaatgacttataacaatactaaagaagcacttctcaatgcgttggatgttccgctacacgaatatccgaaatatcagggcctcggtcaaatttatgacttcatattttcaacagaagcgttcatagcaaatcagattgatgagtcaataggatcaagtgaattatttgccaagcaaaagacagatttactggtaaaaaaaatttatgagattggaaaaaatgaacttggtgatgatttcatgtgtgaacgtgttttcagaagcgaactaatgtttagaaaaaggaagcatttgataggaaaaaggcttaaagtatctttgtcaataactgatttgtttgctccaacttggaaaggctttttgtcttacttaagctggcagaaacctgtcacagcaccactgccggatatagaaggacaaactaacgagggtcagattggcctaatgaagtatttgggtttgaaaaattatcctttgacacaatattggtcaagaccatcattgctcttcacatcaaaaattcccactctaacgctgtactttctaggaagtacaaaggttgtggggaacattatattaaacggcattaaattatcgtcgtggagctcactcaagaagttatcagttccggttatagtggtaggttccttgttgggacttacgtatttaattcatgacctcccccgtgccttaccaatgaatctttccattaaatacaaaagaaagttgcaagaactggattacattcatcttaacgctcaaagaacctcaaatgaagtacgtgatgttttgcgtgtacctacacgtgaaattctaaggtcgtgtgaaataattatggataaaaaacaaatcactaagaaagaattggaaaacaaaaaagaaagtaacttgttgtcaatcaaattcttccaatctctatacgaaggaaccgtggctcaaaaattgatggtggaagaaataaatttagacatcgattag

SEQ ID NO: 4998 - DNA, 2571 bp, Saccharomyces cerevisiae
atgtcccgtgaagtactgccaaacaacgttaccccattgcattatgacattacactagaacctaatttccgtgcttttacgtttgaagggtcattaaaaattgacctgcagattaatgatcattcgataaactctgtgcaaataaattacttagaaatagatttccattctgcacgtattgagggtgtcaatgccattgaagttaacaaaaacgaaaaccaacaaaaagctactcttgtctttcctaatggaacttttgaaaacctaggaccttctgcgaagttagaaattatcttttccggtattctaaatgatcagatggcgggattttacagggctaagtatacggataaagtcacaggggagacgaagtacatggctactactcagatggaagccacagatgctagaagagcctttccttgttttgacgaaccaaatttgaaggcgacttttgcagtaactttggtctctgaatcgtttctgactcatttgtccaacatggatgtcaggaatgaaacaatcaaagagggtaagaaatatacaacttttaacacgactccaaagatgtctacgtacttagtagcatttattgtagctgacctgagatacgtggaaagcaataatttccgtattccagtaagagtttattctaccccaggggacgaaaaatttggtcagtttgcagccaatttagctgctaggaccttgagattctttgaggacaccttcaacatagaatatccattgccaaagatggatatggtggcagttcatgagttttctgctggtgctatggaaaactgggggctagtgacttatagagttattgatttgttattagacatagaaaattcgagtttagatcgcattcaaagagttgctgaggttattcagcatgaactagcccaccaatggttcggcaacttggtcaccatggattggtgggaaggcttatggttgaatgaaggttttgccacttggatgtcttggtactcttgcaacaagtttcaaccagaatggaaagtttgggagcaatatgttactgacaatttacaacgtgctctaaatttagattcattaagatcttcccatccaattgaagttcccgttaataatgcggacgaaatcaatcaaatttttgatgctatttcttattctaaaggatcttctttattgaggatgatttccaaatggttgggtgaagagacttttattaaaggtgtgtcccaatacctgaataaattcaaatacggtaatgcaaagaccggagatttgtgggacgccttagcagatgcctctggcaaggacgtttgttcggtgatgaacatctggacaaaacgtgttggttttccagtgttatctgtcaaggaacacaagaacaaaatcacattaactcaacaccgttatttaagtaccggtgatgttaaagaagaggaagatacaaccatataccccattttgttagctttgaaagacagtacaggtatcgataacacattggtattgaacgaaaaatctgctactttcgaattaaagaatgaagagttcttcaagattaatggtgaccaatctggtattttcattacctcttattctgacgaaagatgggctaagctatccaaacaggcaaatttattatccgtagaggatcgtgttggcttagtcgcagatgcaaaagccctttctgcatctggctatacctctactactaacttcttgaatttaatttctaattggaaaaacgaggattcatttgttgtttgggaacaaatcattaatagtttatccgctctgaaatctacttgggtcttcgaaccagaggatatattgaatgctctagataaatttactttggatctagtacttaacaaactttctgaattggggtggaatattggcgaagacgactcctttgctatccaacgtttaaaagtgacccttttcagtgccgcatgcacttctggcaatgaaaaaatgcaatcgattgcggtagaaatgtttgaggaatacgccaatgggaacaaacaggccatacctgcactgttcaaggcagttgttttcaacaccgttgccagacttggcggagaaaacaattacgaaaagattttcaacatctatcaaaaccctgtttcgtcagaagaaaagattatcgctttgagagctttgggcagatttgaagacaaagaacttttagaaaggacattgtcttatctgctagatggtacagttttgaatcaagatttttacatcccaatgcaaggcattagagttcataagaagggtattgaaaggttatgggcttggatgcaagaacactgggacgaaattgctaagagattacagccaggctcgcctgtgttgggtggcgtgttgacattgggtttaactaattttacctcttttgaagcccttgaaaaaattagtgcgttctatagtagaaaggtcactaaaggttttgatcaaaccctggctcaagccttagacactattagatccaaggcgcaatgggtgagcagagatcgtgaaatcgttgctacctacttgcgtgagcatgagtatgatcaatag

SEQ ID NO: 4999 - DNA, 2577 bp, Saccharomyces cerevisiae
atgtcattaccgggtacacctactacatctccgaccccgatggatgaggatactgaacaagccgtttcggttaatactgaacccaaaagagtaaaggtttacattttagagaacaacgaatggaaagacacaggtacagggttttgtataggggaggtggacgaaggtaagttcgcatatcttgttgtctcagatgaagactccccaactgaaactttactaaaatccaaactagaaggaaatattgaatatcaacggcaggaggaaacgcttattgtttggaaggatttaggggggaaagatatagccttgagttttgaagaaagtatgggatgtgacaccttatgtgaattcattgttcacgtccaaaggaacatagagtcaaatatttctttagtcaccgtaaaatccagcgacaacggactcgggtctgttcacgacattataacgggccctgtgaccttgccctccaacgaccagcaacagaatagtcaaactttactagaagctctaaagattttgaatgaaaatacttctttcgattttttgaaaaacgaaaccattgagtttatcctccagtcaaattacattgatacactgatttctcatttccacaaagcagaagaagaaaagataccgaaggatttatttttgctaagtaacatcatcaaaactttgatactttacaataaaagagacatattggagtcaatggtggaggacgataggattatgggaatagttgggattttagaatacgatactgaataccctacatcaaaggcaaatcataggaaatatttaggatcaaaaggtcccaatttcaaagaggttattccattggaaaatgaggacttaaaaataataatgaaaaaatgttttcgcttacagttcttaaaagacgtggtattagtacgatttttagacgatcataatttcaacttaatctcggaaattgtcatggacctggaaacgtgtataatcgactttcttcaagtagggacgtttttggacagactaatagagctttatgataccaaaacccttccagaaagctcttcagagaaggagaagtttgtacaaaaacgaaaagacgggattagattgttgcaacagtgtgttcaaatgtcaatcaatttagatgcggttgaccgttctaagttctataaaacacttgttcgaaagggtctattcaaagttttagattatgcatttcacatggagacggatagtaatgttaggattttagctacggatactatcattactataatcgaacacgatatcttgttaattcacaacgttcagaatgaagattctttcaaacggcaacataaatcagcgcccgatgacaagtcttcccatcggaaatatccgcaggattacagctccagtactgattccaagttgttattgatactttcaaccattcttctgtccgacaggagtcccggattgcgagaacaagttgtgcaagcgctaaatactttgcttcaccctgaaggatgtgtgggtaatggagaaggttcatatgatcttatgggcagatcaaattatgaagctaagaacacatctgaagatttcccaagtttcagttatggtttaaactcggattcaatcaatttaaataactatcactatagcagcgatgaaatgaataatctagagccagaatctgaatctgaatttcaagtaatggaatattttgcaaatttctataataaaatcgcacccatactgtttggtccattaatcaagaaggatatcacaacggaaatggcagaaatagatgggcaaatagaaaaggttacaaaagacgatcttttgttaattcatttagtgaaattggtatcatttgtttgcactgagcatgatcgtgtcttatccagaagattcatattagaaaacggtatactagattctgttagcaaacttatcggcggtaatcatatgatgcagctaaggttaacagcagtaagatgcattaaaaaccttatgtgtctcgatgataaatactatcatcgatatatgatttcaaaaaatttatatgcgccggtttttaaactcttccaggagaacatagataagaataatcttgcaaattcatgcattcaagattttttccgcattattataacagaatgtagagcttatcaaagtgatggccataacagaaaggaaaaaaccaatggttcttatgatggcaacggtaatgacgtcaaaacgaacgtgaacaacaataggacaaactttaccattttaaacaaatacttagttcaaacatatggtgatgtcttgagaaaagctactgatatccctttcatccaggatatgctagaaaccggggaagaaaaccaacccgatcattctagctttgaaaatagcattgaaggggggaatgacatttctgtaaatatgtcaacagatggatttgcttcgaatcatttagaagatattgacattaaaaacgtcaaaagattacattctgagattgaacactttgaaaatgacccccattattctggtgatcagttagcatttaaaaaaagcgttgaccaaatgaatgcaagtacttga

SEQ ID NO: 5000 - DNA, 2577 bp, Saccharomyces cerevisiae
atgtcgtccttatccacttcatttgattcatcgtcagatttaccaaggtcaaaatccgttgacaatacggcggcttccatgaagacaggcaagtacccaaaattagagaactataggcagtattctgatgcacaaccaatacgtcacgaagcgcttgcattgaaagtggacgaaacgaaagattctagacacaaatttagttcctctaacggggagaatagtggagtggaaaatggaggctatgtggagaaaacgaatatatccacaagtggccgcatggattttgaaggtgaagcagaagcagaagcagtgaaacgttaccagttaagatctttcgcgcttttaagttctaatgcgaggccatccaggctagcaaagtctgaaactcaccaaaagcagattcatgtagagagcatcgctccctctttgccaaagaatgcggctttagagagaggccatgatacggcgttacctgccggtacgtcaagtaacagatgcaacttagaagcctcctcctcggcaagaacttttacaagcgctcgtaaggcttcgctagttagcgcaatctttgaaacatcggctgaatcagagcatggtacgcatcccaaacaggcgaaacttaagagaagaacctattctacaatatcgacacattcatcagtcaatcctacaacgttgttgacaagaactgcatcgcaaaagtccgatatgggaaatgacacacgaagaattaaaccgttacgtatggatagcagggtatctttccatagtgagatatcgcaagcatccagggattctcaagaaacagaagaagacgtttgttttccaatgtttcgactattacatacaagagttaatggtgttgattttgatgagttggaagaatatgcccagatttcaaatgctgaaagaaatctgtctttggcgaaccatcaaaggcacagtgaacgaacatacaatcataccgaccaagatactggatttactaactctgcttccacttcaggatcctcagcagctctgaaatatacacctgaaatttcacggactcttgaaaaaaattgcagcgttaatgagatgtacgtatctgaaaacaatgaatctgtgagggaagatgataaacctgatctacaccctgacgtaacatttggtagaaataagattgaaggtgaaaaagaaggaaatgattcgagttatagccgggcgtattataccctccaaaatacagaatatcaaattcctagtagattttcgttcttccgctctgaatctgatgaaactgtgcatgctagtgatatcccttctttgatatccgagggacagacgttttatgagttattcaagggaggcgatccaacgtggtggttggattgcagttgtccaactgatgatgaaatgcgttgcatagcaaaaacatttggaatccatcctttgaccgcggaagatatcaggatgcaagaaacgcgtgaaaaggtagagcttttcaaatcctattactttgtctgtttccatacatttgaaaatgataaagaatcggagaattatcttgaacctataaatgtttacatcgttgtttttaggtcaggtgtcttgacttttcattttgacccaatatcacactgtgccaatgtaagaagacgtgtaagacaattacgtgactatgtcagtgtcaattcagattggttatgttatgctttaatcgatgatatcacagatagttttgctccggttattcaatccatcgagtatgaagctgattcgattgatgattcagtgtttatgacccgtgatatggattttgcagccatgttacaaaggattggtgaaagtaggcgtaagacaatgacgctgatgagactcttgagcggtaaagcagatgttatcaaaatgttcgccaaaagatgtcaagatgaaactaatggtattgggccagtgcttaaatctcaaactaacatggtgaacttacaagcggaacaagagaatgtgaaccagaataatagtaataaccaaataagcttatcaaatagctatatgcaaacaacatcacaaccaaggggagatattgctttatacttaggtgatattcaggatcatttgttgacgatgtttcaaaatttattggcgtacgaaaagattttttctagatcacatgcaaactacctggcccaattacaagtggaatcatttaactctaataataaagttacagaaatgttgggtaaagttactatgttaggtacaatgttagttccattaaatgttattactggtctgttcggtatgaatgtaaaagttccaggaagaaatggaagtattgcgtggtggtatggaattttgggggtactgcttttactagctgtcataagctggtttttagctagctattggatcaaaaaaatagacccacctgcaacgctcaacgaagccgcaggtagtggggccaaatcagtcatatctagttttttaccgaaaagagataaaagatttaacgatgattctaaaaatggcaatgcgagagttggcgttcgaaggaaatcaactgtcagtctacccagtagatatagccgttacaattaa

SEQ ID NO: 5001 - DNA, 2580 bp, Saccharomyces cerevisiae
atgacttataaatacaattgctgtgatgatggatcaggaaccaccgttggttcagtggtacgatttgataacgtcaccttgttaatcgatcccggttggaatccatctaaagtatcgtatgagcaatgcatcaagtactgggaaaaagtgataccggaaattgatgtaataatactatcacaaccaacaattgaatgtttaggtgctcattcccttctgtactataattttacctcgcatttcatatccagaattcaagtttacgcaactcttcctgttatcaacttagggagagtttccaccatagattcatatgcatctgcaggtgttataggtccatatgacacaaataaactcgatcttgaagatattgagatatcttttgatcatattgtacctttgaagtactcgcaattggtagatctacgatcaagatacgatggattgactttactggcgtacaatgctggtgtgtgtccaggtggttctatttggtgcattagcacatactcagagaaattggtttatgcaaagcgatggaaccacactagagataacatactaaatgctgcttctatattggacgccactggtaagcccttatcaactttgatgaggccctctgcaataattactactttggacaggtttggctcctctcaaccgtttaaaaaacgttcaaaaatctttaaagatacattaaagaaaggtttgagttcggatgggtccgttataataccggtagatatgagtggcaaatttctggacctgttcacacaagttcatgagttattatttgaaagcacaaagatcaatgcgcacacacaagtacctgtacttattctgtcttacgcgagaggaagaactctaacatatgccaaatcaatgctcgagtggctgtccccttcactacttaagacatgggaaaacagaaataatacttctccatttgaaattggatcacggatcaaaatcatcgcaccaaacgaattgagtaaatatcctggttcaaagatttgcttcgtatctgaggtaggagctttgattaatgaagtgataattaaagttggtaattctgagaagacaaccttgattttgaccaagccgagctttgaatgtgcgtcgtctttagacaagatactagaaattgttgaacaagatgaaagaaattggaaaacatttcctgaagatggtaaatcattcctctgcgataattacatttcaatagacaccataaaagaagaacccttgagtaaagaggaaacagaggcgtttaaagtacagcttaaagaaaagaaaagggacagaaataagaaaattctactggtgaaaagagagtctaagaaactggctaacggcaacgcaatcatagatgataccaacggagagagggcaatgagaaatcaagacattttagtggaaaacgtcaatggagtaccaccgattgatcatattatggggggtgacgaagatgatgatgaagaggaagaaaacgacaatttgttgaatttactcaaggataactctgagaaatcagcagcgaaaaaaaatacggaagttcctgtagacattataattcaaccaagtgccgcttcaaaacataaaatgttcccatttaaccccgctaaaatcaagaaagatgattatggtactgttgtagattttacgatgtttttacctgatgattctgacaatgttaatcaaaatagcaggaaaagacctctcaaagacggtgctaaaaccacgagccctgtaaacgaagaagataacaaaaatgaagaagaagatggttataatatgagtgatccaattagcaaaaggagcaaacaccgtgcttctcgttactcgggattttctggaaccggagaagcagaaaattttgataaccttgactatttaaagatagacaaaacgctctccaaaagaacaatctcaactgtaaatgtccaattgaaatgctccgtagtaatcctaaatttacagagtttagttgatcaaaggtctgcatctattatatggccatcgctaaaatctagaaaaatagttctttccgcccccaaacagattcaaaatgaagaaattacggcaaaacttatcaagaaaaatattgaagtggtcaacatgccattaaataagatagtggaattcagtacaacaataaagaccctggatatctccattgactccaacctcgataaccttttgaaatggcaacgtatcagtgatagttatacagttgccactgtcgttggcaggctggttaaggagagcctaccgcaagtgaacaatcatcaaaaaacagcgtcaaggagtaaactagtcttgaaaccattacacggttcatctaggagccataaaacaggtgcgttgtcaatcggtgacgttaggttagcacaattaaagaaacttctcacagagaaaaactacattgcagaatttaaaggggaaggtacacttgtcataaatgaaaaagtagcagtccgcaaaatcaatgatgcagaaactattatcgatggtacgccttccgaactttttgatactgtcaaaaaattggttacggatatgttagcaaaaatctag

SEQ ID NO: 5002 - DNA, 2580 bp, Saccharomyces cerevisiae
atgccaaagtggataagatcaacattgaatcatattataccaagaaggccatttatctgtagtttcaacagttttcttttactcaaaaacgtatcgcacgccaaactatcgttttctatgagtagtcgtggtttcaggtctaataactttattcaagcacaattgaagcatccttccatactttcaaaagaagacctagatttgctctctgattcggatgattgggaagaacctgattgcatacagttagaaactgagaagcaagaaaagaaaattatcactgacatacataaagaagacccggtggacaaaaagcctatgagggataaaaatgtcatgaattttatcaataaagacagtcctttatcctggaacgatatgtttaaacccagtataatacaaccaccgcagttaatttctgaaaactcatttgaccagagcagtcaaaaaaaatcgagatcgacaggattcaagaatccattaagaccagcgttgaaaaaggaaagttcttttgatgaacttcaaaataattctatatctcaagagagaagtttggaaatgataaatgaaaacgaaaagaagaaaatgcaatttggagaaaagattgctgttttgacgcaaagacctagcttcactgaattgcagaatgaccaagatgacagtaacttgaatccccataatggtgtgaaagtcaagataccgatttgcttaagcaaagaacaagaaagtatcatcaagttggcagaaaatggccacaacattttttatacagggagtgccggtaccggtaaatccattcttttacgtgaaatgataaaagttttaaaaggcatatatggtagggagaatgttgcagtcactgcttccacgggtttagctgcttgtaatatcggtggtataaccatacactcgttcgctggtataggattaggaaaaggtgatgcggataaactctataaaaaagttcgtaggtctcgaaagcacctaaggcgctgggaaaatattggtgctttggttgtcgatgaaatatcaatgttagacgcagaactgcttgataaactcgatttcatagctagaaaaatacggaaaaatcatcaacccttcggtggaattcaactcatcttctgtggcgattttttccagttaccgccagtatcaaaagatcctaatagaccaactaagtttgctttcgaatccaaggcttggaaagaaggtgtaaagatgacgattatgctacaaaaggtttttagacagcgaggcgatgttaagttcattgacatgttgaatcggatgagactaggcaatattgatgatgaaacagaaagagagttcaagaagctttctagaccattgccagacgatgaaattattcccgcggaactttatagtaccagaatggaagtagaaagggccaataattcaaggctaagtaaattgccaggccaggtgcatatttttaatgcaatcgatggcggtgctttggaagacgaagagttaaaggaaaggctgttacaaaattttttagctccaaaggaattacatttgaaagttggcgctcaggttatgatggtaaaaaatctagacgcaacattagttaatggatcccttggtaaagtcatcgaattcatggatccagaaacatatttttgctatgaggcgctaacaaacgatccatctatgcctccagaaaaactcgagacttgggcagaaaacccttcaaaactaaaagctgcaatggagagggagcaaagtgatggggaagaaagtgcggtagctagtcgcaaatcttcagtgaaggagggatttgctaagagtgatataggtgagccggtctctcccctagattcctcagtttttgacttcatgaagagagtcaagacagatgacgaagttgtgctggaaaatataaaacgcaaggaacaactgatgcagaccatacatcaaaactctgcaggaaaacgaaggttacctctcgtgagattcaaagcttctgatatgagtacgaggatggtgcttgtcgagccggaggattgggcgatagaagacgaaaatgaaaagccactggtatcaagggttcaattaccgctaatgcttgcctggtcactatccattcacaaatctcagggtcagacacttccaaaagttaaagtggatttacgtagagtattcgaaaagggtcaggcgtacgttgccctttctagagctgtttcaagagaaggactacaggtgttaaattttgacagaactaggatcaaagcacatcaaaaggtaattgatttttatcttactttatcttcagccgaaagtgcctataagcaacttgaggcagatgagcaagtgaaaaaaaggaagttagactacgcaccaggccctaaatataaggctaaatccaagtcaaagtcaaattctccagcacccatatcagcgaccacacaatctaataatggtatcgcagcgatgttgcaaagacacagtaggaagagatttcagttgaaaaaagagtctaatagtaatcaagttcattcattggtttccgacgaacctcgtggtcaggataccgaagaccacatcttagaataa

SEQ ID NO: 5003 - DNA, 2580 bp, Saccharomyces cerevisiae
atgtcacgtaagagctcgactgaatatgtgcataatcaggaggatgctgatatcgaagtatttgaatcagaataccgcacatatagggaatctgaggcggcagaaaacagagacggacttcacaatggtgatgaggaaaattggaaggttaatagtagtaagcagaaatttggggtaacgaaaaatgagctatcagatgtcctgtacgattccattccagcgtatgaagagagcacagtcactttgaaggagtactatgatcattctatcaaaaacaatctaactgcgaaatcggcaggaagttacctcgtatctctttttcctattataaaatggtttcctcattataactttacgtggggctatgctgatttagtggcaggaattacagttggctgcgtactcgtgccccaatctatgtcatacgcacaaatcgctagtttatctcctgaatatggtttgtattcctcctttattggtgcgtttatatattctttgtttgccacatcgaaagatgtttgtattggtccggtcgctgtaatgtcactacaaactgccaaagtcattgctgaagttctaaaaaaatatcccgaagaccagacagaagttacagctcctatcattgcaactaccctttgtttgctttgtgggattgtcgccactgggttgggtatactgcgtttaggctttttagtggaacttatttctctaaatgctgttgctggcttcatgaccggttccgcatttaacatcatctggggtcaaattccggctctcatgggatacaactcattagtgaataccagagaagcaacgtataaggttgtaattaacactctgaaacatttaccaaacacaaagttagacgccgtttttggcttgattccgttggtaatcctctatgtatggaaatggtggtgtggtacatttggtataactttggcagatagatattatcgaaatcaaccaaaggtagcaaatagactgaaatccttctatttctatgcacaagctatgagaaatgccgtcgtcatagtagtttttactgccatatcgtggagcataacaagaaacaaatcttcaaaagaccgtccaatcagtattctgggtacagttccctcgggcttaaatgaggtgggagttatgaaaatcccagacggtctgctatctaatatgagttcagaaatacctgcttcaattatcgttctggtgttagaacacatcgctatttcaaaatcctttggtagaattaacgactacaaggttgtccctgaccaagaacttattgcgattggtgtgacaaatttgatagggacattttttcactcatatccagcaactgggtcattttccagatctgctttgaaagcaaaatgtaacgtgcgcactccgttttctggggtattcactggcggttgcgttctattagcactttattgtttaactgacgccttctttttcattcctaaagcgacactatcggcggttattattcatgctgtttctgatttgctgacttcttacaaaaccacctggaccttctggaagaccaacccgttagattgtatctcatttatcgttacagtgttcatcacagtattttcatccattgaaaatggtatatattttgcaatgtgttggtcatgtgcaatgttactattgaaacaggctttccctgctggtaaattccttggtcgtgttgaggtggcagaagtattgaacccaacagtacaagaggatattgatgctgtgatatcatctaatgaattacctaatgaactgaataaacaggttaagtctactgttgaggttttaccagccccagagtataagtttagcgtaaagtgggttccgttcgatcatggatactcaagagaattgaatatcaataccacagttcggcctcctccaccaggtgtcatagtctatcgtttgggtgatagctttacttacgtgaactgctcaaggcattatgacattatatttgatcgtattaaggaagaaacaaggcgaggccaacttataaccttaaggaaaaagtcagaccgtccatggaatgatcctggtgaatggaaaatgccagattctttgaaatcactatttaaatttaaacgtcattcagcaacaacgaatagtgacctaccgatatcgaatggaagcagtaacggagaaacatatgaaaagccgctactgaaagtcgtctgcctggatttttcccaagttgctcaagtggattcaaccgctgttcaaagcctggttgatctgagaaaagctgtgaataggtatgcggatagacaagtcgaattccattttgccggaattatatctccatggatcaaaagaagtcttttgagtgttaaattcggaactacaaatgaggaatatagtgacgactctattatcgctggccattctagttttcacgttgcaaaagttttgaaggatgatgtggattatactgatgaagacagccgtataagcacatcttacagtaactatgaaacattatgtgctgcaactgggacaaatttaccgttttttcatatcgatatacccgatttttctaaatgggacgtttag

SEQ ID NO: 5004 - DNA, 2580 bp, Saccharomyces cerevisiae
atgtcagcatacatcgcaatgaaaggagtaataacaaacgtcgatgagaacataagaaatgatgaagatgtggcttttgagtacgaaatacaaaagacaccgcagaacatacttacatggaaaagatatatcgagtattggaaagaggagggaagaactgacaaacagattaggtggctatatgaaagattttgttcacaatttgtaacagatacaagtatatgggaagattatatacgctgggaatcaacaaaggaagtagtcgaaacttcacgtattttctggctttttcaaaggtgcctgaaaagctgtgtacgagattgtgacaggatatgtttgtcttatttagaattggcaattgaacaatatgacttggcaatgataaggcatgccttagcttcatctttaatgaaaatggagagagaaatgcatcggaaagtttgggatcctgtcataaaatttgtggaagaaaaagttttaccattaacgcaactggattcaactcaagaagatgaagaagaaagtactgatgaagctgaattgataaatgtacttttagtgaagggtttcacgaagggaggttttattagcgaggaaattagtgaaaacggaagtagaggtgatatttggtcgtcacatattttagaaagatacttaaaagtggctcctcagcaaaaacgaaatgaatcgctggcaactcttgcattaactagagacaatattaccatcaaatcagtatatgaaaagtatttgccacaagatgaaaatagtgggaagtatctacctagttcagaactgccttttgaattaaatttcaattatttggccagcctagaaaaactaggtttagataatcaatatgaggagttcatgaggcaaatgaatggcatatatcccgacaaatggctttttttgatcctatcacttgccaaatattatatctctcgcgggaggcttgacagttgtggtgatttattgaagaaaagtttacagcaaacacttaggtacagtgattttgatcgcatctataatttctatttgctatttgagcaagagtgctcccaatttattctgggaaagctaaaggaaaatgacagcaaattctttaatcaaaaagattggactgaaaagttacaagctcatatggcgacatttgaatctttaatcaacttatatgatatctatttgaacgatgtcgcactaaggcaagattccaacttggtggaaacgtggatgaaaagagtgtccttgcagaagtcagcagcggaaaagtgtaatgtgtattcagaagctatactgaaaattgatccccgaaaagttggtacgcctggctctttcggtaggctttggtgttcgtatggggatttgtattggagatcaaacgcaattagtacagctagagaattgtggacacaatctctgaaggtaccgtatccttatatagaagatctggaagaaatttacctaaactgggctgatagagaattagataaagaaggggtggaaagagctttttctatccttgaagatgcattacatgtgccaacaaatccagaaattctcctcgaaaaatataagaatggacacagaaaaatacctgctcaaactgttctattcaactcattacgtatttggtccaaatacattgattatctagaggcttactgcccaaaggatgcaaattcctccgataaaatattcaataagacaaaaatggcatacaatactgttattgatttgagattgatcactccagcaatggcagaaaattttgcattgttcttacaaaatcattacgaagtcatggaaagttttcaggtgtatgagaaaacaatccctctgtttccccccgaaatccaatacgaattatggattgagtatctagaagtagcgacatcacatcaattgtcatcactgagtcctgaacatattagatttttgtttgagaaagcacttaagaatctatgttcaaatggtatagactgtaaaacaatttttatcgcttatagcgtatttgaagaaaggataagtggtctgattagcaagagtattgagatattacgtagaggtgctgtaataggtactgttagtgtgagcacgcacctcgaaagtagactgcaactgtggagaatgtgtatttccaaggccgagtctactttgggaccatcagtaaccagagagttgtaccaagaatgcattcaaattttaccaaactctaaagctgttgagtttgtgattaaattttcagatttcgagagctctataggagaaactattcgagcacgtgaaatccttgcctatggtgcaaagcttcttcctccatccagaaatactgaattatgggatagctttgaaatttttgagttaaaacatggggataaggaaacttacaaagacatgttgaagatgaagaaggtgttggaatccaacatgctcattgattcagctagcgttagccatgaggaaggtaacattaacttcgtggcggcagcaacctcgcatgctcccaactcgcatactcttacccaatcaacctcttcatattcgattaatccagatgaaatagaactagatatttga

SEQ ID NO: 5005 - DNA, 2580 bp, Saccharomyces cerevisiae
atgtcatcatcctcaagttcatcagagtcatcgcctaatttatcgcggtcaaactcactggctaacacgatggtttccatgaaaacagaagaccatacgggattgtacgaccataggcagcaccctgactcactgccggtccgtcaccaacctccaacattgaagaacaaggaaattgctaagtccactaaaccttctattcctaaggagcagaagagtgcaacgagatacaacagccatgtggatgtgggaagcgtacccagtaggggccgcatggattttgaagatgaagggcagggtatggatgaaacggttgctcatcatcaattgagggcatctgccattttaacttctaacgcgaggccttccagactagcccactccatgccacatcaaaggcagctttatgtggaaagtaatatacacacaccaccaaaggatgtaggtgtaaagagagactatactatgtcatcttctactgcatcatcaggtaacaaatccaagctgagcgcatcttcctcggcaagtcctattacgaaggttagaaaatcttcgctggtcagtcctgttcttgagatcccacacgaatcgaaatctgatacacactccaagctggctaaacccaagaagaggacatattctaccacatctgcgcattcatctatcaatcccgcagttttactgacgaaaagcacatcccaaaaatcggatgcagatgatgatacattggaaagaaaaccagtacgtatgaatactagagcttcttttgatagtgacgtatcacaggcgtcgagagattctcaagagacggaagaagatgtttgtttccctatgccaccacaattgcataccagagttaacggtatagatttcgatgaactggaagagtacgctcagtttgcaaacgcggagaagagtcaatttttggcaagtctgcaagtgcccaacgaacagaagtacagtaacgtttctcaggatatcgggtttaccagctctacttccacttcgggatcatcagctgccctaaaatatacaccaagagtttcgcagactggtgaaaagagcgagagtaccaatgaaacagaaatccatgaaaagaaggaagacgagcatgagaaaatcaagcctagtttacaccctggtatatctttcggtaaaaataaagttgaaggggaagagaatgaaaacattccatccaatgacccggcgtattgctcttaccagggtacagactttcaaattcctaatagattttcttttttctgttccgaatctgatgaaaccgttcatgctagtgatatcccttccttagtgtctgagggacaaacattctatgaattattcaggggaggtgagccaacatggtggttagattgtagttgtccaactgatgatgaaatgcgttgcatagcaaaggcgtttggtatccatccattgactgcagaagatatcagaatgcaagaaacacgtgaaaaggtggaacttttcaaatcgtattacttcgtttgtttccatacctttgaaaatgataaagaatcagaggatttcctggaacctattaacgtttacattgttgtctgtaggtcaggtgttttaacattccattttggcccaatatctcattgtgctaatgtcagaaggcgtgtaagacagttacgtgactatgtcaatgtcaattcagattggttatgttatgctttaatcgatgacattactgatagtttcgctcctgtaattcaatctattgaatatgaagcagatgcaatcgaagattctgtgttcatggctcgtgacatggattttgcagcaatgttacaaagaattggtgaaagtaggcgtaagacaatgacgttgatgagacttcttagtggtaaggctgatgttatcaaaatgtttgccaaaagatgccaagatgaagctaatggtattggaccggcactaacatctcaaataaatattgctaacttacaggcaaggcaggataacgccagtcatatcaaaaataatagttcgacaactgtaccaaataattatgcgcccaccacatcacaaccgaggggggatatcgccctatacttgggtgatattcaagatcatttgttgacaatgtttcaaaatttgctggcgtacgaaaaaattttttctagatcccatacaaactacttagctcaactgcaagtggaatcatttaattctaataataaagtgacagaaatgttgggtaaagtcaccatgataggtacaatgctagttccattaaatgttatcactggtcttttcggtatgaatgttaaagttccgggggagaattccagtatcgcgtggtggtttgggatattgggtgtgctgcttttgctggccgtccttggttggttcttggccagctattggattaaaagaatagaccctcctgcaacacttaacgaggccgctgaaagtggagccaaatcggttatttcgagcttcttgccaaaaagaaacaagagattcaatgatcgttccaaaaatataaatgtaagagccggtccttcaaacaaatcagttgcaagtcttcctagtagatatagccgctacgactga

SEQ ID NO: 5006 - DNA, 2583 bp, Saccharomyces cerevisiae
atgaacactgcattggatgatttacatggggatttggtgactttagaagataacgaaatcatcaataattctgatcattcatcttctcactctactagtcatgaggaggaagacgaggaagaagacgatactgaggatatagaacttatagaaaaagacggcaataaaatcctatcaagtagaattcatccggaagacgaaatcataaatgatgggttaaatatatggattccggttcaaatgctcaagaagaatatagcaaagttctggtcccattttctagcaattgaaaagaaattaacgaaagttaaatgtaaacattgtggagagatactaacaagaagcgatgcaagtttgacaaaaacctttagatctcacttgaaaacaaagcataatataagtgccaataaaaacttctattccatgaatttcacagtaggagactccaatctcaaaaacaatacttccagcacagaaattacacgtagacacggctatgattcgttaaccttcaattccgaccaaagtttcaaatgctttgacataggaaaattacagagcagtaattacctttctatttcccaattagtagccatagtcatagcctcagaaaatttaccgctgaacttctttgagaatgtgtcctttaaatctcttttatcaaaatttcataggatccctcctttaactaccaatataatagaggagtcaattatagggttgtcaaaatcaattgatgagttgatcagaaggtctatatcaaggaatgatacacaattaccctttactatccatttatccgatagtaaggaatcaaatcaacctctttacttgaaatattctagggaaattcgggcacaattgtctaacttggacttatcccatcttatttctgtaaattttacagaactggctggaaaaagatcattattttctttgcaactgttcgataataccaacaaagtttcgaagggtttaccattatctatttttgtacgtaaaacaacggatatagatattagtgtctggcaggaacagctcaacaatttgtattcgaaataccctggcttacaaaaatcggtgatttctataactttgcctcaaagccattatacaatggtactagagaatagaaacagtcataattttactttccatagcgggagtgtgagggagataaagtaccatacttgcatagtatctgaattacttcattgttttttacagccgttgtttaatgttcctactgaatcaatgctgtcttccttttctgtggccaaagaaaatcattcaggaggctctttgttagactcattaatagatttttcccatattgatttatcatctactattctcggcaaaatatgctgtttgatagaagaagttaacttaaacgactccctaaaatcggatttcctattatactgccaaaattatacacaacctaactgcaatgaacttacttcaatcctttcctgtaactgcgatagattttcagctttgaagagtatcttagaaaaatttgcaaacttagttcctttcttcaagtctatcaactctcatttagaaaatgaatcacttagtgaatccgattttcgtctaataaacacggtagaagagacgttaagaactttcgagcaatcaattgagtactttgcttcttccgctccattgaaatttacccataccttggtttttatcattaagtttgagttatatttgacagagattatacgaagcttcaaattcaccaaatctaaaaagccctttgaaaaaatcctagcaaggcttctaaaagttaaagacctttatttacttgatgatgtaaacttgattggtgctttcctgtatccatcaatcttccaaagtaaaagccttctaaatgaaatctttggcacaacatcggtaaataaaatagttcataacatgaccaaaattgttctaaggtatcttaaaaactttatcaatataactaattttcgttcctctaatagtggtggggagagcggtcggaattccggtaataatcttctttctgactacgaggccatttttatgaaagaatcacgggacgtagagcttttatgtaacaccaagttaaccgcaccactaacagaagattcattacttgtccaaatcattcgggatgatctattacgctatgtcaacagaattgcgcatgagctgcctaatgcataccatgactacttaaatgataatgatattagcttcgatggatctcactttacaaaacatgagttatctgaggaaaacgactctaactcgggggaatggtgcctaaatcccatggaagagacatttgatattcatattcctatctcggattcaatttggaataattacataagcagtaaaaacaagattgaagtaatcgatattttacttcagttgctttcagtaaattcgacatcttcaatacggtcagaattatcttctctaacagctaatcaagacttcagtaccaagttgagtgaggaaacaattaaaatcaaacttttgaattcacagtttaatctcgaaaaaattaattttcactctggatcaattttcgatgcttgctag

SEQ ID NO: 5007 - DNA, 2586 bp, Saccharomyces cerevisiae
atggaagggcaaaaatcgaatgcatcatgggagagctcgatcatcgagggccaattgtctaaaaatctagcaaggtacaccttgttattagacaaattatcgacactatctcaaatagacaagctgtctgaagtgatagccaatgattacgcaaaacaatctaaacaattaaatgcatttgtgcaacagtcgcaatcatcgctcaacaaagagtcccggaaattagaattgcaaagaactaaccttacgactactttgactcagtttcatgagactgtggccaccatttcttcttcgaacgcaagagcaaaagctatacatgacgatattgaaactgtagatcaggaacgcgctttggtcaacaaaacgttacaatttgtaaaagacgtcaggacgctaaagaataatatttcactggcgcattctgctttagaaacaaaggattacttagttgctgcgacagcaatcaatgaaattagaagccttccggataaaaaacttattgtatccgagtttgccaagaaagttgtgccctcgagtgaaattcccgaagaaccagctatactaataaagaattggtgtaaggaactgacaagtttatttcaggagcaattcatggaagcaacaagaacacaggatattaaagagctaaccttaatgttcaaaatgttccctatgattgggcaggacgtacttggtttagacctgtattccaaatatgtctgtgatattattgcggacgaaagcaggaaaattatgtcgaattctatggaaaacagcaccaagtttcaaggatttttttcacaagtactgttacatctttttaaaattgtatcgaccattataaatgatcattcaaaagtcatcgccacgtgttatggaaaaaagcacatggtgcatgtcatggaaaaagtagaaaaagaagctgatcttcaagctagtttgattctagatatttttatggagacgaggaaaatagaaaggactatacatgatataaatgaatgggaacattcacaaaagaatgaagatgtgaatatagacagtaatcagtcggatatcgaaacagacggagaaacggaaaagagctcaattatatccattcatgacttggcattattgataatggaattttctcaaatacttcaaaattggtccatgtattctagattttattcagttaaatggaatgaatttagcgatttgcatccgcatgtattgcaaccacctccaccaatagcagatggtaaatttgccttaaagttaaagcaagataaggtctttgatgagtttcaggtgtttgtgttgaaccatctgcagagatcatttagaaatagtatttcactagaagaattaccgtcactgaacgatcttataactgctgttcccctcaatgaccacgataacatttcataccctgtaacatctgttttagatgacttaattttattagttcggaaaaatctgatatcagtggttaatactggccagtttaagctcttagcaagttttttgaacgagttggtaaaattttttcagaaccgatttctggtaaaatttatgcaaaacaaatttaagttactacaatcgaaactagcctccaatgtatctttgaaaagatacattccaaaaggtgaggagcaatctgcaacatcaagatcggtttctccacctgcaaataagttttctccgctaagcaggttcacttttagaggggcagcagctagcgctttgacaaatattcaatcaaatttacaagccgtagttgcagaggacgaggattccattcttgcgttgcaccattatttgatatatctgaacacgttgtacttgagtaaagtatacgttcacaggctgttatccatagaaatattagaagacgattcgcaaaggattttgagagacaatttcccttttgacaatgatgcagcgcagttacagaatttaattataaactcagaaaaattagtcctggaacaaacagataagctaagcaaatgggctgtcaaatacttgttccaaaatatcctacaaaatagggttcggaacttattgggaactgtttttgttaattcagcctcatcaaattcctcaacgtccaatcaaaaaaatgtgtctcgcgattattctgcaggttcgaaccaaaagaattacatcacaagcatagaagatttcgaagatttgtcgcaaattaacagtttcaatagcaaatggaaccaattgattatcccttacaaaaatattcttcacaacgaagcatatgcagagttgctatctgtcatagtcgactacatcgtaacaacattggagcaaagaatatggactctagaattcaatgaacttggtgttacgaaattagatagagaactgagccttttcatcggcaatatgtgtggcttgaactataatctcagagagaagttcttgaaattgacacaaatcgtgttgcttctcggtttagatgatgacaattttgatttgactacaggtgatatcaaggatgacttcaatggtactttcgattgggtgataaactctcaggaaagaattaaagctagaaatatgaagattgatagaacacagtaa

SEQ ID NO: 5008 - DNA, 2586 bp, Saccharomyces cerevisiae
atggacaaaaaggaatattcggagactttctatcatccttataagccctatgatattcaggtacagttaatggaaactgtatacagagtgctatccgaagggaagaaaatagctatcctggaaagccccactgggacaggcaagacgctgtccttaatctgtgccacgatgacttggttgagaatgaataaagcagatattttcacccgcatggaaactaacatcaaaacgaatgaagatgatagtgaaaacctaagcgatgacgagccagactgggttattgacacttatcgaaagtctgttttacaagaaaaggtggatttgctaaatgattatgagaagcatttaaacgaaattaacacgaccagttgtaagcagttgaaaactatgtgtgatttagataaagaacatggaagatataaatcagttgatccattaagaaagaaacgcaaaggcgctaggcaccttgatgtatcacttgaagaacaagattttattccgcgcccgtacgaatcagattctgaaaacaatgatacctccaaaagcacaagaggaggaagaatatctgataaagattacaaattgagtgaactaaattcacaaataataacacttttagacaaaattgatgggaaggtttcgagagatccaaacaatggcgatcgctttgacgttacaaatcaaaatccagtgaaaatatattatgcatccagaacttattcacaattaggtcaatttacttctcagttaagattaccctcgttcccatcatcctttagggataaggtcccagatgaaaaggtgaagtacttaccacttgcttcgaaaaagcagctttgtattaatccaaaagtgatgaagtggaaaacattggaagctattaatgacgcatgtgcggaccttagacatagtaaagagggatgtatcttttatcaaaatacaaacgaatggcgtcattgtcctgatacgttagctctcagagatatgattttttcagaaattcaagatattgaagatttagttcccctgggaaaatctttgggaatttgtccctattacgcctcgagggaggcacttcctattgcggaggtagtgactttgccatatcaatacttactttctgagtccacccgttcaagtcttcaaataaaccttgaaaattctatagtaattattgatgaggctcataatttgatagaaacaataaattctatatattcctctcagatctcgttggaggacttaaagaattgccataaggggatagtaacttatttcaacaaatttaagtccaggctcaatcccggtaacagagtaaatctattaaagctcaattcacttttgatgactctgattcaatttatagttaaaaatttcaagaagataggacaagaaatagatcctaacgatatgttcacaggaagtaacatcgataccctaaacattcataaactattgagatatataaaagtctccaaaattgcttacaaaattgacacgtataaccaggcactaaaagaggaagaatcgtcaaaaaatgaaaatccaataaaagaaacgcataaaaaatcagtttcttctcagccattacttttcaaggtttctcaattcctatattgtttgacaaatttgacgtcagaaggacaatttttttttgagaaaaattattcaataaagtacatgcttctagaaccaagtaaaccttttgagtcaatactaaatcaagcaaaatgtgtagtccttgcaggtgggacaatggaacccatgtcagagtttttgtcgaatttgctacctgaagttccttctgaagacattacgaccttgtcgtgcaatcatgttataccgaaagagaatttgcaaacttatatcacaaaccagcctgagcttgagttcacattcgaaaaaagaatgtctccctcccttgtaaataatcatctttttcaattttttgttgatctgagcaaagcagttcctaaaaagggtggtattgtagctttttttccaagctatcagtatttggcgcatgtaattcagtgctggaaacagaatgacaggtttgctacattaaataacgtgaggaaaatattctatgaagcaaaagacggcgatgatattctatctggatattctgattcggtagcagagggaagggggtctcttttgctggctattgttgggggaaaattatcagagggaataaattttcaagatgatttatgtagggctgtggtgatggtgggcctgccgttcccaaatatttttagtggagaactaatagttaaaaggaagcatttggccgctaaaataatgaagtcaggcggaacggaagaggaagcttcacgagcaacaaaggagtttatggagaatatttgtatgaaagctgtcaaccaaagtgttggacgtgctatacggcatgcaaatgattacgcaaacatttacttgctcgatgtgcgatataataggcccaatttccggaaaaaattgtcacgttgggtgcaagattctatcaattccgaacatacaacacatcaggtcatttcttcaacacggaagtttttttcaatgcgcagcctgaattcacgctaa

SEQ ID NO: 5009 - DNA, 2586 bp, Saccharomyces cerevisiae
atggtcaatatttctgatttctttggtaaaaataagaaatccgtaagatcgtcaacatccagacctacgagacaggtgggttcgtctaaaccagaagttatcgacttagatactgaatctgaccaagaatcaaccaataaaacaccaaagaagatgcctgtaagtaatgtaattgatgtatcagagacacctgaaggagaaaaaaagctacctcttcccgctaagaggaaggcctcttcaccaactgtaaagccagcaagttcaaaaaaaaccaaaccctcctctaaaagttcagactcggcttcgaatattacggctcaagatgtactagataagattccatccttggatctgtcaaatgttcatgtgaaagagaatgctaaatttgatttcaaaagcgcaaattcaaatgcggatccagatgaaattgtttctgaaataggtagttttccagaaggaaagccaaattgtttattaggtctaacaattgtcttcacaggtgttctgccaaccttggagcgtggtgcatcggaagctttagcgaaaagatacggagcaagggttactaaatcaatttcaagcaaaacttctgtagtagtcttaggtgatgaagcagggccaaagaaactagaaaaaatcaagcaattgaaaatcaaagccatagacgaagaaggctttaagcaattaattgctgggatgcctgctgaaggtggtgacggggaagctgccgaaaaagcacgtcgaaaattagaagaacagcataatattgctaccaaagaagcagaattgcttgttaagaaagaagaggaaaggtcgaagaagcttgcagccactagagtttctggtggccatctggagagagacaatgtggttagggaagaagataaattgtggacagtaaagtacgcaccaacgaatctacaacaggtctgtggtaacaaaggaagtgtaatgaaattaaaaaactggttggctaattgggaaaattcaaagaaaaatagttttaaacatgctggtaaagatggctctggtgttttcagggctgcaatgttatacggtcctcctggtattgggaagacaactgctgctcatttagttgcacaagagcttgggtatgacattcttgaacaaaacgcttctgatgttcgctctaaaactttacttaatgccggtgttaaaaacgctcttgataacatgtctgtagtgggatatttcaaacacaacgaagaagctcaaaatttgaacgggaaacattttgtcattatcatggatgaagttgatggtatgagcggaggcgatagggggggagttggccagctggcacagttttgtcgtaagacgtcaactccattgattctaatttgtaatgaacgtaatttaccaaaaatgagaccattcgatagagtatgtcttgatatccaatttagaagacctgatgctaacagtatcaaatcaagattaatgacaattgcgatcagagaaaagttcaaacttgatccaaatgtcattgataggttgatacagactacaagaggtgatatccgccaggttattaatctactttcaacgatatctacgactactaaaaccataaaccatgaaaatatcaacgagatctcaaaggcatgggaaaagaatattgccctaaaaccctttgacattgcccataaaatgttggatggacaaatatactcagacataggttcaaggaactttacactgaatgataagatcgcattatattttgatgactttgatttcacacccctaatgattcaggaaaactatttatctacaagaccaagcgttttgaaacccggccagtcacatttggaagcagttgctgaggcggctaactgtatttcattaggtgatattgtcgaaaagaagattcgtagtagtgagcaattatggagtcttttgcctttgcatgctgttctttcatctgtttatccagcatcaaaagttgccggccatatggcgggaagaatcaatttcacagcttggttgggccaaaattctaaatctgccaaatattataggttactgcaagagatacattatcatacaagactaggtacatctactgataaaattggactaaggctggattacctaccaacttttagaaaaagattattggacccatttttgaagcaaggtgctgatgcaatttcatctgtcatagaggtaatggacgattactatttgaccaaagaagactgggattctattatggagtttttcgtaggtcctgatgtgaccacagccattatcaaaaagataccagctacggttaaaagtggattcacgcggaaatacaacagtatgacacatccagtcgcaatttacagaacaggtagtactattggtggtggtggtgttggcaccagtactagcacccccgatttcgaagatgtcgttgacgcagatgacaatccagttcccgcagatgatgaagaaacacaagatagtagcacagacttgaagaaggataaacttatcaagcagaaagccaaacctacgaagaggaagactgccaccagtaaacctggtggtagcaaaaaaaggaaaacgaaagcatga

SEQ ID NO: 5010 - DNA, 2586 bp, Saccharomyces cerevisiae
atgtccaccgctgaatttgctcaactattggagaacagtatcttaagtcccgaccaaaacattcggttgactagtgaaacgcaattaaagaaattatctaatgacaacttcttacaatttgcaggtctttcttcgcaagtgcttatcgatgaaaatacaaagctagaagggcgtattctagcggcgctaactttgaagaacgagctggtgtccaaggactcagtcaagacgcagcaatttgcacaacgttggattacacaggttagtccagaagctaaaaaccaaattaaaactaacgcgctgaccgcattggtctccatagaaccgcgtatagcaaatgcagcagctcaattgattgcggctatagcagatattgagttgccccatggcgcatggccagagttgatgaaaattatggttgacaatacaggtgcggaacaaccagaaaatgtcaagagagcctctttattggccttgggttatatgtgtgaaagtgcagaccctcaaagtcaagccttagtttcttcatcaaacaatatcttaatcgctattgtccagggtgcgcaatctacggaaacttccaaagcagtcagactggcagctctgaatgctcttgcagactctttaattttcatcaaaaataacatggaacgcgaaggtgaaagaaactaccttatgcaagtcgtctgtgaagccactcaagctgaagatatagaagttcaagcagctgcctttggttgtttgtgtaaaatcatgtcactatactatacatttatgaaaccttacatggagcaagccctatatgcattgaccatagctacaatgaaatctccaaatgataaagtagcttccatgactgtggaattctggtccactatttgtgaagaagaaatcgatattgcctatgagctcgctcaatttcctcaatctcctttacagagttataatttcgctctctcttctattaaagatgttgtccccaatttgttgaaccttctaacgagacaaaatgaagatccagaagatgacgattggaatgtttccatgtccgcaggtgcatgcttgcagttgtttgcccaaaactgtggcaatcatatcttagaacctgtattggaatttgttgaacaaaatattaccgctgacaactggaggaatcgtgaagctgctgtaatggcctttggttccattatggatggccctgataaggtccaaagaacctattacgttcaccaagccttaccatctattttgaatttaatgaacgatcaatccctacaagttaaggaaaccactgcttggtgtattggtagaattgctgattctgttgctgaatctatcgacccacaacagcatcttccaggtgtcgttcaagcttgtttaattgggttgcaagatcacccaaaagtggccacaaactgttcttggaccattatcaacttagtcgaacaattagcagaagccacaccatctccaatctataacttctatcccgctcttgtagatggtttgatcggtgctgcaaatagaattgataatgagttcaatgcccgtgcatccgccttttcagccttgacaacaatggttgaatacgccacggacacggtagctgaaacttccgcctccatttctacgtttgttatggacaaattagggcagacaatgagtgttgatgaaaatcaattaacgttagaagatgcgcaaagtttgcaagaattgcagtcaaatatattgactgttctagcagccgttattagaaaaagtccaagtagtgtagaaccggttgcagatatgcttatgggactgttcttcaggttgttggaaaaaaaggactctgcgtttattgaagacgatgtgttttatgctatttcagctctagctgcttctttgggtaaaggatttgagaaatacctggaaacattttctccctatttattaaaggctttaaatcaagtagattcgccagtttcaatcaccgcagtgggcttcatcgctgatatttcaaattcgttagaagaagatttcagaagatattccgatgctatgatgaatgtcttggctcaaatgatctctaatccaaatgcaaggagagagttgaaaccagccgtcttgagcgtgttcggtgatattgcttccaatataggtgctgattttattccctacttgaatgacatcatggcgttgtgtgttgctgcccaaaacacgaagccggaaaacggcacattagaagcccttgattatcaaataaaagtactagaagcagtactagatgcttatgtgggtatagtagcgggtcttcatgataaacctgaagctctgttcccttatgttggtactatattccagttcattgcacaagttgcagaagatcctcagctgtacagtgaggatgctacctcaagagcagcagtcggattgattggtgatatagcagcgatgtttccagacggctcaatcaaacaattttatggacaagactgggttattgattacattaaaagaactaggagtggccaattgttcagtcaagccacaaaagatacagcaagatgggctagagagcaacagaagcgtcaattatccttataa

SEQ ID NO: 5011 - DNA, 2589 bp, Saccharomyces cerevisiae
atgaacatggcaatccaaacaattaaatacattttttggctactgccgatattagggcttacacaagcacttctacaaaacccaggggacgattttccatttagcacagtaatagatatcctctcagaaaatgttgaattctcaacttttttaaggattattcagaaaactggtcacgtacagtacttaaatgagctacagaactttacactttttgctccgattaattcagcatttattaagggggaccaaaccacagaccaatttgaggagcatttccatattgaagatttccttattcatgatagggtattgcaagtgagagaccttgaaaacggtacctacctggagaaaagagctgcaaaagcacctttattgctgagaaagcatgagcgccattgctttgtcaatgaaattgctgttgtcgaacccgatttgctgcctagtttccagaatgcttcattacaaggtattaacaatcttttactaattcaacctcaaataaatgagttgctggtacaactagatgaagaaacccaagatttaaagatatttagtgattttatcagcagtttttcaaactataatgcatatacaaactcatccacagttttagtgcccttagatgttaattttcgaaaattcttcaatacaatcgaaataaactatctacttgacaaatataataaattgggtaaatctaatacaatttctcaggccaaatgggccgcagatagaacttcccttcttcaagaactcattattgatgacgtgtatggtggtattttacccaaggaactaattttagaaaataaaaacaatcgaaaactttttatgaagagtaattcagaaggtacatcagtaagtgtaaataattcagattactcacccatatcaaacagaatttttgaaataggcgtcgtgcatggattttctgacttagactttttacgaacgcatatacagtttgatgctgaaaagtacttgcacggtttgaactgctcagaattcgtaaaggagttatacttcagagaccttgaaaaattcattcaaaacggaaggaaaatcaccatatttgtaccacaagcctcttttaatgaggatcgtgggtacacaaaaccatcacttctgtaccattttgtagaaggtaaaattgaccttgaacaggacttttcctcattgcgcccgattcaatacgcacctacccaaatttatgactccgccttttgctcttcagctaaaagactaggtggacactgccaaaagttcaaaatcacaaggtctaataaaggttattacatcaatggtcgcttcaagattttaaacacaaaaccttatgagattggtaatacgtccatttattctattgacgatgatcttcaattaccgggcgacttagtgttgtcattagcaccagaaaaccactgttctatttccctaatgctcttgaaggaacttaaccttttggatctaccatcaaatcataaggggtacacgatacttcttccatgtatgaattcatgggacaataatgatttgactatagactatttgaggtcaaacaaaaccgccctaaatttacttatgaggaacctaatcttcgaagaccttatttattccaacaattatagtatttcgactactgtcaagaatttatacggaaattctgtatctattggcgtacaaaaaattgtgggaagccaaaaccttacgaaaatctcagtgagtactataaaggaaagtattattattgaggagagttccgatatatttttcaaccagggagttatccatcctatagaccaattggattttccagtcgatttggagatatccctaaaagagctgatagaaactactggaacaaaagaaatatttgacttttttaacttgttttatgacctttcttcaatcatttggaataacgaagagtactcgcttttagttccaacggcttcttctattccattaagtggcatcacggcgaactcgacaaacttaagaaaattcctcgaactccatttgattcctgctaatgtaacgcaaaacctactagactgcaatggctccattagcactaaactaggtacaaaactaaactgcagaaaagatcatctggacaacgtttttgttagcatacagggcgactggaccaaggaagttagagttcttaaaacaggatgcactactaatttgaaaagttcatgcatatttctgatcgacaaacccatatccttatcttggctaaacagcgagaaataccatctgcgcttgccagggatagcggttggatttggggttataataggtgttaccatagccatttctttattgttttgcataataattaccaggggtggaaaagtaaaagacaaaaatcaaagagggagaaatgatcgagcaacaacaccactgattcaacactctccgataatccacaacccttcttactcggcaacagcgcatttatcaccactttctcaacccacttttgaaggttcatattctgtgaacgctatacaaacccccagagatatacgaagggtgggatcagatcaaaagggcggtcgcagtgtcagtacctcataa

SEQ ID NO: 5012 - DNA, 2589 bp, Saccharomyces cerevisiae
atgcagtacgtaggcagagctcttgggtctgtgtctaaaacatggtcttctatcaatccggctacgctatcaggtgctatagatgtcattgtagtggagcatccagacggaaggctatcatgttctccctttcatgtgaggttcggcaaatttcaaattctaaagccatctcaaaagaaagtccaagtgtttataaatgagaaactgagtaatatgccaatgaaactgagtgattctggagaagcctatttcgttttcgagatgggtgaccaggtcactgatgtccctgacgaattgcttgtgtcgcccgtgatgagcgccacatcaagcccccctcaatcacctgaaacatccatcttagaaggaggaaccgagggtgaaggtgaaggtgaaaatgaaaataagaagaaggaaaagaaagtgctagaggaaccagattttttagatatcaatgacactggagattcaggcagtaaaaatagtgaaactacagggtcgctttctcctactgaatcctctacaacgacaccaccagattcagttgaagagaggaagcttgttgagcagcgtacaaagaactttcagcaaaaactaaacaaaaaactcactgaaatccatatacccagtaaacttgataacaatggcgacttactactagacactgaaggttacaagccaaacaagaatatgatgcatgacacagacatacaactgaagcagttgttaaaggacgaattcggtaatgattcagatatttccagttttatcaaggaggacaaaaatggcaacatcaagatcgtaaatccttacgagcaccttactgatttatctcctccaggtacgcctccaacaatggccacaagcggatcagttttaggcttagatgcaatggaatcaggaagtactttgaattcgttatcttcttcaccttctggttccgatactgaggacgaaacatcatttagcaaagaacaaagcagtaaaagtgaaaaaactagcaagaaaggaacagcagggagcggtgagaccgagaaaagatacatacgaacgataagattgactaatgaccagttaaagtgcctaaatttaacttatggtgaaaatgatctgaaattttccgtagatcacggaaaagctattgttacgtcaaaattattcgtttggaggtgggatgttccaattgttatcagtgatattgatggcaccatcacaaaatcggacgctttaggccatgttctggcaatgataggaaaagactggacgcacttgggtgtagccaagttatttagcgagatctccaggaatggctataatatactctatctaactgcaagaagtgctggacaagctgattccacgaggagttatttgcgatcaattgaacagaatggcagcaaactaccaaatgggcctgtgattttatcacccgatagaacgatggctgcgttaaggcgggaagtaatactaaaaaaacctgaagtctttaaaatcgcgtgtctaaacgacataagatccttgtattttgaagacagtgataacgaagtggatacagaggaaaaatcaacaccattttttgccggctttggtaataggattactgatgctttatcttacagaactgtggggatacctagttcaagaattttcacaataaatacagagggtgaggttcatatggaattattggagttagcaggttacagaagctcctatattcatatcaatgagcttgtcgatcatttctttccaccagtcagccttgatagtgtcgatctaagaactaatacttccatggttcctggctccccccctaatagaacgttggataactttgactcagaaattacttcaggtcgcaaaacgctatttagaggcaatcaggaagagaaattcacagacgtaaatttttggagagacccgttagtcgacatcgacaacttatcggatattagcaatgatgattctgataacatcgatgaagatactgacgtatcacaacaaagcaacattagtagaaatagggcaaattcagtcaaaaccgccaaggtcactaaagccccgcaaagaaatgtgagcggcagcacaaataacaacgaagttttagccgcttcgtctgatgtagaaaatgcgtctgacctggtgagttcccatagtagctcaggatccacgcccaataaatctacaatgtccaaaggggacattggaaaacaaatatatttggagctaggttctccacttgcatcgccaaaactaagatatttagacgatatggatgatgaagactccaattacaatagaactaaatcaaggagagcatcttctgcagccgcgactagtatcgataaagagttcaaaaagctctctgtgtcaaaggccggcgctccaacaagaattgtttcaaagatcaacgtttcaaatgacgtacattcacttgggaattcagataccgaatcacgaagggagcaaagtgttaatgaaacagggcgcaatcagctaccccacaactcaatggacgataaagatttggattcaagagtaagcgatgaattcgatgacgatgaattcgacgaagatgaattcgaagattaa

SEQ ID NO: 5013 - DNA, 2589 bp, Saccharomyces cerevisiae
atgtccagcagcaattttaacgagatgaacgaactaaatatgactcaaacaaattatggcagcacaaaatataccgctcagcatcatcaaggtgtaataaatgccatcatctcttcactgacagccccagatcagccaactaccgtatcattacaatattccaacgacaagaacatggcgacggaaatacaagcttatgctaaactctccggaccaaactggacctattatgtgaaggatttggaagtttctattggtagaaatactgatcccttaaacagtgcactacaggaaaattcagatggtgtaaaaaactcatatagagtgaatattgatctcggacctgccaaagtcgtttctagaaagcacgccataataaaatacaacatgaatatcggcggttgggaattgcacatattgggccgtaacggcgctaaagtaaactttcaaaggactcataatggacccaacaatcctcccattcgattatcttccggaaccctgctagacataggaggaacacaaatgatgtttatcctgcccgacagtgacccggttgttgctcctatttgtatagaacacctgatgcctaatttaataaacatgttcggattggaaggcaacaacaaccccctgctaagagacattataaaacagtctaattatgctaagcaaaggcaattaacctctaatcaacaaatcaaagggtttaagctttatggaagtggtggcaatgctccttttggtagcggagcgaacttgggccctagcgaacaaggcatcttcaacaacaataataatagtaagaacaagaatggctactttacgtccataaacccaaactatacagcatctacaacaacaagcaataccatcaatccacaagcggcttctccacagggtcctccaaataccatcatcgctgcaaattttgtagattcatacaagtcatcaaatgcctatcctcaagctttggattttacttcggacctatcccatgacgaaaacaggaacgttaaaccacctcattcatacgcaactatgataacacaggccatactgtcgtcgccggagggagttatttcactagccgatatctacaagtatatttcttccaattatgcatactacaggtttgctaaatccggttggcaaaactccattaggcataatttatcattaaataaggcgtttgaaaaggttccgagaagacccaatgagccgggcaaaggtatgaaatggagaattagcgaatcttatcagcaagaatttctaaacaagtggaataccggaaaagtggggaaaatcaggcggggatcctcagtagcaaggcaactacagttacatatggcaaaattcaacagtttacccatggaaatggactataggttatcgcttaacatggctcaaccccctaaacgacaactacaatctcacaatgtgctagaaccatccaacaataacatcatagaagggttcgtacaacatgtcccatccaaaggtaaccttcctgcatcgcaacaatcacagccccctgtgtcacatcaaaatcagtcacagcagccgccaccacaggaacaacgtcaagagattcaatttaccttcgcggatacccaaaatcgaaatatagcgttagcaagacctatcaagacgccacaattgcaagctcccaattcaaatgctaacttaaatcaaaacaatatgaaagaatacaaagagtcacttcatccgcctgcaatatcaatatcacaaatgaataggcaatctccaaacaacgctctagtctcgttcactaatgcatgtgctaattccaaaataataaacaacatcagcgatagcgccgacaaatcgacaaacaataacggcggtaccaaaatgaatctacccgccatatctacttcttcacttgatgaaaatggtaatttggagccgacaactaccacgtcttccggtaattctaactcagttccgcaaactggaacaacaacttcctcattggcagcgaacagtctacgcctttctcaaccatatgacacgctattacgatctcctactaaggcatttcatattactgcgatggaagcatatacaccagaaagaggaagcgctaatagggctaggtcacctcttcatagtaatagcaacaatactaataataacggcgcaaataattctaatttacagactagcggaatggaaaacaaacaaacaggtctagtattggattctaatgtcttgaaaagcatggaatcaaacaatgataatagacggctgacaccatcaacaagtaaatcgcagaatgtcaaaagttctccaggtgtatggaatttattgcagtttagctcaacaaacaacactcctgccgcagatagcggaggcaacaagagaggattttccataaatccggacattaaagccaaagaaaacgagaatgctacttcagaaaaagattcggactctaactcaaatgatctggaaactaaagatattaattcttcacctttgaaaaaccaaggtggtagcaccgccaatgccaaggaactaatactagatacggatggtgcaaagatcagtattatcaacaactaa

SEQ ID NO: 5014 - DNA, 2592 bp, Saccharomyces cerevisiae
atgccatctgctagcttactcgtctcgacaaagagacttaacgcttccaaattccaaaaatttgtgtcttcattaaacaaatccaccatagcaggatttgcatctgtacccttgagagctccaccatccgttgcatttacgagaaagaaagtcggatactcaaagaggtatgtttcatctactaacggcttttcagctactagatccactgtgatccaactgttgaacaatatcagcacaaaaagagaggttgaacaatatttgaaatatttcacttccgtctcacaacaacaatttgctgtgatcaaggtgggtggtgccattatcagcgacaatctacacgaactcgcttcctgcttggcatttttgtatcatgttggtctatatccaatagttttacatggtaccggtcctcaggttaatggaaggctagaagcgcagggaattgagccagactatattgatggtattagaatcacggatgagcacacaatggccgtagttagaaaatgttttttggaacaaaatcttaagctagttactgcattagaacagctaggggtccgtgcaagacccattacttctggtgtttttactgctgactatttggataaggacaaatacaagctagtgggcaatattaaaagtgtcacaaaagagccaattgaagcatctattaaggcaggtgccctaccaatcttgacctctttagccgaaactgcttctggtcaaatgttgaacgtcaacgccgacgtagctgctggtgaattagcccgtgtttttgagcctttgaagatcgtttacctgaatgagaaagggggtattatcaatggctccacgggagaaaaaatttcgatgatcaatttggatgaagagtatgacgatttaatgaagcaaagttgggtgaagtatggtaccaaattaaaaattagagaaattaaagagcttttggactatcttcctcgttcttcttcagttgcaatcattaacgttcaagatctacaaaaagaactgttcactgattctggtgcgggtactatgatcaggagaggttacaaattagtgaagagatcctccattggcgaatttccatccgctgatgctctaagaaaagctcttcaaagggacgctggcattagttccggtaaagaatctgttgcttcttatttaagatatttggaaaactctgattttgtctcttatgctgatgaacctcttgaagcagtggccattgtaaagaaagatacgaacgttcccacactagacaaatttgtctgttctgacgcagcctggttgaataacgtcacagataatgtattcaatgttttgcgccgtgattttcctgctttacaatgggtagtcagtgaaaatgatgctaacattgcatggcattttgataagtctcaaggttcatatctaaaaggcggaaaagttttgttctggtatggtatcgatgatataaatacaatatccgagctcgttgaaaattttgtgaagtcgtgtgacactgcttctaccctcaactcatcagcaagtagtggagtatttgctaacaaaaaatcagctaggtcgtactcaactagatccactcctcgtcccgagggagttaacaccaaccctggtcgtgtcgcgcttattggtgctagaggttacacaggtaaaaatttggtatctttgatcaacggccacccatatttagaagtggcccatgtttcttctcgtgaattgaaaggtcaaaagttgcaagattatacaaaatccgaaattatatatgaaagtttgcaaatacaggatattaggaaactggaagaacaaaatgctgtggacttttgggttatggcattacccaacaaagtctgtgaacctttcgttgagacaatccaaagtgttcatggtaagtctaaaattattgatctgtccgctgatcacaggtttgtatcagaatcagactgggcttacggtttgccagaattgaatgatagagcaaaaattgcaaacgctgccaaaattgctaatcccggttgttatgctactggttcgcaattaactatttctccgttaacaaagtatatcaatggtcttccaactgtgtttggtgtttcagggtattcaggcgcggggacgaagccttctccaaaaaacgatcccaaattcttgaacaataacttaattccttacgctttaagtgatcatatacacgaacgcgaaatctcagctcgcattgggcacaatgttgcattcatgccccatgttgggcagtggtttcaaggtatctctttgaccgtctctattccaataaaaaaaggttccttgtctattgatgagatcaggaaattatacagaaatttttacgaagacgaaaagctagtacatgtcatcgatgatatcccactggttaaagatattgagggcacccatggtgtagttattggtggtttcaagctgaatgatgctgaagatcgtgtagttgtttgcgcaaccatcgataacttacttaaaggcgccgctactcaatgtctgcaaaatattaatcttgctatgggttatggagagtatgctggtatccctgaaaataaaattattggtgtctga

SEQ ID NO: 5015 - DNA, 2592 bp, Saccharomyces cerevisiae
atgggatatgactcccaagttaggacaaaaaaacgacatcgaattactgtagtatgcacaaattgcaaaaaaaggaaaagtaagtgcgatcgaacgaaaccatgtggaacatgtgtacgactgggagatgtggacagctgtgtctatctcaccgatagctctggacaacctgaaagcagtccttcattgaatgatgctgaccctctgaggaaacaatcaactcctgcggaacgaataagtccaggtttcattaagaaaagaagatcgtcacagacaagacaagacgaagatcactggcaaagagtacgagaacttgaaaatcaatcatcactttattatctaccaattcatgaagaaactccattttttattgacctcatccctaatgggttttatttagagaccaaaaggtctgctgataatttatttggtctgttcacggatagagcaattgaaaatcgcgacccctatctccaagcaatggtaacatttagaagtatcgcaatcaaaaaaatgatggataaattgggaagcaacggcaataatgtgaaaaatggaagcttgcctaaatctttcgaagctttatccactttcgatgctgatgacgaacgccacattagcgatgatgttgttggtaagggcaataacttccgcatgcatcagactattcacaaatcattgtttaacaaattcgctcaatacagagaaaataatgctaaaaaattcagctcagaaactatattagcaaaggattatttgcctcctttaaaaatacttgaaagtgaggttttagcactttttgaagaaaaaatttacaatatgataccgattttcgatatgaaagttttgcgtcatgaaataacgatattttatcaaaatatagtcgagaaagggaatccaatttctataaaacactacgatcatatggttttctgcataatcttgttgattattaaaatatgccgactttctgtccagttttcgaagctaactccatatatatacccggttcttcaagaaattgatacctctaagtttttggctcttgttaaacactatttgttcgagacgaaggtcctcagaaaatgtaatttattacagttgcaatgtctcatattactaaggttcttgcactggtgtgcccctgaagatggcgatggacccgaaactcaatattgtcaaatcttaatggggacaataatatcatcatgtaaagaaatgggcattaactggtattgcttctctcatccagaaaaatattcatttaaaataaaccgacatacgaggccttcatacgatataatgaaacctagcgattacatttcagttttcagaaagatatggagttatgttttattttgggacaggaagatgtgttttattagcggtgaagaatgtcaaattgggaaaaccttgcagtgccatttcaaagaagaagcagatacacccacatggtatatacgaatgttaaccctggataacttgatgaaaaagataaacgatacgttgaacgatgatccaggaaaggtagatttgaacttgttgcaccgactaataaatgatttaaaaagaaactttcatattttaaaaagcctgtcgaaaaacgaaaaagaaacaatgcgtcattttgatttcgaaatggaatggataatagatttattctcactaagtttgctgcacggagaaatgatcttttatgaatatgactgcaatattacaaaattttataagagtttccaagatttgtgggatatggtcattcatatctcagagaagtgctacaattacttttttaacagtgatgccttagaggtggattcattgacaaagttttataccaatagaatcgtggaaattgtcgcaaacaaagttttggtcattgttccggcattcattctcagaggagaccgcttcaaaacaattcagtacgccgacaagaagaaaatgatagaatttctttacggggtctcgtctgtgtattttaacgaatttggctttgagtactatcgttgttttagaaaaatgttcaccgctaaaattgcctacaagatcttgaatcgctcatgtgaaaaagatgcatggagaattattttaaaatttttgctgaatgaattgaaactagaagataacggtgatagttatatagattacaacgatatgagattaaatgacatctgtccaataatactagaatttcaggagacagtacaaaaatatgatgggtataggccagatattctaagtatatggaacaatgagttttatcccataggtaaatacaacgatgatatgacaggatttaagtttcaaatgcgcataaaggaaatgcaagaattcttggatatggagaaatattccgacaggtttaatattttttcatccttttatgatcacgccagttcacaattagctaaacatactgaagttgataccaacataagcattacgaatgaacaagtagctgaaattccgcaaaaagaactactacaacaacctttagcacccgctttgcctgttaatgatttaattgtctcagagtttgacgtgattgaagatatttttgatcctgtggatttcgtatcatttttttaa

SEQ ID NO: 5016 - DNA, 2593 bp, Saccharomyces cerevisiae
atgagtatgtttctttccattggacggttgtcttccgatcaaaattttatctcctatacaatttcttcctatttactaacgaaaacctgcgaacctgtaaactacatgatttttaatattagtgaacttcaatacacctcaacaaaacaaaacgcccttttcgttcgggactgccaacaataactctaacaccaccaatcagaattcctctactggtgcgggcgccttcggaacaggtcaatcaacatttggtttcaacaattctgcgccaaataacacgaacaatgcaaactcttcaatcacacctgcatttggtagcaataacactggtaatactgcattcggtaacagtaaccccacaagtaacgtttttggcagcaacaattctacgactaatacatttggtagtaatagtgcagggacatccctttttggatcttccagtgctcaacaaacgaagagcaatggaactgctggaggaaatacatttggttcttcatccttattcaataacagtactaatagcaatacgacaaaacctgcgttcggcggtttgaattttggcggcggcaataacacaactcctagctcgaccggtaatgctaacacaagtaataacttatttggcgctaccgcaaatgcgaataagccagccttttcctttggtgcaaccactaacgacgataaaaaaacagaaccagacaagcctgctttctcctttaattcaagtgtcggtaataagacagacgctcaagctcccactacaggattttcctttggttcacaactaggtggaaacaaaacggttaacgaggctgcaaagccttccctttcatttggttcaggatcagctggtgctaacccagctggagcttcgcaacccgaacctacaactaatgaaccagcaaaaccagccctctcttttggtactgcaacatccgacaataagacaactaacacaaccccaagtttttcgtttggtgctaaatcggatgaaaataaagctggtgctacttctaagcctgccttctcattcggtgctaagccagaagaaaagaaggatgataattcctcaaaaccagctttctcatttggtgccaaatcaaatgaagacaagcaagatggaacggctaagccagcattttcctttggtgccaagcccgcggagaagaataacaatgaaacctccaagccggcattctcttttggagcaaagtctgatgagaaaaaggatggtgatgcctctaaacctgccttctcttttggcgctaaaccggatgaaaataaagctagtgctacttctaagcctgccttctcattcggcgctaagccagaagaaaagaaggatgataattcctcaaaaccagctttctcatttggtgccaaatcaaatgaagacaagcaagatggaacggctaagccagcattttcctttggtgccaagcccgcggaaaagaataacaatgaaacttccaagccggcattctcttttggagcaaagtccgatgagaaaaaggatggcgatgcctctaaacctgccttctcatttggtgctaaatcggatgaaaaaaaggacagtgattcttcgaagcctgccttctcatttggtactaaatcgaatgaaaaaaaggacagtggttcttcgaagcctgccttctcattcggtgctaaacccgatgaaaagaagaatgatgaagtctccaagcctgccttctcattcggagcaaaggctaacgaaaagaaagaaagtgatgaatcaaaatcagccttttcatttggttctaagcctacaggaaaggaggaaggcgatggggcgaaggctgccatttcctttggtgctaaacccgaagaacagaaatccagtgatacgagcaagccagcgtttacttttggtgctcaaaaagataatgagaagaaaacagaggaatcttctacggggaagtcaaccgcagatgtcaaatcaagtgatagcttgaaattaaattctaaaccagtagaattgaagccagtttctctcgacaataaaacactggacgatttagtaacgaaatggactaaccaactaacagaatcggcctctcattttgaacagtataccaaaaaaattaatagttgggatcaggtactagtgaaaggaggtgaacaaattagtcagttatactcagatgctgtgatggcggaacatagtcaaaacaaaatagatcaatctctacaatatatcgagaggcaacaggatgaattagaaaacttcttagacaattttgaaaccaagacagaggcacttctgtccgatgttgtgtctacaagttcaggtgctgcggccaacaataatgaccaaaaaagacaacaggcctataagacagcccagactttggacgaaaatttaaactcgttgtcatccaatctttcttctctaatagtagaaatcaacaatgttagtaatacattcaacaaaaccactaacatcgatataaacaatgaagacgaaaatattcaactaatcaaaatcttgaattcacatttcgacgctttaaggtcactagacgataactccacctctctggaaaaacaaatcaactcgataaagaaatga

SEQ ID NO: 5017 - DNA, 2595 bp, Saccharomyces cerevisiae
atgacagcacgtcgtttgattaatatagttcctaatacgtctaagctagaccctttaaaggaggaggactcaacgcatctgaaacaaaatcaacctaagaagttttccacaaaggagttgatgctttcagaatataccgaacgcaaaagttgcagccttccgttgtctaaatcccgatcaggcagtagtgcatccagtagcactacaggttcgaacggaaagaatattggaacaagacgccctagctccaacctagatttcaatttcgctagccaagatgttgttaaaaatgtattaggtaataataatccacacgtacccacagcgaagtgcattaggccaatatcagatgattctataggtacatcgagcacagagatattttcttcatcgcactcaaatacgacatctgattctttatgtacatcagatataagctcagaagagggtgaaatagcaaacagtaagatggaggataactgcttcttcaaaagtatgagagaagctgaccatagaagcaatattacgcccttaaagaaaagccgaccgggatcaatactacagaaaacacgtacagcaagtagcgctgataaaacaatctgctcaatgagtaccataactacatgcattccatctcgtcaaaattcggtgtcaactcctaaactctccaggacagtagggctgcctggatcgagcaatacaaccaacagtatagccgcatcacaaacttcattcataagcgagaatgactctcctcttaaacatcattgcatgagtaccgcaactatccaagaaccaaaactcatgccgatcacaaaaacgccgtatgtgcattccaatagtacttctgtaatattaccatataaaacaacccaacttactccttctcaacgttaccgtttaaggaaagagcaaaatgaccaatctttgcgtaaagccataaaaatgaaagaaaaattttatgaagatcaagacgttaacttggaacttcaagagggcgatgtcgacggctcgttaatttggaacattccaatggcatctttatcgaccagttcttttttaacattatctaagtttaatagaaaagaaatgagtttagattcagcgcggggggatgaagagatattaatacaggagaacaattgcgaaggcaaacaacactcatcttcggctctctgtgtggacaaaactttccatcaggttcatagtactagaaaacatacatcaaattcaagtaacactttaaaagaatcatgtctggactataaggagcttccgccaacatgcattcctggtatatctcctgtgtctgattcacagtacatccaggatacaatgaaaaatctctcccaaatatacctgcatagttccgaaaaaatctccaaaagtattctttctggtcgttcaagatctgtacagagtttaccactggaatttaaagaagccagtagtcagggaatggaagacctaatgctagtttcagaggacaaactaaaggccgtaagtcatttccgtccgagttggctcccgcccaaggatttcaaagagaggaaattgcaagataaacaaatctacaaaaatatcgacttagcatcaatggaagagttgcaaaaaaataaagaacgtgacgaaaaagccaaaaagaatgagcagaataaggtcaaattccagcatttactggaccgaggcattactcgtaactcgtcattaagtgaattaaagaaaattatttgggaaacacctttgatatctaaagtacggcttcaaatatatagtcaacttctacaaagtgacaattgcttgataacaaaatgttttattgaatcatttgaggaagtaatgcagctactcaacaaaatggattttcccaaagataaagaatttgaaataagacagcttattgaacacgatgtacaggaaaaggttttttataaaaatggaacagataagcaagtggtttctgacttgatgctattactgcaactgaaatctatatctcaacaaggtttggttactggtgatgagatgctattctaccattttttaactgatcaatcttttgggactttgaaggaaacatgggaaatggtcaacttgatacagatgacgtgcttcagtgaaatttgcaaggaaaaatacgattcaagaatattaaatcccagaggaattgttgcccatcttttacgaaaagatgagttcaaaaatgaattcaatggcggatgtttgaatagcaatacatggtggaacatattgcaaagaatggaccataaactttttatgtgggtaatggatgtaattatcgttcataatggccaaaactttgcaaactaccccgtaaaaatggaaatattcaaagacaaagtatgggaatactatagatctaagaaggttattgtaaattataagattttggtttcactaacagttaacgtattgttaaactaccacttcggatatgataatctgaaacatttatcagatttggatgataagcatttttgtattccactgtatacggaggatagtatcgaagaggaaaacctcaataatattttcacaaagtggtggttgcactactaccgaaaattacgttag

SEQ ID NO: 5018 - DNA, 2595 bp, Saccharomyces cerevisiae
atgtacatggccagatgtggccccaagaataatgtgctgtgtttcccatttcaactttcctttctattttcaaaacgactaataaataagcgtttcaagtataccctacaaactgaagatgaaaagaatatgatggggagtttaagtaaaaataaaataataacacctgaagacgttgagttcaaattagcacaattacgagaattttctaatactttaaaagaacgcattcacaacactaaatcggtgaattcagatggccaccaaagcaatagtatcgcaccaatctcagaagactcaaggaatgttaatgtcaccaaaacatcatctgttcctaatgaagaaaaatccaaaaatctatcagatttgattcattcttcgtttttagaaaaaatggatcacctcgtaccaaaagttataagagaaagagtagcagacgacgacatacttgcaaaaaacctttttgatagatcacacagtaattgggcacctgtcatagataggctttatgtcagtgagaaacggttcatggatattgattccagagaattttctgtttggttaaatggtacagtcaaatatttgccatttcatagtatactacacttggatgaaatgctattagaacaaatcaatggagatgttgtaaaatttaatacccacatgtacgaatgtatctttaacaacttaggaaatttaaaaccaactaattttaatcaggatggtactaacgataaagttatcctcaaaatgaaagagttgttagagaggtatgataaggcattaaaaataactgaagaaagaattaacaaaaaagaaggattcccttccaaagtaccaaagatgacgcaagcaatacttaataattgtttaaaatactcgaccaagtgttcaagctttcacgacatggattattttattacaaaattcagagatgattatggcataactcctaataagcaaaacctaactactgtaatacaattctactctaggaaggaaatgactaagcaagcctggaatacttttgacaccatgaaatttttatctacaaagcatttccctgatatctgcacatataacacaatgctgcgaatatgcgagaaggaacggaattttcctaaggctttggatttatttcaagaaattcaagaccacaatataaagcctacaacaaacacttacataatgatggcaagagtgttggcttcttcgagcagtaatgccgttgtcagtgagggtaaatcagactctctaagattactgggatggaaataccttcatgagttggaggacaagaatctttacagacataaaaaagatgacttaaatttatttttggctatgatggcattagccgcgtttgatggtgatattgaattaagtagagctctatattacttgttcatcgcgaaaaagtacaaaactttgtgcgcaaattggaaaggaaacattctcgtagatcaagatacaatttggaagtcaactttaatgccagaaatgctgaattatttgatgcttgcttatgcaagatttgatcccagaaatttgccagtcttatccggttatgaaaaaggcattgaattgagaagaaaatttcttcgcgaatttgattcctccatgaggttagatgatacagacaaattggtcaaatttaaattaccatttcttccaattagtgacctaaattcggaggcacaagtattggcggaatctaacgcaatctggagtttcaatatggaaaatggaggaacgcgcaatacattgacatcttcaaatgaagcggcgttggaggatatcaaaaaatataggcaattacttgattcgtttgcgcaagaagcagaggatttcaacgagtttaagtttaaagttatgtacgaagtgacgaaaatgcaaagagaaagtattaatgtgaacgtcttcaataaaatttcactacacacatatttgtcaattcccattaacttaaaacaacagaaggaattcttgcgaaggttgacgttcttcactttccaacaacacgaatttgaagctgtcataaagcgtttgtatgaaggataccgtaatattccttcgtcccatacgcgtgaccaaaattcaatatcaactgaagccatctcagtatccaaacctgagaccacggaagacctcaacttaataatgcatgatatatggtatattacatgtttgaggcacaaaatcatgatggacaccacgttatatgagctggtgatgaaagccgctatagaatttcaaaatgaggacttagcaaagaaagtatggaatgataggggtaaatttaggacgactgtaccgtttctgaaaatggaccaaagaataagaatagcaaaggatcagaaatttgcccatctaatggttgaattcttcacaaagcaaggaaagtattcggacgcaatagctatcatattgtcttcaaaaaatcgcttcaattggacttattccatggttaggaatttgcataaagcattagaagaaatcgaggatagaaatagcgttgaaatcttactggatgtagtaaacaaaaagtcacacgcaaaggccctgaagtgggaggaacaagaacttaacatgtag

SEQ ID NO: 5019 - DNA, 2598 bp, Saccharomyces cerevisiae
atgtcgtacaccaataaacgtcatacatactacggagggtttaccaacgatttgtctgacacatttcagtaccctcaaagaacagatgagcaaaggcggaaacatgtaacgtttggtccttatatcctagggtcgacgttaggagaaggagagttcggaaaagtgaagctaggctggccaaagaatttttcaaacagctctaattcaacttttgacttcccaaaacaagtagcaattaaacttatcaaacgtgatagcatatcgaatgattacaggaaagaagttaaaatatacagagaaatcaacgccttaaaacacttatcacatccgaatatcgtaaaattagaagaagtgttgcaaaattctaggtacattggtattgtcctagagtacgcatgcgggggagaattctataaatatattcaaaaaaaaaggaggcttaaggaaatgaatgcatgcaggttattttctcagctaataagtggagtacattacatacattctaagggacttgttcacagagatctcaaattggaaaatctattactagacaagaatgagaacctagttattacagattttgggtttgtcaatgagttttgctcacgaaacgaattaatgaagacgtcatgtggctctccatgctacgcagcgcctgaactagtgataagcgccgaaccatacgaagctagaaaagcagatatatggtcatgtggagttatactttacgctatactagctggatatttaccgtgggatgatgatccaaataatcctgaaggcagcgatataggaagactttataattatattaactccacaccattaaagttccctgattatattcttcctatacctcgggacttattaagacgcatgctggtctcagacccaaagaaaagaataaacctgaaacagatcaagaaacatgaatggctaaagcctcattcttcattcttatccataacacctgatgagtgggacaaactaaacaatactcaatccgtgttcagattagcaaaaccaagaagaagatatggatctagaccacaatccagttgttctacctcatctcttggctcaaggagtgataaaagggattcactggtcattgattcaactttaattactttcccggctccgcctcaagaatcacaaaatcatattataaccagaccggcttctattgcatctgaccagcggctgtcacctataagaagatctaataggcacaatagaagtaactctgctgcatccgttgccttgcaggcagtggtgaacgcagatagggaatatgtgttaagtcatgaacaatcattatccccagtacaaaacattagacaaactacgggaaacatgactgccagtctttcacctccaccagccataagtccaggcgatattataatcgaaaccacacctattaaaagaaatacaatttctgggagtagtattgtaccaagtttagaagaagagtcgtctaccacaatgcaaacaagcaagattcaaccaaataacatggcttcatcacaaaatcatcaatacaataaaaataagacccaaaatagtctccaatctgctaaaaatttctaccgtacgtcttcctcatcccatacaaagccacggccaacttcataccatcctggctcatacacaacacctccctacaattcaaatacgctctccatatatgagatcaacgaaaaagctaaaagtagcgcttcatcacaaacgctgaatcaaagagacacatccccatttgattccacaccataccttgccctagatacatgcataacctcatcctcttccatcgaaagctctccaaagttaattacgcacggccaattttcagtagcaaaaccctctgttgatttgcaaagcgtatctggtgacttgatcaagtataagagggacgctgatgtagtaacgagaatctatgatgaaaaatacaaacagaagcgcaaaagtttgagatatagcggcatattcagtgacatctcatgcgatacggtcaccgaagagtctgatgaattgaggccaccagaatctcctcttcaacaacatgaaggacaagaatcaattgataaggcgaaaacggaggacacaagtgaaaagggtagtaaaagtagcaacatcgcgaaagctacagcacaaaaacacgtcaataaccatctagaaagatcacttaacgaagcagagtcaacaaagaaaagatttagctttctttccttgtactcttatgatacttccaaatctagtttatactcatcaatggattccaaacggaaaccttctccaccttcccaaagacgcccaaaaaaggatgacagttatcaaacaaattcaaagaatcattatatcactgcttcaaatatgcaaacatcccatcaagtctcaaaagacctgcctgcaccaacgatggtgcaaaataaatgtactttagaaactaaaaaagcggtccgaagcaacaggtcctccataatggtatctgaggtcaacaaggcaagcgtagacaataaagcagcccaaagtccagaacattcaaccgcaaaaagagtattagggtttttcaaaagaagaagtatgaaaatctag

SEQ ID NO: 5020 - DNA, 40 bp, Artificial Sequence
  PCR primer for ORF amplification
ggatccagctagcaaaatggcaacgttggattttaccact

SEQ ID NO: 5021 - DNA, 40 bp, Artificial Sequence
  PCR primer for ORF amplification
ggatccagctagcaaaatgataataatatttatagaattg

SEQ ID NO: 5022 - DNA, 40 bp, Artificial Sequence
  PCR primer for ORF amplification
ggatccagctagcaaaatgtgggtagtactttcaaaagaa

SEQ ID NO: 5023 - DNA, 40 bp, Artificial Sequence
  PCR primer for ORF amplification
ggatccagctagcaaaatgttctcccacttcgaagtctcg

SEQ ID NO: 5024 - DNA, 40 bp, Artificial Sequence
  PCR primer for ORF amplification
ggatccagctagcaaaatgaccgaaagaaagctattgcag

SEQ ID NO: 5025 - DNA, 40 bp, Artificial Sequence
  PCR primer for ORF amplification
ggatccagctagcaaaatgagaagtttggtgtttgtccaa

SEQ ID NO: 5026 - DNA, 40 bp, Artificial Sequence
  PCR primer for ORF amplification
ggatccagctagcaaaatgatctctgatgaacagctgaac

SEQ ID NO: 5027 - DNA, 40 bp, Artificial Sequence
  PCR primer for ORF amplification
ggatccagctagcaaaatgcaaccatctaccgctaccgcc

SEQ ID NO: 5028 - DNA, 40 bp, Artificial Sequence
  PCR primer for ORF amplification
ggatccagctagcaaaatgctaatcttcataattcattat

SEQ ID NO: 5029 - DNA, 40 bp, Artificial Sequence
  PCR primer for ORF amplification
ggatccagctagcaaaatggtacacttcatttttatcgcc

SEQ ID NO: 5030 - DNA, 40 bp, Artificial Sequence
  PCR primer for ORF amplification
ggatccagctagcaaaatgcaagatttagagatttttttg

SEQ ID NO: 5031 - DNA, 40 bp, Artificial Sequence
  PCR primer for ORF amplification
ggatccagctagcaaaatgcaatggaacgctttttccttt

SEQ ID NO: 5032 - DNA, 40 bp, Artificial Sequence
  PCR primer for ORF amplification
ggatccagctagcaaaatgtccctacggccttgtctaaca

SEQ ID NO: 5033 - DNA, 40 bp, Artificial Sequence
  PCR primer for ORF amplification
ggatccagctagcaaaatgaatgtaatatttaaattgtat

SEQ ID NO: 5034 - DNA, 40 bp, Artificial Sequence
  PCR primer for ORF amplification
ggatccagctagcaaaatgcaaccgatcaccactgcttcc

SEQ ID NO: 5035 - DNA, 40 bp, Artificial Sequence
  PCR primer for ORF amplification
ggatccagctagcaaaatgaaagtgctagatgattggttt

SEQ ID NO: 5036 - DNA, 40 bp, Artificial Sequence
  PCR primer for ORF amplification
ggatccagctagcaaaatgagtcgttctattttttttttc

SEQ ID NO: 5037 - DNA, 40 bp, Artificial Sequence
  PCR primer for ORF amplification
ggatccagctagcaaaatgcacctaagaagcagatggtgg

SEQ ID NO: 5038 - DNA, 40 bp, Artificial Sequence
  PCR primer for ORF amplification
ggatccagctagcaaaatgccatttccgtcgatattacat

SEQ ID NO: 5039 - DNA, 40 bp, Artificial Sequence
  PCR primer for ORF amplification
ggatccagctagcaaaatgacagcaaagacgaaacaaagc

SEQ ID NO: 5040 - DNA, 40 bp, Artificial Sequence
  PCR primer for ORF amplification
ggatccagctagcaaaatgacttgcggtatagaaaatagt

SEQ ID NO: 5041 - DNA, 40 bp, Artificial Sequence
  PCR primer for ORF amplification
ggatccagctagcaaaatgactttaccaggtggtgttatt

SEQ ID NO: 5042 - DNA, 40 bp, Artificial Sequence
  PCR primer for ORF amplification
ggatccagctagcaaaatgttgactggtattgccccagac

SEQ ID NO: 5043 - DNA, 40 bp, Artificial Sequence
  PCR primer for ORF amplification
ggatccagctagcaaaatgtattcgtgcgcgaaaaaaaaa

SEQ ID NO: 5044 - DNA, 40 bp, Artificial Sequence
  PCR primer for ORF amplification
ggatccagctagcaaaatgtacaatcagataataaacact

SEQ ID NO: 5045 - DNA, 40 bp, Artificial Sequence
  PCR primer for ORF amplification
ggatccagctagcaaaatgttgatgagcacgttaccaggt

SEQ ID NO: 5046 - DNA, 40 bp, Artificial Sequence
  PCR primer for ORF amplification
ggatccagctagcaaaatgaagataaaaatttccatcgaa

SEQ ID NO: 5047 - DNA, 40 bp, Artificial Sequence
  PCR primer for ORF amplification
ggatccagctagcaaaatgcatgacatctgggtaatcacc

SEQ ID NO: 5048 - DNA, 40 bp, Artificial Sequence
  PCR primer for ORF amplification
ggatccagctagcaaaatgttttatggaagcttcaataaa

SEQ ID NO: 5049 - DNA, 40 bp, Artificial Sequence
  PCR primer for ORF amplification
ggatccagctagcaaaatgaaaatgaactatcatctatca

SEQ ID NO: 5050 - DNA, 40 bp, Artificial Sequence
  PCR primer for ORF amplification
ggatccagctagcaaaatgcctagtgattatacttcccat

SEQ ID NO: 5051 - DNA, 40 bp, Artificial Sequence
  PCR primer for ORF amplification
ggatccagctagcaaaatgtgtaaactcatgtggtgcact

SEQ ID NO: 5052 - DNA, 40 bp, Artificial Sequence
  PCR primer for ORF amplification
ggatccagctagcaaaatgttaacgacacaaaagtgtgaa

SEQ ID NO: 5053 - DNA, 40 bp, Artificial Sequence
  PCR primer for ORF amplification
ggatccagctagcaaaatggcacacaaatgtgcaagtgcc

SEQ ID NO: 5054 - DNA, 40 bp, Artificial Sequence
  PCR primer for ORF amplification
ggatccagctagcaaaatgcaagttggttttgtttctcag

SEQ ID NO: 5055 - DNA, 40 bp, Artificial Sequence
  PCR primer for ORF amplification
ggatccagctagcaaaatgccacaattagttccattttat

SEQ ID NO: 5056 - DNA, 40 bp, Artificial Sequence
  PCR primer for ORF amplification
ggatccagctagcaaaatgtcttacacacgagtagatcat

SEQ ID NO: 5057 - DNA, 40 bp, Artificial Sequence
  PCR primer for ORF amplification
ggatccagctagcaaaatgaaattactatttctgaatatt

SEQ ID NO: 5058 - DNA, 40 bp, Artificial Sequence
  PCR primer for ORF amplification
ggatccagctagcaaaatgaagttatttattcttgattat

SEQ ID NO: 5059 - DNA, 40 bp, Artificial Sequence
  PCR primer for ORF amplification
ggatccagctagcaaaatgataaactacgttaacattaca

SEQ ID NO: 5060 - DNA, 40 bp, Artificial Sequence
  PCR primer for ORF amplification
ggatccagctagcaaaatgatacaaaaaccgattttatta

SEQ ID NO: 5061 - DNA, 40 bp, Artificial Sequence
  PCR primer for ORF amplification
ggatccagctagcaaaatgatgagaatgtctctaaaacaa

SEQ ID NO: 5062 - DNA, 40 bp, Artificial Sequence
  PCR primer for ORF amplification
ggatccagctagcaaaatgtcccgtgtctatatatatcca

SEQ ID NO: 5063 - DNA, 40 bp, Artificial Sequence
  PCR primer for ORF amplification
ggatccagctagcaaaatgtggagacgtcggcgcgagccc

SEQ ID NO: 5064 - DNA, 40 bp, Artificial Sequence
  PCR primer for ORF amplification
ggatccagctagcaaaatgaaacagatgatgattgaagca

SEQ ID NO: 5065 - DNA, 40 bp, Artificial Sequence
  PCR primer for ORF amplification
ggatccagctagcaaaatgtctaacacctttgttgcagtc

SEQ ID NO: 5066 - DNA, 40 bp, Artificial Sequence
  PCR primer for ORF amplification
ggatccagctagcaaaatgtttggtctacctcaacaggaa

SEQ ID NO: 5067 - DNA, 40 bp, Artificial Sequence
  PCR primer for ORF amplification
ggatccagctagcaaaatgacattccatcttgggtggaca

SEQ ID NO: 5068 - DNA, 40 bp, Artificial Sequence
  PCR primer for ORF amplification
ggatccagctagcaaaatgaggcatcatcaaaatatgcat

SEQ ID NO: 5069 - DNA, 40 bp, Artificial Sequence
  PCR primer for ORF amplification
ggatccagctagcaaaatgcacggcgcttgcctcagcggt

SEQ ID NO: 5070 - DNA, 40 bp, Artificial Sequence
  PCR primer for ORF amplification
ggatccagctagcaaaatgacagttctaatcaagttgggt

SEQ ID NO: 5071 - DNA, 40 bp, Artificial Sequence
  PCR primer for ORF amplification
ggatccagctagcaaaatgattccctttcctgcacaacac

SEQ ID NO: 5072 - DNA, 40 bp, Artificial Sequence
  PCR primer for ORF amplification
ggatccagctagcaaaatgattttctttttcaaccagatc

SEQ ID NO: 5073 - DNA, 40 bp, Artificial Sequence
  PCR primer for ORF amplification
ggatccagctagcaaaatgattctcgctttgggcgacttc

SEQ ID NO: 5074 - DNA, 40 bp, Artificial Sequence
  PCR primer for ORF amplification
ggatccagctagcaaaatgcatatattaacgcgatcgagt

SEQ ID NO: 5075 - DNA, 40 bp, Artificial Sequence
  PCR primer for ORF amplification
ggatccagctagcaaaatgcgtttgtctctctattcatgt

SEQ ID NO: 5076 - DNA, 40 bp, Artificial Sequence
  PCR primer for ORF amplification
ggatccagctagcaaaatggggttcctccctgagtgtaat

SEQ ID NO: 5077 - DNA, 40 bp, Artificial Sequence
  PCR primer for ORF amplification
ggatccagctagcaaaatgagactacataaaacatttatc

SEQ ID NO: 5078 - DNA, 40 bp, Artificial Sequence
  PCR primer for ORF amplification
ggatccagctagcaaaatgatagttgatttctattccaac

SEQ ID NO: 5079 - DNA, 40 bp, Artificial Sequence
  PCR primer for ORF amplification
ggatccagctagcaaaatgatgtgcgtctgtatcccaaaa

SEQ ID NO: 5080 - DNA, 40 bp, Artificial Sequence
  PCR primer for ORF amplification
ggatccagctagcaaaatgcttttgtgcttccatatgtgt

SEQ ID NO: 5081 - DNA, 40 bp, Artificial Sequence
  PCR primer for ORF amplification
ggatccagctagcaaaatggtgcggctttcgtatctgcgt

SEQ ID NO: 5082 - DNA, 40 bp, Artificial Sequence
  PCR primer for ORF amplification
ggatccagctagcaaaatggtcaaattaacttcaatcgct

SEQ ID NO: 5083 - DNA, 40 bp, Artificial Sequence
  PCR primer for ORF amplification
ggatccagctagcaaaatgatcgtaaataatacacatata

SEQ ID NO: 5084 - DNA, 40 bp, Artificial Sequence
  PCR primer for ORF amplification
ggatccagctagcaaaatggattctgccaagatcattaac

SEQ ID NO: 5085 - DNA, 40 bp, Artificial Sequence
  PCR primer for ORF amplification
ggatccagctagcaaaatgttcaatgtagcattaccatca

SEQ ID NO: 5086 - DNA, 40 bp, Artificial Sequence; identical to SEQ ID NO: 5032
  PCR primer for ORF amplification

SEQ ID NO: 5087 - DNA, 40 bp, Artificial Sequence
  PCR primer for ORF amplification
ggatccagctagcaaaatgaaaagggacctaattggtccg

SEQ ID NO: 5088 - DNA, 40 bp, Artificial Sequence
  PCR primer for ORF amplification
ggatccagctagcaaaatggctcacgaaaacgtctggttc

SEQ ID NO: 5089 - DNA, 40 bp, Artificial Sequence
  PCR primer for ORF amplification
ggatccagctagcaaaatggctcacgaaaacgtttggttc

SEQ ID NO: 5090 - DNA, 40 bp, Artificial Sequence
  PCR primer for ORF amplification
ggatccagctagcaaaatgtttttacgtttttataatcga

SEQ ID NO: 5091 - DNA, 40 bp, Artificial Sequence
  PCR primer for ORF amplification
ggatccagctagcaaaatgaatgtgtttatgccaataagg

SEQ ID NO: 5092 - DNA, 40 bp, Artificial Sequence
  PCR primer for ORF amplification
ggatccagctagcaaaatgtataaatgtgtcccgagttat

SEQ ID NO: 5093 - DNA, 40 bp, Artificial Sequence
  PCR primer for ORF amplification
ggatccagctagcaaaatgacacaattgagtcaatccaac

SEQ ID NO: 5094 - DNA, 40 bp, Artificial Sequence
  PCR primer for ORF amplification
ggatccagctagcaaaatgcatttgatgtacactttgggc

SEQ ID NO: 5095 - DNA, 40 bp, Artificial Sequence
  PCR primer for ORF amplification
ggatccagctagcaaaatggaatctatatttctacatgct

SEQ ID NO: 5096 - DNA, 40 bp, Artificial Sequence
  PCR primer for ORF amplification
ggatccagctagcaaaatgaagttatctcaagttgttgtt

SEQ ID NO: 5097 - DNA, 40 bp, Artificial Sequence
  PCR primer for ORF amplification
ggatccagctagcaaaatgactattgctccaattactggt

SEQ ID NO: 5098 - DNA, 40 bp, Artificial Sequence
  PCR primer for ORF amplification
ggatccagctagcaaaatggctaagtctaagaaccatacc

SEQ ID NO: 5099 - DNA, 40 bp, Artificial Sequence
  PCR primer for ORF amplification
ggatccagctagcaaaatgggcttttttaacaataatccg

SEQ ID NO: 5100 - DNA, 40 bp, Artificial Sequence
  PCR primer for ORF amplification
ggatccagctagcaaaatgttgaaaagattccctacccct

SEQ ID NO: 5101 - DNA, 40 bp, Artificial Sequence
  PCR primer for ORF amplification
ggatccagctagcaaaatgagtttcctaccatcttttatc

SEQ ID NO: 5102 - DNA, 40 bp, Artificial Sequence
  PCR primer for ORF amplification
ggatccagctagcaaaatggctaataaagttattcaacta

SEQ ID NO: 5103 - DNA, 40 bp, Artificial Sequence
  PCR primer for ORF amplification
ggatccagctagcaaaatgttcgatagttctatcgaacga

SEQ ID NO: 5104 - DNA, 40 bp, Artificial Sequence
  PCR primer for ORF amplification
ggatccagctagcaaaatgtttgctaagctttatcgcggt

SEQ ID NO: 5105 - DNA, 40 bp, Artificial Sequence
  PCR primer for ORF amplification
ggatccagctagcaaaatgttcagcgaattaattaacttc

SEQ ID NO: 5106 - DNA, 40 bp, Artificial Sequence
  PCR primer for ORF amplification
ggatccagctagcaaaatgaaagtatcacaagttttcatt

SEQ ID NO: 5107 - DNA, 40 bp, Artificial Sequence
  PCR primer for ORF amplification
ggatccagctagcaaaatgcagtccatgatctgctcatct

SEQ ID NO: 5108 - DNA, 40 bp, Artificial Sequence
  PCR primer for ORF amplification
ggatccagctagcaaaatggacggtatgtttgctatgcca

SEQ ID NO: 5109 - DNA, 40 bp, Artificial Sequence
  PCR primer for ORF amplification
ggatccagctagcaaaatgacacttgcctattatggacag

SEQ ID NO: 5110 - DNA, 40 bp, Artificial Sequence
  PCR primer for ORF amplification
ggatccagctagcaaaatggacactgaagagaaaaaaaag

SEQ ID NO: 5111 - DNA, 40 bp, Artificial Sequence
  PCR primer for ORF amplification
ggatccagctagcaaaatggtttgtattcacactgaaaat

SEQ ID NO: 5112 - DNA, 40 bp, Artificial Sequence
  PCR primer for ORF amplification
ggatccagctagcaaaatgtctgcctggaggaaagctggt

SEQ ID NO: 5113 - DNA, 40 bp, Artificial Sequence
  PCR primer for ORF amplification
ggatccagctagcaaaatgtgtattattgtaaaatactca

SEQ ID NO: 5114 - DNA, 40 bp, Artificial Sequence
  PCR primer for ORF amplification
ggatccagctagcaaaatgaaaatgtggggaccctcccaa

SEQ ID NO: 5115 - DNA, 40 bp, Artificial Sequence
  PCR primer for ORF amplification
ggatccagctagcaaaatgatgtgtattataaattctgag

SEQ ID NO: 5116 - DNA, 40 bp, Artificial Sequence
  PCR primer for ORF amplification
ggatccagctagcaaaatgccatactcaccttcacttata

SEQ ID NO: 5117 - DNA, 40 bp, Artificial Sequence
  PCR primer for ORF amplification
ggatccagctagcaaaatggtttgtcgttttgttcatcat

SEQ ID NO: 5118 - DNA, 40 bp, Artificial Sequence
  PCR primer for ORF amplification
ggatccagctagcaaaatgaagattttcacgctgtatacc

SEQ ID NO: 5119 - DNA, 40 bp, Artificial Sequence
  PCR primer for ORF amplification
ggatccagctagcaaaatgaattgtttatgtttatgttct

SEQ ID NO: 5120 - DNA, 40 bp, Artificial Sequence
  PCR primer for ORF amplification
ggatccagctagcaaaatgatctcagtttgtttcgttttt

SEQ ID NO: 5121 - DNA, 40 bp, Artificial Sequence
  PCR primer for ORF amplification
ggatccagctagcaaaatgattttagtacatacagggaac

SEQ ID NO: 5122 - DNA, 40 bp, Artificial Sequence
  PCR primer for ORF amplification
ggatccagctagcaaaatgtctagtcgccaaggtggtaag

SEQ ID NO: 5123 - DNA, 40 bp, Artificial Sequence
  PCR primer for ORF amplification
ggatccagctagcaaaatggccgtacagacaccaagacaa

SEQ ID NO: 5124 - DNA, 40 bp, Artificial Sequence
  PCR primer for ORF amplification
ggatccagctagcaaaatgagaaacgaattataccagtta

SEQ ID NO: 5125 - DNA, 40 bp, Artificial Sequence
  PCR primer for ORF amplification
ggatccagctagcaaaatgatactatccaaacatgtaaat

SEQ ID NO: 5126 - DNA, 40 bp, Artificial Sequence
  PCR primer for ORF amplification
ggatccagctagcaaaatgcaattcaagaccatcgtcgct

SEQ ID NO: 5127 - DNA, 40 bp, Artificial Sequence
  PCR primer for ORF amplification
ggatccagctagcaaaatgcgccgcctatatcgtcatctt

SEQ ID NO: 5128 - DNA, 40 bp, Artificial Sequence
  PCR primer for ORF amplification
ggatccagctagcaaaatgcggcgtgcattgttcatagcg

SEQ ID NO: 5129 - DNA, 40 bp, Artificial Sequence
  PCR primer for ORF amplification
ggatccagctagcaaaatgttcttcagccaagttttgaga

SEQ ID NO: 5130 - DNA, 40 bp, Artificial Sequence
  PCR primer for ORF amplification
ggatccagctagcaaaatgaacaagagatataaattatac

SEQ ID NO: 5131 - DNA, 40 bp, Artificial Sequence
  PCR primer for ORF amplification
ggatccagctagcaaaatgccttatcactatttatttttg

SEQ ID NO: 5132 - DNA, 40 bp, Artificial Sequence
  PCR primer for ORF amplification
ggatccagctagcaaaatgctggccatgaaatcattttca

SEQ ID NO: 5133 - DNA, 40 bp, Artificial Sequence
  PCR primer for ORF amplification
ggatccagctagcaaaatggataacaaaaccccagtcact

SEQ ID NO: 5134 - DNA, 40 bp, Artificial Sequence
  PCR primer for ORF amplification
ggatccagctagcaaaatggattctaagaccccagtcacc

SEQ ID NO: 5135 - DNA, 40 bp, Artificial Sequence
  PCR primer for ORF amplification
ggatccagctagcaaaatggtcgcctttttagaactaact

SEQ ID NO: 5136 - DNA, 40 bp, Artificial Sequence
  PCR primer for ORF amplification
ggatccagctagcaaaatggttgttggcagcgaatttaac

SEQ ID NO: 5137 - DNA, 40 bp, Artificial Sequence
  PCR primer for ORF amplification
ggatccagctagcaaaatgaatacagaccaacaaaaagtg

SEQ ID NO: 5138 - DNA, 40 bp, Artificial Sequence
  PCR primer for ORF amplification
ggatccagctagcaaaatgaccatggaccaaggccttaac

SEQ ID NO: 5139 - DNA, 40 bp, Artificial Sequence
  PCR primer for ORF amplification
ggatccagctagcaaaatgagaccacgtgaccaaggcttt

SEQ ID NO: 5140 - DNA, 40 bp, Artificial Sequence
  PCR primer for ORF amplification
ggatccagctagcaaaatgagagcagtcactagaaacaaa

SEQ ID NO: 5141 - DNA, 40 bp, Artificial Sequence
  PCR primer for ORF amplification
ggatccagctagcaaaatgcatttgtgccagaatggacac

SEQ ID NO: 5142 - DNA, 40 bp, Artificial Sequence
  PCR primer for ORF amplification
ggatccagctagcaaaatggcaaaatcggttttcaatttc

SEQ ID NO: 5143 - DNA, 40 bp, Artificial Sequence
  PCR primer for ORF amplification
ggatccagctagcaaaatggctagaggtaatcaaagagac

SEQ ID NO: 5144 - DNA, 40 bp, Artificial Sequence
  PCR primer for ORF amplification
ggatccagctagcaaaatgggtgctgcttatcatttcatg

SEQ ID NO: 5145 - DNA, 40 bp, Artificial Sequence
  PCR primer for ORF amplification
ggatccagctagcaaaatgaacgctaacaaacaaaggcag

SEQ ID NO: 5146 - DNA, 40 bp, Artificial Sequence
  PCR primer for ORF amplification
ggatccagctagcaaaatgactcgtgatacacccgaagat

SEQ ID NO: 5147 - DNA, 40 bp, Artificial Sequence
  PCR primer for ORF amplification
ggatccagctagcaaaatgactgaaactgacaagaaacaa

SEQ ID NO: 5148 - DNA, 40 bp, Artificial Sequence
  PCR primer for ORF amplification
ggatccagctagcaaaatgactgtaaaaatatgtgactgt

SEQ ID NO: 5149 - DNA, 40 bp, Artificial Sequence
  PCR primer for ORF amplification
ggatccagctagcaaaatgctggttcccatgcataactca

SEQ ID NO: 5150 - DNA, 40 bp, Artificial Sequence
  PCR primer for ORF amplification
ggatccagctagcaaaatgtgttgtttcgataccctccat

SEQ ID NO: 5151 - DNA, 40 bp, Artificial Sequence
  PCR primer for ORF amplification
ggatccagctagcaaaatgaagttccaatatgcgttggcc

SEQ ID NO: 5152 - DNA, 40 bp, Artificial Sequence
  PCR primer for ORF amplification
ggatccagctagcaaaatgaaatcactccatgatagttta

SEQ ID NO: 5153 - DNA, 40 bp, Artificial Sequence
  PCR primer for ORF amplification
ggatccagctagcaaaatgattgtcccagtcagatgtttc

SEQ ID NO: 5154 - DNA, 40 bp, Artificial Sequence
  PCR primer for ORF amplification
ggatccagctagcaaaatggtaaaagtgaaatctaagaat

SEQ ID NO: 5155 - DNA, 40 bp, Artificial Sequence
  PCR primer for ORF amplification
ggatccagctagcaaaatgtattcaaagatcttgctatac

SEQ ID NO: 5156 - DNA, 40 bp, Artificial Sequence
  PCR primer for ORF amplification
ggatccagctagcaaaatgtcattctctgtcagctgcaag

SEQ ID NO: 5157 - DNA, 40 bp, Artificial Sequence
  PCR primer for ORF amplification
ggatccagctagcaaaatgtccaaatacgcttggtatacc

SEQ ID NO: 5158 - DNA, 40 bp, Artificial Sequence
  PCR primer for ORF amplification
ggatccagctagcaaaatgtctcgcgaagggttccagatt

SEQ ID NO: 5159 - DNA, 40 bp, Artificial Sequence
  PCR primer for ORF amplification
ggatccagctagcaaaatgcatcgtaaaaaaagaaaaaaa

SEQ ID NO: 5160 - DNA, 40 bp, Artificial Sequence
  PCR primer for ORF amplification
ggatccagctagcaaaatgtcaagacacaagtacaagtta

SEQ ID NO: 5161 - DNA, 40 bp, Artificial Sequence
  PCR primer for ORF amplification
ggatccagctagcaaaatgagcaagcataagcatgaatgg

SEQ ID NO: 5162 - DNA, 40 bp, Artificial Sequence
  PCR primer for ORF amplification
ggatccagctagcaaaatggagaaccctcatgaacaagtg

SEQ ID NO: 5163 - DNA, 40 bp, Artificial Sequence
  PCR primer for ORF amplification
ggatccagctagcaaaatggctagagcaagaaagggtgca

SEQ ID NO: 5164 - DNA, 40 bp, Artificial Sequence
  PCR primer for ORF amplification
ggatccagctagcaaaatgtctgataagcccgactcccaa

SEQ ID NO: 5165 - DNA, 40 bp, Artificial Sequence
  PCR primer for ORF amplification
ggatccagctagcaaaatgtctgcattatttaattttcgt

SEQ ID NO: 5166 - DNA, 40 bp, Artificial Sequence
  PCR primer for ORF amplification
ggatccagctagcaaaatgagatctaatattttgaaatta

SEQ ID NO: 5167 - DNA, 40 bp, Artificial Sequence
  PCR primer for ORF amplification
ggatccagctagcaaaatgattgaggtagttgtgaatgac

SEQ ID NO: 5168 - DNA, 40 bp, Artificial Sequence
  PCR primer for ORF amplification
ggatccagctagcaaaatggaactttttataccttgccca

SEQ ID NO: 5169 - DNA, 40 bp, Artificial Sequence
  PCR primer for ORF amplification
ggatccagctagcaaaatggcagagataaaacattatcaa

SEQ ID NO: 5170 - DNA, 40 bp, Artificial Sequence
  PCR primer for ORF amplification
ggatccagctagcaaaatgttgctatatttatatatttta

SEQ ID NO: 5171 - DNA, 40 bp, Artificial Sequence
  PCR primer for ORF amplification
ggatccagctagcaaaatgaataaatatctatttgaccat

SEQ ID NO: 5172 - DNA, 40 bp, Artificial Sequence
  PCR primer for ORF amplification
ggatccagctagcaaaatgatcgcccaaagtaccagatta

SEQ ID NO: 5173 - DNA, 40 bp, Artificial Sequence
  PCR primer for ORF amplification
ggatccagctagcaaaatggcgcctccaaccaccatccgc

SEQ ID NO: 5174 - DNA, 40 bp, Artificial Sequence
  PCR primer for ORF amplification
ggatccagctagcaaaatgtggagatcttatcttgttttt

SEQ ID NO: 5175 - DNA, 40 bp, Artificial Sequence
  PCR primer for ORF amplification
ggatccagctagcaaaatgaaccgttttgtaattatttgc

SEQ ID NO: 5176 - DNA, 40 bp, Artificial Sequence
  PCR primer for ORF amplification
ggatccagctagcaaaatgaatccacgctacaggtttata

SEQ ID NO: 5177 - DNA, 40 bp, Artificial Sequence
  PCR primer for ORF amplification
ggatccagctagcaaaatgacaaagaatttcatcgtcact

SEQ ID NO: 5178 - DNA, 40 bp, Artificial Sequence
  PCR primer for ORF amplification
ggatccagctagcaaaatgagccaacaacaaggttactac

SEQ ID NO: 5179 - DNA, 40 bp, Artificial Sequence
  PCR primer for ORF amplification
ggatccagctagcaaaatgccaattataggggtgccgagg

SEQ ID NO: 5180 - DNA, 40 bp, Artificial Sequence
  PCR primer for ORF amplification
ggatccagctagcaaaatggaagcggaaaaacaatctgat

SEQ ID NO: 5181 - DNA, 40 bp, Artificial Sequence
  PCR primer for ORF amplification
ggatccagctagcaaaatgagtactgaaaaactggaagct

SEQ ID NO: 5182 - DNA, 40 bp, Artificial Sequence
  PCR primer for ORF amplification
ggatccagctagcaaaatgatctttgaatgtacatccttt

SEQ ID NO: 5183 - DNA, 40 bp, Artificial Sequence
  PCR primer for ORF amplification
ggatccagctagcaaaatgcaattagtattagcagctaaa

SEQ ID NO: 5184 - DNA, 40 bp, Artificial Sequence
  PCR primer for ORF amplification
ggatccagctagcaaaatggagatgctcttgtttctgaac

SEQ ID NO: 5185 - DNA, 40 bp, Artificial Sequence
  PCR primer for ORF amplification
ggatccagctagcaaaatgctggcgaaaacgggcgatgta

SEQ ID NO: 5186 - DNA, 40 bp, Artificial Sequence
  PCR primer for ORF amplification
ggatccagctagcaaaatggcatttgaaagacaaggaaag

SEQ ID NO: 5187 - DNA, 40 bp, Artificial Sequence
  PCR primer for ORF amplification
ggatccagctagcaaaatggctgtagatgttcctcgtgcg

SEQ ID NO: 5188 - DNA, 40 bp, Artificial Sequence
  PCR primer for ORF amplification
ggatccagctagcaaaatggtttctacccctgaactgaag

SEQ ID NO: 5189 - DNA, 40 bp, Artificial Sequence
  PCR primer for ORF amplification
ggatccagctagcaaaatgatgataataatatttatagaa

SEQ ID NO: 5190 - DNA, 40 bp, Artificial Sequence
  PCR primer for ORF amplification
ggatccagctagcaaaatgagcactgccttcagaaaaata

SEQ ID NO: 5191 - DNA, 40 bp, Artificial Sequence
  PCR primer for ORF amplification
ggatccagctagcaaaatgcaggcaaaccattccgtcagt

SEQ ID NO: 5192 - DNA, 40 bp, Artificial Sequence
  PCR primer for ORF amplification
ggatccagctagcaaaatggctagagaaatcaccgacatc

SEQ ID NO: 5193 - DNA, 40 bp, Artificial Sequence
  PCR primer for ORF amplification
ggatccagctagcaaaatgtcacagaacaacacaatcagc

SEQ ID NO: 5194 - DNA, 40 bp, Artificial Sequence
  PCR primer for ORF amplification
ggatccagctagcaaaatgttgtgccaacagatgattaga

SEQ ID NO: 5195 - DNA, 40 bp, Artificial Sequence
  PCR primer for ORF amplification
ggatccagctagcaaaatgaaaatgaacccttgtactgtt

SEQ ID NO: 5196 - DNA, 40 bp, Artificial Sequence
  PCR primer for ORF amplification
ggatccagctagcaaaatgcaaatcaaaaacattgtcgct

SEQ ID NO: 5197 - DNA, 40 bp, Artificial Sequence
  PCR primer for ORF amplification
ggatccagctagcaaaatgcacgcccgcgactggttttta

SEQ ID NO: 5198 - DNA, 40 bp, Artificial Sequence
  PCR primer for ORF amplification
ggatccagctagcaaaatgcctaagagattaagtgggtta

SEQ ID NO: 5199 - DNA, 40 bp, Artificial Sequence
  PCR primer for ORF amplification
ggatccagctagcaaaatgtctaacatgatgaataagttc

SEQ ID NO: 5200 - DNA, 40 bp, Artificial Sequence
  PCR primer for ORF amplification
ggatccagctagcaaaatgaacacacaagaactatgtaag

SEQ ID NO: 5201 - DNA, 40 bp, Artificial Sequence
  PCR primer for ORF amplification
ggatccagctagcaaaatgacacaacataaaagctcgatg

SEQ ID NO: 5202 - DNA, 40 bp, Artificial Sequence
  PCR primer for ORF amplification
ggatccagctagcaaaatggatagcggaaagagtgatata

SEQ ID NO: 5203 - DNA, 40 bp, Artificial Sequence
  PCR primer for ORF amplification
ggatccagctagcaaaatggctagagctagtgaaaaaggt

SEQ ID NO: 5204 - DNA, 40 bp, Artificial Sequence
  PCR primer for ORF amplification
ggatccagctagcaaaatgtctaataaagagataacttgt

SEQ ID NO: 5205 - DNA, 40 bp, Artificial Sequence
  PCR primer for ORF amplification
ggatccagctagcaaaatgttatctaaagaagcgttaata

SEQ ID NO: 5206 - DNA, 40 bp, Artificial Sequence
  PCR primer for ORF amplification
ggatccagctagcaaaatgtcaacatatgacgaaatcgaa

SEQ ID NO: 5207 - DNA, 40 bp, Artificial Sequence
  PCR primer for ORF amplification
ggatccagctagcaaaatgtcaagcccaactcctccaggt

SEQ ID NO: 5208 - DNA, 40 bp, Artificial Sequence
  PCR primer for ORF amplification
ggatccagctagcaaaatggctgatcaagaaaactctcca

SEQ ID NO: 5209 - DNA, 40 bp, Artificial Sequence
  PCR primer for ORF amplification
ggatccagctagcaaaatgacgagaacaaacaagtggacc

SEQ ID NO: 5210 - DNA, 40 bp, Artificial Sequence
  PCR primer for ORF amplification
ggatccagctagcaaaatgcacggcacttgcctcagcggt

SEQ ID NO: 5211 - DNA, 40 bp, Artificial Sequence
  PCR primer for ORF amplification
ggatccagctagcaaaatggacgatttccttgaacatttg

SEQ ID NO: 5212 - DNA, 40 bp, Artificial Sequence
  PCR primer for ORF amplification
ggatccagctagcaaaatggccagcagtacttccacttcc

SEQ ID NO: 5213 - DNA, 40 bp, Artificial Sequence; identical to SEQ ID NO: 5073
  PCR primer for ORF amplification

SEQ ID NO: 5214 - DNA, 40 bp, Artificial Sequence
  PCR primer for ORF amplification
ggatccagctagcaaaatgcctcaaaaaccacttaaagtt

SEQ ID NO: 5215 - DNA, 40 bp, Artificial Sequence
  PCR primer for ORF amplification
ggatccagctagcaaaatggttttgaatccgtccaagtac

SEQ ID NO: 5216 - DNA, 40 bp, Artificial Sequence
  PCR primer for ORF amplification
ggatccagctagcaaaatgtcagcggagaacattagtact

SEQ ID NO: 5217 - DNA, 40 bp, Artificial Sequence
  PCR primer for ORF amplification
ggatccagctagcaaaatgtcatctgctctatacaaacaa

SEQ ID NO: 5218 - DNA, 40 bp, Artificial Sequence
  PCR primer for ORF amplification
ggatccagctagcaaaatgttaccacgttcagcattagca

SEQ ID NO: 5219 - DNA, 40 bp, Artificial Sequence
  PCR primer for ORF amplification
ggatccagctagcaaaatgttccttcctataatttttcac

SEQ ID NO: 5220 - DNA, 40 bp, Artificial Sequence
  PCR primer for ORF amplification
ggatccagctagcaaaatgaccagaactagcaaatggaca

SEQ ID NO: 5221 - DNA, 40 bp, Artificial Sequence
  PCR primer for ORF amplification
ggatccagctagcaaaatgagcgagagcagtgatatcagc

SEQ ID NO: 5222 - DNA, 40 bp, Artificial Sequence
  PCR primer for ORF amplification
ggatccagctagcaaaatgcctccaagaagtatagaagaa

SEQ ID NO: 5223 - DNA, 40 bp, Artificial Sequence
  PCR primer for ORF amplification
ggatccagctagcaaaatggggaatataatgtcagctagt

SEQ ID NO: 5224 - DNA, 40 bp, Artificial Sequence
  PCR primer for ORF amplification
ggatccagctagcaaaatggtgttttacaaagtcacgttg

SEQ ID NO: 5225 - DNA, 40 bp, Artificial Sequence
  PCR primer for ORF amplification
ggatccagctagcaaaatgtccggaaaagcttctacagag

SEQ ID NO: 5226 - DNA, 40 bp, Artificial Sequence
  PCR primer for ORF amplification
ggatccagctagcaaaatgttaaaccgttgcatttcccgt

SEQ ID NO: 5227 - DNA, 40 bp, Artificial Sequence
  PCR primer for ORF amplification
ggatccagctagcaaaatgcagttacttcgctgtttttca

SEQ ID NO: 5228 - DNA, 40 bp, Artificial Sequence
  PCR primer for ORF amplification
ggatccagctagcaaaatgcatccattagtcgatgaattg

SEQ ID NO: 5229 - DNA, 40 bp, Artificial Sequence
  PCR primer for ORF amplification
ggatccagctagcaaaatggacgcattgaactccaaagaa

SEQ ID NO: 5230 - DNA, 40 bp, Artificial Sequence
  PCR primer for ORF amplification
ggatccagctagcaaaatggcagatagcgaggatacctct

SEQ ID NO: 5231 - DNA, 40 bp, Artificial Sequence
  PCR primer for ORF amplification
ggatccagctagcaaaatggtcgctagccgcgctcgggaa

SEQ ID NO: 5232 - DNA, 40 bp, Artificial Sequence
  PCR primer for ORF amplification
ggatccagctagcaaaatggtttcccaattattcgaagaa

SEQ ID NO: 5233 - DNA, 40 bp, Artificial Sequence
  PCR primer for ORF amplification
ggatccagctagcaaaatgtcactaagaaacatatcaatg

SEQ ID NO: 5234 - DNA, 40 bp, Artificial Sequence
  PCR primer for ORF amplification
ggatccagctagcaaaatgtcttctctatcaacgtctgat

SEQ ID NO: 5235 - DNA, 40 bp, Artificial Sequence
  PCR primer for ORF amplification
ggatccagctagcaaaatggacatcttgaaactgtcagat

SEQ ID NO: 5236 - DNA, 40 bp, Artificial Sequence
  PCR primer for ORF amplification
ggatccagctagcaaaatggcagcttcagttccaccagga

SEQ ID NO: 5237 - DNA, 40 bp, Artificial Sequence
  PCR primer for ORF amplification
ggatccagctagcaaaatgtgtgtgtgtgcgatacccttt

SEQ ID NO: 5238 - DNA, 40 bp, Artificial Sequence
  PCR primer for ORF amplification
ggatccagctagcaaaatgagtacggacgttgctgctgca

SEQ ID NO: 5239 - DNA, 40 bp, Artificial Sequence
  PCR primer for ORF amplification
ggatccagctagcaaaatggagacacctttggatttattg

SEQ ID NO: 5240 - DNA, 40 bp, Artificial Sequence
  PCR primer for ORF amplification
ggatccagctagcaaaatggatacggaagcattggccaat

SEQ ID NO: 5241 - DNA, 40 bp, Artificial Sequence
  PCR primer for ORF amplification
ggatccagctagcaaaatgaatgacgatgaagatagagcc

SEQ ID NO: 5242 - DNA, 40 bp, Artificial Sequence
  PCR primer for ORF amplification
ggatccagctagcaaaatgcaatactgtgaactcgattta

SEQ ID NO: 5243 - DNA, 40 bp, Artificial Sequence
  PCR primer for ORF amplification
ggatccagctagcaaaatgggtgctgcatacaaagtattt

SEQ ID NO: 5244 - DNA, 40 bp, Artificial Sequence
  PCR primer for ORF amplification
ggatccagctagcaaaatgcaaccggcagctagactttta

SEQ ID NO: 5245 - DNA, 40 bp, Artificial Sequence
  PCR primer for ORF amplification
ggatccagctagcaaaatgcaattctctactgtcgcttcc

SEQ ID NO: 5246 - DNA, 40 bp, Artificial Sequence
  PCR primer for ORF amplification
ggatccagctagcaaaatgggtaaaagattttcagaatcc

SEQ ID NO: 5247 - DNA, 40 bp, Artificial Sequence
  PCR primer for ORF amplification
ggatccagctagcaaaatgtctggatacttcaaccatctt

SEQ ID NO: 5248 - DNA, 40 bp, Artificial Sequence
  PCR primer for ORF amplification
ggatccagctagcaaaatgagtctaccggagattttgcct

SEQ ID NO: 5249 - DNA, 40 bp, Artificial Sequence
  PCR primer for ORF amplification
ggatccagctagcaaaatgcataatactggcaagagatac

SEQ ID NO: 5250 - DNA, 40 bp, Artificial Sequence
  PCR primer for ORF amplification
ggatccagctagcaaaatggtcaccccaagagaacctaag

SEQ ID NO: 5251 - DNA, 40 bp, Artificial Sequence
  PCR primer for ORF amplification
ggatccagctagcaaaatgtctttcttaggtttcggtggt

SEQ ID NO: 5252 - DNA, 40 bp, Artificial Sequence
  PCR primer for ORF amplification
ggatccagctagcaaaatgttgagaaccacttttttgcgc

SEQ ID NO: 5253 - DNA, 40 bp, Artificial Sequence
  PCR primer for ORF amplification
ggatccagctagcaaaatgtttttacagactctccgccta

SEQ ID NO: 5254 - DNA, 40 bp, Artificial Sequence
  PCR primer for ORF amplification
ggatccagctagcaaaatgacattagtaagtacccaaatg

SEQ ID NO: 5255 - DNA, 40 bp, Artificial Sequence
  PCR primer for ORF amplification
ggatccagctagcaaaatgaatccttttgcatcgctagaa

SEQ ID NO: 5256 - DNA, 40 bp, Artificial Sequence
  PCR primer for ORF amplification
ggatccagctagcaaaatgatggctagtacatccaatgat

SEQ ID NO: 5257 - DNA, 40 bp, Artificial Sequence
  PCR primer for ORF amplification
ggatccagctagcaaaatgcctggatttacagctccaaca

SEQ ID NO: 5258 - DNA, 40 bp, Artificial Sequence
  PCR primer for ORF amplification
ggatccagctagcaaaatggaacacaatctttcaccttta

SEQ ID NO: 5259 - DNA, 40 bp, Artificial Sequence
  PCR primer for ORF amplification
ggatccagctagcaaaatggaccgatctttgcaagtatat

SEQ ID NO: 5260 - DNA, 40 bp, Artificial Sequence
  PCR primer for ORF amplification
ggatccagctagcaaaatgggtcctccaagcggtaaaact

SEQ ID NO: 5261 - DNA, 40 bp, Artificial Sequence
  PCR primer for ORF amplification
ggatccagctagcaaaatgtcattcatacctattgtatgt

SEQ ID NO: 5262 - DNA, 40 bp, Artificial Sequence
  PCR primer for ORF amplification
ggatccagctagcaaaatgtcgaacaaagttaaaaccaag

SEQ ID NO: 5263 - DNA, 40 bp, Artificial Sequence
  PCR primer for ORF amplification
ggatccagctagcaaaatgtctgagatattacaagatgta

SEQ ID NO: 5264 - DNA, 40 bp, Artificial Sequence
  PCR primer for ORF amplification
ggatccagctagcaaaatgaagttagattcaggaatatac

SEQ ID NO: 5265 - DNA, 40 bp, Artificial Sequence
  PCR primer for ORF amplification
ggatccagctagcaaaatgtccggaaaaccaccagtttat

SEQ ID NO: 5266 - DNA, 40 bp, Artificial Sequence
  PCR primer for ORF amplification
ggatccagctagcaaaatgataccggctctcactcccgaa

SEQ ID NO: 5267 - DNA, 40 bp, Artificial Sequence
  PCR primer for ORF amplification
ggatccagctagcaaaatgtatatcaattttactagtttt

SEQ ID NO: 5268 - DNA, 40 bp, Artificial Sequence
  PCR primer for ORF amplification
ggatccagctagcaaaatgtcgacagttaatgttttgaga

SEQ ID NO: 5269 - DNA, 40 bp, Artificial Sequence
  PCR primer for ORF amplification
ggatccagctagcaaaatgtgccctcgcacagttttgctc

SEQ ID NO: 5270 - DNA, 40 bp, Artificial Sequence
  PCR primer for ORF amplification
ggatccagctagcaaaatggaggaccacacccttgtggcc

SEQ ID NO: 5271 - DNA, 40 bp, Artificial Sequence
  PCR primer for ORF amplification
ggatccagctagcaaaatgtccgaacaagcacaaacacaa

SEQ ID NO: 5272 - DNA, 40 bp, Artificial Sequence
  PCR primer for ORF amplification
ggatccagctagcaaaatgtctaatccatgccagaaggag

SEQ ID NO: 5273 - DNA, 40 bp, Artificial Sequence
  PCR primer for ORF amplification
ggatccagctagcaaaatgaagtcaagtattccaatcacc

SEQ ID NO: 5274 - DNA, 40 bp, Artificial Sequence
  PCR primer for ORF amplification
ggatccagctagcaaaatggcagttagtaataataataat

SEQ ID NO: 5275 - DNA, 40 bp, Artificial Sequence
  PCR primer for ORF amplification
ggatccagctagcaaaatggcggtaagtatcctatcatat

SEQ ID NO: 5276 - DNA, 40 bp, Artificial Sequence
  PCR primer for ORF amplification
ggatccagctagcaaaatgtcagggaacccaggaagctcg

SEQ ID NO: 5277 - DNA, 40 bp, Artificial Sequence
  PCR primer for ORF amplification
ggatccagctagcaaaatgttgattgatttttgctgtagt

SEQ ID NO: 5278 - DNA, 40 bp, Artificial Sequence
  PCR primer for ORF amplification
ggatccagctagcaaaatgaagactgtctattacaaagaa

SEQ ID NO: 5279 - DNA, 40 bp, Artificial Sequence
  PCR primer for ORF amplification
ggatccagctagcaaaatgaccgaagaaactattactata

SEQ ID NO: 5280 - DNA, 40 bp, Artificial Sequence
  PCR primer for ORF amplification
ggatccagctagcaaaatggcccatctctcactaaatcag

SEQ ID NO: 5281 - DNA, 40 bp, Artificial Sequence
  PCR primer for ORF amplification
ggatccagctagcaaaatggccgcaactaaagaagcaaag

SEQ ID NO: 5282 - DNA, 40 bp, Artificial Sequence
  PCR primer for ORF amplification
ggatccagctagcaaaatggtaaacgtgaaagtggagttt

SEQ ID NO: 5283 - DNA, 40 bp, Artificial Sequence
  PCR primer for ORF amplification
ggatccagctagcaaaatgtataaaataactactatatat

SEQ ID NO: 5284 - DNA, 40 bp, Artificial Sequence
  PCR primer for ORF amplification
ggatccagctagcaaaatgtctcaagatttcgttacgtta

SEQ ID NO: 5285 - DNA, 40 bp, Artificial Sequence
  PCR primer for ORF amplification
ggatccagctagcaaaatgttgggaatgataaggtgggta

SEQ ID NO: 5286 - DNA, 40 bp, Artificial Sequence
  PCR primer for ORF amplification
ggatccagctagcaaaatgaaaacattcttcttgattgag

SEQ ID NO: 5287 - DNA, 40 bp, Artificial Sequence
  PCR primer for ORF amplification
ggatccagctagcaaaatgacagataacacaacttccagc

SEQ ID NO: 5288 - DNA, 40 bp, Artificial Sequence
  PCR primer for ORF amplification
ggatccagctagcaaaatgagaggcgaaacaggcgtaagc

SEQ ID NO: 5289 - DNA, 40 bp, Artificial Sequence
  PCR primer for ORF amplification
ggatccagctagcaaaatgagcaatactaagcataccact

SEQ ID NO: 5290 - DNA, 40 bp, Artificial Sequence
  PCR primer for ORF amplification
ggatccagctagcaaaatggttcagtacgctccctttcta

SEQ ID NO: 5291 - DNA, 40 bp, Artificial Sequence
  PCR primer for ORF amplification
ggatccagctagcaaaatgaacaataatgttgaagaactc

SEQ ID NO: 5292 - DNA, 40 bp, Artificial Sequence
  PCR primer for ORF amplification
ggatccagctagcaaaatgaagaacgcagcattgtgtgag

SEQ ID NO: 5293 - DNA, 40 bp, Artificial Sequence
  PCR primer for ORF amplification
ggatccagctagcaaaatgactatgaatggaataccagtg

SEQ ID NO: 5294 - DNA, 40 bp, Artificial Sequence
  PCR primer for ORF amplification
ggatccagctagcaaaatgatttttaaacgtgcagtatct

SEQ ID NO: 5295 - DNA, 40 bp, Artificial Sequence
  PCR primer for ORF amplification
ggatccagctagcaaaatgcaatcgatcagtaattgtccc

SEQ ID NO: 5296 - DNA, 40 bp, Artificial Sequence
  PCR primer for ORF amplification
ggatccagctagcaaaatgctaaaggtggaaaagttcaaa

SEQ ID NO: 5297 - DNA, 40 bp, Artificial Sequence
  PCR primer for ORF amplification
ggatccagctagcaaaatgtcggactcagaagtcaatcaa

SEQ ID NO: 5298 - DNA, 40 bp, Artificial Sequence
  PCR primer for ORF amplification
ggatccagctagcaaaatgattgttaaagtgaagacactg

SEQ ID NO: 5299 - DNA, 40 bp, Artificial Sequence
  PCR primer for ORF amplification
ggatccagctagcaaaatgcgtactttcactgactttgtt

SEQ ID NO: 5300 - DNA, 40 bp, Artificial Sequence; identical to SEQ ID NO: 5299
  PCR primer for ORF amplification

SEQ ID NO: 5301 - DNA, 40 bp, Artificial Sequence
  PCR primer for ORF amplification
ggatccagctagcaaaatgaaattctctactctctccacc

SEQ ID NO: 5302 - DNA, 40 bp, Artificial Sequence
  PCR primer for ORF amplification
ggatccagctagcaaaatggcaggggatagtataagcgct

SEQ ID NO: 5303 - DNA, 40 bp, Artificial Sequence
  PCR primer for ORF amplification
ggatccagctagcaaaatggtggcagttcataaggtcagg

SEQ ID NO: 5304 - DNA, 40 bp, Artificial Sequence
  PCR primer for ORF amplification
ggatccagctagcaaaatgtctagtgaaagagcctgtatg

SEQ ID NO: 5305 - DNA, 40 bp, Artificial Sequence
  PCR primer for ORF amplification
ggatccagctagcaaaatgtccggtagaggtaaaggtggt

SEQ ID NO: 5306 - DNA, 40 bp, Artificial Sequence; identical to SEQ ID NO: 5305
  PCR primer for ORF amplification

SEQ ID NO: 5307 - DNA, 40 bp, Artificial Sequence
  PCR primer for ORF amplification
ggatccagctagcaaaatgaattcaagtctgaatgccaat

SEQ ID NO: 5308 - DNA, 40 bp, Artificial Sequence
  PCR primer for ORF amplification
ggatccagctagcaaaatggttactcaattcaaaactgcc

SEQ ID NO: 5309 - DNA, 40 bp, Artificial Sequence
  PCR primer for ORF amplification
ggatccagctagcaaaatgcaaaattcccaagactacttt

SEQ ID NO: 5310 - DNA, 40 bp, Artificial Sequence
  PCR primer for ORF amplification
ggatccagctagcaaaatgcccaagatcttttgtttagcg

SEQ ID NO: 5311 - DNA, 40 bp, Artificial Sequence
  PCR primer for ORF amplification
ggatccagctagcaaaatggaagatacctcgaggtgcatc

SEQ ID NO: 5312 - DNA, 40 bp, Artificial Sequence
  PCR primer for ORF amplification
ggatccagctagcaaaatggacattgacatgaactatccc

SEQ ID NO: 5313 - DNA, 40 bp, Artificial Sequence
  PCR primer for ORF amplification
ggatccagctagcaaaatgggcttattttcatttgatggt

SEQ ID NO: 5314 - DNA, 40 bp, Artificial Sequence
  PCR primer for ORF amplification
ggatccagctagcaaaatggtcactcaattaaaatccgct

SEQ ID NO: 5315 - DNA, 40 bp, Artificial Sequence
  PCR primer for ORF amplification
ggatccagctagcaaaatgttaaggagggaaacttcaaca

SEQ ID NO: 5316 - DNA, 40 bp, Artificial Sequence
  PCR primer for ORF amplification
ggatccagctagcaaaatgatggacttgggcgacaaaata

SEQ ID NO: 5317 - DNA, 40 bp, Artificial Sequence
  PCR primer for ORF amplification
ggatccagctagcaaaatgcaagttctcatcggaacgaaa

SEQ ID NO: 5318 - DNA, 40 bp, Artificial Sequence
  PCR primer for ORF amplification
ggatccagctagcaaaatgccactatttgcaaggctctgc

SEQ ID NO: 5319 - DNA, 40 bp, Artificial Sequence
  PCR primer for ORF amplification
ggatccagctagcaaaatggaacatccagcatatacattg

SEQ ID NO: 5320 - DNA, 40 bp, Artificial Sequence
  PCR primer for ORF amplification
ggatccagctagcaaaatgggtctatcatctatctttggc

SEQ ID NO: 5321 - DNA, 40 bp, Artificial Sequence
  PCR primer for ORF amplification
ggatccagctagcaaaatgtccaagagtaatacttatagg

SEQ ID NO: 5322 - DNA, 40 bp, Artificial Sequence
  PCR primer for ORF amplification
ggatccagctagcaaaatgttggcgcgcagtttgggttac

SEQ ID NO: 5323 - DNA, 40 bp, Artificial Sequence
  PCR primer for ORF amplification
ggatccagctagcaaaatgaagtacttagctgcttaccta

SEQ ID NO: 5324 - DNA, 40 bp, Artificial Sequence
  PCR primer for ORF amplification
ggatccagctagcaaaatggcacccacacaattggatata

SEQ ID NO: 5325 - DNA, 40 bp, Artificial Sequence
  PCR primer for ORF amplification
ggatccagctagcaaaatggccaaatcattacgtgctagc

SEQ ID NO: 5326 - DNA, 40 bp, Artificial Sequence
  PCR primer for ORF amplification
ggatccagctagcaaaatgtccacccttttgaagtctgct

SEQ ID NO: 5327 - DNA, 40 bp, Artificial Sequence
  PCR primer for ORF amplification
ggatccagctagcaaaatgtcgaaattgggtccgttagca

SEQ ID NO: 5328 - DNA, 40 bp, Artificial Sequence
  PCR primer for ORF amplification
ggatccagctagcaaaatgtctactgaatccgctttgtct

SEQ ID NO: 5329 - DNA, 40 bp, Artificial Sequence
  PCR primer for ORF amplification
ggatccagctagcaaaatgagtagggctagcaagataacg

SEQ ID NO: 5330 - DNA, 40 bp, Artificial Sequence
  PCR primer for ORF amplification
ggatccagctagcaaaatggtaaacttagctaacgtttta

SEQ ID NO: 5331 - DNA, 40 bp, Artificial Sequence
  PCR primer for ORF amplification
ggatccagctagcaaaatgtcccgccatcagtttgatcta

SEQ ID NO: 5332 - DNA, 40 bp, Artificial Sequence
  PCR primer for ORF amplification
ggatccagctagcaaaatgcctccaaagcaacaattatct

SEQ ID NO: 5333 - DNA, 40 bp, Artificial Sequence
  PCR primer for ORF amplification
ggatccagctagcaaaatgcctccaaagcaacaattgtct

SEQ ID NO: 5334 - DNA, 40 bp, Artificial Sequence
  PCR primer for ORF amplification
ggatccagctagcaaaatgaatactaataagatagcacaa

SEQ ID NO: 5335 - DNA, 40 bp, Artificial Sequence
  PCR primer for ORF amplification
ggatccagctagcaaaatgagctcaaatgaagaggtattt

SEQ ID NO: 5336 - DNA, 40 bp, Artificial Sequence
  PCR primer for ORF amplification
ggatccagctagcaaaatggatatgcttcataataaatgt

SEQ ID NO: 5337 - DNA, 40 bp, Artificial Sequence
  PCR primer for ORF amplification
ggatccagctagcaaaatggtagctagttgtaaagatcag

SEQ ID NO: 5338 - DNA, 40 bp, Artificial Sequence
  PCR primer for ORF amplification
ggatccagctagcaaaatgtccattgagaatctgaaatca

SEQ ID NO: 5339 - DNA, 40 bp, Artificial Sequence
  PCR primer for ORF amplification
ggatccagctagcaaaatgactgaattcaaggccggttct

SEQ ID NO: 5340 - DNA, 40 bp, Artificial Sequence
  PCR primer for ORF amplification
ggatccagctagcaaaatgtcacagatagcacaagaaatg

SEQ ID NO: 5341 - DNA, 40 bp, Artificial Sequence
  PCR primer for ORF amplification
ggatccagctagcaaaatgtcagccaccttgaaagactac

SEQ ID NO: 5342 - DNA, 40 bp, Artificial Sequence
  PCR primer for ORF amplification
ggatccagctagcaaaatgtcgttctttttaaatagtcta

SEQ ID NO: 5343 - DNA, 40 bp, Artificial Sequence
  PCR primer for ORF amplification
ggatccagctagcaaaatgtctgacgcaggtagaaaagga

SEQ ID NO: 5344 - DNA, 40 bp, Artificial Sequence
  PCR primer for ORF amplification
ggatccagctagcaaaatgtctgcctttgttactaaagct

SEQ ID NO: 5345 - DNA, 40 bp, Artificial Sequence
  PCR primer for ORF amplification
ggatccagctagcaaaatgaaatacttagctgcttactta

SEQ ID NO: 5346 - DNA, 40 bp, Artificial Sequence
  PCR primer for ORF amplification
ggatccagctagcaaaatgaacgtaccaaaggcgagactc

SEQ ID NO: 5347 - DNA, 40 bp, Artificial Sequence
  PCR primer for ORF amplification
ggatccagctagcaaaatgacatcagttcaaaactctcca

SEQ ID NO: 5348 - DNA, 40 bp, Artificial Sequence
  PCR primer for ORF amplification
ggatccagctagcaaaatgaccaaagatgccgtgaatcta

SEQ ID NO: 5349 - DNA, 40 bp, Artificial Sequence
  PCR primer for ORF amplification
ggatccagctagcaaaatgctttcgttttgtccttcgtgt

SEQ ID NO: 5350 - DNA, 40 bp, Artificial Sequence
  PCR primer for ORF amplification
ggatccagctagcaaaatggtatctcaagaaactatcaag

SEQ ID NO: 5351 - DNA, 40 bp, Artificial Sequence
  PCR primer for ORF amplification
ggatccagctagcaaaatgttcaagagagcaatgagcaca

SEQ ID NO: 5352 - DNA, 40 bp, Artificial Sequence
  PCR primer for ORF amplification
ggatccagctagcaaaatgtttatcttagtatccgttgta

SEQ ID NO: 5353 - DNA, 40 bp, Artificial Sequence
  PCR primer for ORF amplification
ggatccagctagcaaaatgagccaatttgaaaagcagaag

SEQ ID NO: 5354 - DNA, 40 bp, Artificial Sequence
  PCR primer for ORF amplification
ggatccagctagcaaaatgctaggaagggcattgcgacct

SEQ ID NO: 5355 - DNA, 40 bp, Artificial Sequence
  PCR primer for ORF amplification
ggatccagctagcaaaatggagcaaaacaaagatccgcag

SEQ ID NO: 5356 - DNA, 40 bp, Artificial Sequence
  PCR primer for ORF amplification
ggatccagctagcaaaatggccctgtggggtagaagtgcc

SEQ ID NO: 5357 - DNA, 40 bp, Artificial Sequence
  PCR primer for ORF amplification
ggatccagctagcaaaatgggtctatttaataacttcaag

SEQ ID NO: 5358 - DNA, 40 bp, Artificial Sequence
  PCR primer for ORF amplification
ggatccagctagcaaaatggttgaaccagcaaggaaaaag

SEQ ID NO: 5359 - DNA, 40 bp, Artificial Sequence
  PCR primer for ORF amplification
ggatccagctagcaaaatgtctactgtaaccaaatacttt

SEQ ID NO: 5360 - DNA, 40 bp, Artificial Sequence
  PCR primer for ORF amplification
ggatccagctagcaaaatggattggctgaaaaatacaaca

SEQ ID NO: 5361 - DNA, 40 bp, Artificial Sequence
  PCR primer for ORF amplification
ggatccagctagcaaaatgtatctcagtgcccagcttatg

SEQ ID NO: 5362 - DNA, 40 bp, Artificial Sequence
  PCR primer for ORF amplification
ggatccagctagcaaaatgacaagcaaacgggaaaagtca

SEQ ID NO: 5363 - DNA, 40 bp, Artificial Sequence
  PCR primer for ORF amplification
ggatccagctagcaaaatgacagaggttgtgggattctgg

SEQ ID NO: 5364 - DNA, 40 bp, Artificial Sequence
  PCR primer for ORF amplification
ggatccagctagcaaaatgactgatgagctgaaaagttat

SEQ ID NO: 5365 - DNA, 40 bp, Artificial Sequence
  PCR primer for ORF amplification
ggatccagctagcaaaatgcctcctcttccacaaaattat

SEQ ID NO: 5366 - DNA, 40 bp, Artificial Sequence
  PCR primer for ORF amplification
ggatccagctagcaaaatggctaaagaaagtacgggattc

SEQ ID NO: 5367 - DNA, 40 bp, Artificial Sequence
  PCR primer for ORF amplification
ggatccagctagcaaaatgggagaacaaaacaaattgtac

SEQ ID NO: 5368 - DNA, 40 bp, Artificial Sequence
  PCR primer for ORF amplification
ggatccagctagcaaaatgggcaagtgtagcatgaaaaag

SEQ ID NO: 5369 - DNA, 40 bp, Artificial Sequence
  PCR primer for ORF amplification
ggatccagctagcaaaatgtctgaaattcaaaacaaagct

SEQ ID NO: 5370 - DNA, 40 bp, Artificial Sequence; identical to SEQ ID NO: 5151
  PCR primer for ORF amplification

SEQ ID NO: 5371 - DNA, 40 bp, Artificial Sequence
  PCR primer for ORF amplification
ggatccagctagcaaaatgaaggccagttacttagttttg

SEQ ID NO: 5372 - DNA, 40 bp, Artificial Sequence
  PCR primer for ORF amplification
ggatccagctagcaaaatgagcgcgagtgacaaaacaaag

SEQ ID NO: 5373 - DNA, 40 bp, Artificial Sequence
  PCR primer for ORF amplification
ggatccagctagcaaaatgctttttgaagtatttggtgaa

SEQ ID NO: 5374 - DNA, 40 bp, Artificial Sequence
  PCR primer for ORF amplification
ggatccagctagcaaaatgggcttatcgcgctggcacgac

SEQ ID NO: 5375 - DNA, 40 bp, Artificial Sequence
  PCR primer for ORF amplification
ggatccagctagcaaaatgtctgaagtaattgaaggtaac

SEQ ID NO: 5376 - DNA, 40 bp, Artificial Sequence
  PCR primer for ORF amplification
ggatccagctagcaaaatgtctgaattaggtgccaaatat

SEQ ID NO: 5377 - DNA, 40 bp, Artificial Sequence
  PCR primer for ORF amplification
ggatccagctagcaaaatgttgagagcgttccgctgttct

SEQ ID NO: 5378 - DNA, 40 bp, Artificial Sequence
  PCR primer for ORF amplification
ggatccagctagcaaaatgaaaattagcttgcataacaaa

SEQ ID NO: 5379 - DNA, 40 bp, Artificial Sequence
  PCR primer for ORF amplification
ggatccagctagcaaaatgctaagcaggatccaaaattat

SEQ ID NO: 5380 - DNA, 40 bp, Artificial Sequence
  PCR primer for ORF amplification
ggatccagctagcaaaatgggtaatttcagatttcctata

SEQ ID NO: 5381 - DNA, 40 bp, Artificial Sequence
  PCR primer for ORF amplification
ggatccagctagcaaaatgggtagtttttgggacgcattc

SEQ ID NO: 5382 - DNA, 40 bp, Artificial Sequence
  PCR primer for ORF amplification
ggatccagctagcaaaatgtcgtcatcagtgccatacgat

SEQ ID NO: 5383 - DNA, 40 bp, Artificial Sequence
  PCR primer for ORF amplification
ggatccagctagcaaaatgatcgaaactgccatttatggt

SEQ ID NO: 5384 - DNA, 40 bp, Artificial Sequence
  PCR primer for ORF amplification
ggatccagctagcaaaatgcgctgggatgttatcatctta

SEQ ID NO: 5385 - DNA, 40 bp, Artificial Sequence
  PCR primer for ORF amplification
ggatccagctagcaaaatgtcccaagaaagtagtgtttta

SEQ ID NO: 5386 - DNA, 40 bp, Artificial Sequence
  PCR primer for ORF amplification
ggatccagctagcaaaatgttactcacaccagccaagact

SEQ ID NO: 5387 - DNA, 40 bp, Artificial Sequence
  PCR primer for ORF amplification
ggatccagctagcaaaatgaagtctacatttaagtctgaa

SEQ ID NO: 5388 - DNA, 40 bp, Artificial Sequence
  PCR primer for ORF amplification
ggatccagctagcaaaatggatggatcgactatagtgttt

SEQ ID NO: 5389 - DNA, 40 bp, Artificial Sequence
  PCR primer for ORF amplification
ggatccagctagcaaaatgaagctcccacagaccatgcta

SEQ ID NO: 5390 - DNA, 40 bp, Artificial Sequence
  PCR primer for ORF amplification
ggatccagctagcaaaatgagacccgttgtatccactggt

SEQ ID NO: 5391 - DNA, 40 bp, Artificial Sequence
  PCR primer for ORF amplification
ggatccagctagcaaaatgagtaatattttggcagtgttc

SEQ ID NO: 5392 - DNA, 40 bp, Artificial Sequence
  PCR primer for ORF amplification
ggatccagctagcaaaatgcagacaatgggcggggagcac

SEQ ID NO: 5393 - DNA, 40 bp, Artificial Sequence
  PCR primer for ORF amplification
ggatccagctagcaaaatgcagcacacgcttacccggacc

SEQ ID NO: 5394 - DNA, 40 bp, Artificial Sequence
  PCR primer for ORF amplification
ggatccagctagcaaaatggctgagaaacgtactcttata

SEQ ID NO: 5395 - DNA, 40 bp, Artificial Sequence
  PCR primer for ORF amplification
ggatccagctagcaaaatgtcgttcagcggaaaaaaattt

SEQ ID NO: 5396 - DNA, 40 bp, Artificial Sequence
  PCR primer for ORF amplification
ggatccagctagcaaaatgaaaaatattgcatacgaaggt

SEQ ID NO: 5397 - DNA, 40 bp, Artificial Sequence
  PCR primer for ORF amplification
ggatccagctagcaaaatgccaaaaaagagagcttccaac

SEQ ID NO: 5398 - DNA, 40 bp, Artificial Sequence
  PCR primer for ORF amplification
ggatccagctagcaaaatgccaaagaagagagcttccaac

SEQ ID NO: 5399 - DNA, 40 bp, Artificial Sequence
  PCR primer for ORF amplification
ggatccagctagcaaaatgcgcagcatagaaaacgataga

SEQ ID NO: 5400 - DNA, 40 bp, Artificial Sequence
  PCR primer for ORF amplification
ggatccagctagcaaaatggaaaaaaaaaaaattttagac

SEQ ID NO: 5401 - DNA, 40 bp, Artificial Sequence
  PCR primer for ORF amplification
ggatccagctagcaaaatgaactatttggaaacacagtta

SEQ ID NO: 5402 - DNA, 40 bp, Artificial Sequence
  PCR primer for ORF amplification
ggatccagctagcaaaatgagaccagcacagttactgttg

SEQ ID NO: 5403 - DNA, 40 bp, Artificial Sequence
  PCR primer for ORF amplification
ggatccagctagcaaaatggtcaaactaacttcaatcgcc

SEQ ID NO: 5404 - DNA, 40 bp, Artificial Sequence
  PCR primer for ORF amplification
ggatccagctagcaaaatggtcaaactaacttcaatcgct

SEQ ID NO: 5405 - DNA, 40 bp, Artificial Sequence
  PCR primer for ORF amplification
ggatccagctagcaaaatggtcaaattaacttcaatcgcc

SEQ ID NO: 5406 - DNA, 40 bp, Artificial Sequence; identical to SEQ ID NO: 5082
  PCR primer for ORF amplification

SEQ ID NO: 5407 - DNA, 40 bp, Artificial Sequence; identical to SEQ ID NO: 5082
  PCR primer for ORF amplification

SEQ ID NO: 5408 - DNA, 40 bp, Artificial Sequence; identical to SEQ ID NO: 5082
  PCR primer for ORF amplification

SEQ ID NO: 5409 - DNA, 40 bp, Artificial Sequence
  PCR primer for ORF amplification
ggatccagctagcaaaatggtcaaattaacttcaattgcc

SEQ ID NO: 5410 - DNA, 40 bp, Artificial Sequence
  PCR primer for ORF amplification
ggatccagctagcaaaatgaaattcatttctacctttctc

SEQ ID NO: 5411 - DNA, 40 bp, Artificial Sequence
  PCR primer for ORF amplification
ggatccagctagcaaaatgaatgctccagacagattcgaa

SEQ ID NO: 5412 - DNA, 40 bp, Artificial Sequence
  PCR primer for ORF amplification
ggatccagctagcaaaatgacaggtgaaagaattgaaaag

SEQ ID NO: 5413 - DNA, 40 bp, Artificial Sequence
  PCR primer for ORF amplification
ggatccagctagcaaaatgcacaacaagattgttagaatc

SEQ ID NO: 5414 - DNA, 40 bp, Artificial Sequence
  PCR primer for ORF amplification
ggatccagctagcaaaatgcctaaagtttacagttaccaa

SEQ ID NO: 5415 - DNA, 40 bp, Artificial Sequence
  PCR primer for ORF amplification
ggatccagctagcaaaatggtgaatgaaacaggagaaagt

SEQ ID NO: 5416 - DNA, 40 bp, Artificial Sequence
  PCR primer for ORF amplification
ggatccagctagcaaaatgacctgtggtctagtacgaata

SEQ ID NO: 5417 - DNA, 40 bp, Artificial Sequence
  PCR primer for ORF amplification
ggatccagctagcaaaatgagcaaccaggcactatatgag

SEQ ID NO: 5418 - DNA, 40 bp, Artificial Sequence
  PCR primer for ORF amplification
ggatccagctagcaaaatgagcaacgaagttgacaggatg

SEQ ID NO: 5419 - DNA, 40 bp, Artificial Sequence
  PCR primer for ORF amplification
ggatccagctagcaaaatgtccactaagttgcctattgtg

SEQ ID NO: 5420 - DNA, 40 bp, Artificial Sequence
  PCR primer for ORF amplification
ggatccagctagcaaaatgtctgactttcaaaaggaaaag

SEQ ID NO: 5421 - DNA, 40 bp, Artificial Sequence
  PCR primer for ORF amplification
ggatccagctagcaaaatgtctgatattttggatgagatt

SEQ ID NO: 5422 - DNA, 40 bp, Artificial Sequence
  PCR primer for ORF amplification
ggatccagctagcaaaatgaaagtttccgataggcgtaag

SEQ ID NO: 5423 - DNA, 40 bp, Artificial Sequence; identical to SEQ ID NO: 5422
  PCR primer for ORF amplification

SEQ ID NO: 5424 - DNA, 40 bp, Artificial Sequence; identical to SEQ ID NO: 5405
  PCR primer for ORF amplification

SEQ ID NO: 5425 - DNA, 40 bp, Artificial Sequence
  PCR primer for ORF amplification
ggatccagctagcaaaatgactacgtttagattttgtcgt

SEQ ID NO: 5426 - DNA, 40 bp, Artificial Sequence
  PCR primer for ORF amplification
ggatccagctagcaaaatgcaagacaactcaagtcattcc

SEQ ID NO: 5427 - DNA, 40 bp, Artificial Sequence
  PCR primer for ORF amplification
ggatccagctagcaaaatggcagtacccgggtattacgaa

SEQ ID NO: 5428 - DNA, 40 bp, Artificial Sequence
  PCR primer for ORF amplification
ggatccagctagcaaaatggccaatttttttgttagactg

SEQ ID NO: 5429 - DNA, 40 bp, Artificial Sequence
  PCR primer for ORF amplification
ggatccagctagcaaaatggccagcgaaacaccaagagtt

SEQ ID NO: 5430 - DNA, 40 bp, Artificial Sequence
  PCR primer for ORF amplification
ggatccagctagcaaaatgggtgaaatgctagagaggcaa

SEQ ID NO: 5431 - DNA, 40 bp, Artificial Sequence
  PCR primer for ORF amplification
ggatccagctagcaaaatgttccttacattctcaatgtgt

SEQ ID NO: 5432 - DNA, 40 bp, Artificial Sequence; identical to SEQ ID NO: 5082
  PCR primer for ORF amplification

SEQ ID NO: 5433 - DNA, 40 bp, Artificial Sequence
  PCR primer for ORF amplification
ggatccagctagcaaaatgaaactaccggtagcacagtac

SEQ ID NO: 5434 - DNA, 40 bp, Artificial Sequence
  PCR primer for ORF amplification
ggatccagctagcaaaatgaacgtaactgaaaatgctcta

SEQ ID NO: 5435 - DNA, 40 bp, Artificial Sequence
  PCR primer for ORF amplification
ggatccagctagcaaaatgagcacgagaacaaaggccctg

SEQ ID NO: 5436 - DNA, 40 bp, Artificial Sequence
  PCR primer for ORF amplification
ggatccagctagcaaaatgatgggacgaaacggtattcgg

SEQ ID NO: 5437 - DNA, 40 bp, Artificial Sequence
  PCR primer for ORF amplification
ggatccagctagcaaaatgattgctacacctataagatta

SEQ ID NO: 5438 - DNA, 40 bp, Artificial Sequence
  PCR primer for ORF amplification
ggatccagctagcaaaatggatcaaaagaaggacccaagt

SEQ ID NO: 5439 - DNA, 40 bp, Artificial Sequence
  PCR primer for ORF amplification
ggatccagctagcaaaatgtcttggaggtactctatcttg

SEQ ID NO: 5440 - DNA, 40 bp, Artificial Sequence
  PCR primer for ORF amplification
ggatccagctagcaaaatggtcaaactaacttcaattgtt

SEQ ID NO: 5441 - DNA, 40 bp, Artificial Sequence; identical to SEQ ID NO: 5082
  PCR primer for ORF amplification

SEQ ID NO: 5442 - DNA, 40 bp, Artificial Sequence; identical to SEQ ID NO: 5082
  PCR primer for ORF amplification

SEQ ID NO: 5443 - DNA, 40 bp, Artificial Sequence; identical to SEQ ID NO: 5082
  PCR primer for ORF amplification

SEQ ID NO: 5444 - DNA, 40 bp, Artificial Sequence
  PCR primer for ORF amplification
ggatccagctagcaaaatggtcaaattaacttcaattgct

SEQ ID NO: 5445 - DNA, 40 bp, Artificial Sequence
  PCR primer for ORF amplification
ggatccagctagcaaaatgatcagaagggcccctaccacc

SEQ ID NO: 5446 - DNA, 40 bp, Artificial Sequence
  PCR primer for ORF amplification
ggatccagctagcaaaatgcgaccacatcattttttttgt

SEQ ID NO: 5447 - DNA, 40 bp, Artificial Sequence
  PCR primer for ORF amplification
ggatccagctagcaaaatgcgagattcccctacccacaag

SEQ ID NO: 5448 - DNA, 40 bp, Artificial Sequence
  PCR primer for ORF amplification
ggatccagctagcaaaatgttccctatcgcttccagaaga

SEQ ID NO: 5449 - DNA, 40 bp, Artificial Sequence
  PCR primer for ORF amplification
ggatccagctagcaaaatgcctagtaaagatccagagagc

SEQ ID NO: 5450 - DNA, 40 bp, Artificial Sequence
  PCR primer for ORF amplification
ggatccagctagcaaaatggttctaaccgatgccgaagaa

SEQ ID NO: 5451 - DNA, 40 bp, Artificial Sequence
  PCR primer for ORF amplification
ggatccagctagcaaaatgtctctcgactttaacactttg

SEQ ID NO: 5452 - DNA, 40 bp, Artificial Sequence
  PCR primer for ORF amplification
ggatccagctagcaaaatgtctgttgtaggatcgttaatt

SEQ ID NO: 5453 - DNA, 40 bp, Artificial Sequence
  PCR primer for ORF amplification
ggatccagctagcaaaatgtttagatccgtttgccgcatt

SEQ ID NO: 5454 - DNA, 40 bp, Artificial Sequence
  PCR primer for ORF amplification
ggatccagctagcaaaatggtacagctgagaagaacgtat

SEQ ID NO: 5455 - DNA, 40 bp, Artificial Sequence
  PCR primer for ORF amplification
ggatccagctagcaaaatggtatgttacgttctattgcgc

SEQ ID NO: 5456 - DNA, 40 bp, Artificial Sequence
  PCR primer for ORF amplification
ggatccagctagcaaaatgacaggttactttttaccacca

SEQ ID NO: 5457 - DNA, 40 bp, Artificial Sequence
  PCR primer for ORF amplification
ggatccagctagcaaaatgagtatgcagattgaaataaag

SEQ ID NO: 5458 - DNA, 40 bp, Artificial Sequence
  PCR primer for ORF amplification
ggatccagctagcaaaatggcaggtgaagcagtttcggaa

SEQ ID NO: 5459 - DNA, 40 bp, Artificial Sequence
  PCR primer for ORF amplification
ggatccagctagcaaaatgtctgccccaaacccaaaggct

SEQ ID NO: 5460 - DNA, 40 bp, Artificial Sequence
  PCR primer for ORF amplification
ggatccagctagcaaaatgtttgaatcgtttgttaatgaa

SEQ ID NO: 5461 - DNA, 40 bp, Artificial Sequence
  PCR primer for ORF amplification
ggatccagctagcaaaatgttttatctaagtgacatcgag

SEQ ID NO: 5462 - DNA, 40 bp, Artificial Sequence
  PCR primer for ORF amplification
ggatccagctagcaaaatgatcccagctccacttgatgct

SEQ ID NO: 5463 - DNA, 40 bp, Artificial Sequence
  PCR primer for ORF amplification
ggatccagctagcaaaatgatctgttatttccttgttgta

SEQ ID NO: 5464 - DNA, 40 bp, Artificial Sequence
  PCR primer for ORF amplification
ggatccagctagcaaaatgccacagtcttttacgtctatt

SEQ ID NO: 5465 - DNA, 40 bp, Artificial Sequence
  PCR primer for ORF amplification
ggatccagctagcaaaatgtcaagcactaatggaaacgca

SEQ ID NO: 5466 - DNA, 40 bp, Artificial Sequence
  PCR primer for ORF amplification
ggatccagctagcaaaatgtcactacaaagcaacagtgta

SEQ ID NO: 5467 - DNA, 40 bp, Artificial Sequence
  PCR primer for ORF amplification
ggatccagctagcaaaatgtcttcaaactatgccactcct

SEQ ID NO: 5468 - DNA, 40 bp, Artificial Sequence
  PCR primer for ORF amplification
ggatccagctagcaaaatgttgttctataagcctgtgatg

SEQ ID NO: 5469 - DNA, 40 bp, Artificial Sequence
  PCR primer for ORF amplification
ggatccagctagcaaaatgaacagtgctaccagtgagaca

SEQ ID NO: 5470 - DNA, 40 bp, Artificial Sequence
  PCR primer for ORF amplification
ggatccagctagcaaaatgatcaccccaaagggaacgcac

SEQ ID NO: 5471 - DNA, 40 bp, Artificial Sequence
  PCR primer for ORF amplification
ggatccagctagcaaaatggcaacgacagatatcatatct

SEQ ID NO: 5472 - DNA, 40 bp, Artificial Sequence
  PCR primer for ORF amplification
ggatccagctagcaaaatgtctgctaacgattactacggc

SEQ ID NO: 5473 - DNA, 40 bp, Artificial Sequence
  PCR primer for ORF amplification
ggatccagctagcaaaatgagattacttcaccatggtgaa

SEQ ID NO: 5474 - DNA, 40 bp, Artificial Sequence
  PCR primer for ORF amplification
ggatccagctagcaaaatgatatatcccttattcaggata

SEQ ID NO: 5475 - DNA, 40 bp, Artificial Sequence
  PCR primer for ORF amplification
ggatccagctagcaaaatggaactgttaccacagggacaa

SEQ ID NO: 5476 - DNA, 40 bp, Artificial Sequence
  PCR primer for ORF amplification
ggatccagctagcaaaatggtcaccacgctaactcccgtt

SEQ ID NO: 5477 - DNA, 40 bp, Artificial Sequence
  PCR primer for ORF amplification
ggatccagctagcaaaatggtcgaaggtgattttgtcgat

SEQ ID NO: 5478 - DNA, 40 bp, Artificial Sequence
  PCR primer for ORF amplification
ggatccagctagcaaaatgtctacatcatccgtacgtttt

SEQ ID NO: 5479 - DNA, 40 bp, Artificial Sequence
  PCR primer for ORF amplification
ggatccagctagcaaaatgtctgaagtagcggaaacatgg

SEQ ID NO: 5480 - DNA, 40 bp, Artificial Sequence
  PCR primer for ORF amplification
ggatccagctagcaaaatgtcttcagcaccattattacaa

SEQ ID NO: 5481 - DNA, 40 bp, Artificial Sequence
  PCR primer for ORF amplification
ggatccagctagcaaaatgtttagacagtgtgctaagaga

SEQ ID NO: 5482 - DNA, 40 bp, Artificial Sequence
  PCR primer for ORF amplification
ggatccagctagcaaaatgaccagatcttccgttttagct

SEQ ID NO: 5483 - DNA, 40 bp, Artificial Sequence
  PCR primer for ORF amplification
ggatccagctagcaaaatgataccttcccggattagccac

SEQ ID NO: 5484 - DNA, 40 bp, Artificial Sequence
  PCR primer for ORF amplification
ggatccagctagcaaaatggaagacacgatacgtccatta

SEQ ID NO: 5485 - DNA, 40 bp, Artificial Sequence
  PCR primer for ORF amplification
ggatccagctagcaaaatggcaaaagcaccaaaggcaaac

SEQ ID NO: 5486 - DNA, 40 bp, Artificial Sequence
  PCR primer for ORF amplification
ggatccagctagcaaaatggcctccttacctcacccaaag

SEQ ID NO: 5487 - DNA, 40 bp, Artificial Sequence
  PCR primer for ORF amplification
ggatccagctagcaaaatggtaagtttcataacgtctagg

SEQ ID NO: 5488 - DNA, 40 bp, Artificial Sequence
  PCR primer for ORF amplification
ggatccagctagcaaaatgtctcaaccggttcaacgcgct

SEQ ID NO: 5489 - DNA, 40 bp, Artificial Sequence
  PCR primer for ORF amplification
ggatccagctagcaaaatgagtagtttgtatgtgtcataa

SEQ ID NO: 5490 - DNA, 40 bp, Artificial Sequence
  PCR primer for ORF amplification
ggatccagctagcaaaatgagtcaaagtcgctggagtatc

SEQ ID NO: 5491 - DNA, 40 bp, Artificial Sequence
  PCR primer for ORF amplification
ggatccagctagcaaaatgcacatatcgctccctacgaga

SEQ ID NO: 5492 - DNA, 40 bp, Artificial Sequence
  PCR primer for ORF amplification
ggatccagctagcaaaatgcaggttctcaatacgaagagt

SEQ ID NO: 5493 - DNA, 40 bp, Artificial Sequence
  PCR primer for ORF amplification
ggatccagctagcaaaatgctttatgagctgatcggactt

SEQ ID NO: 5494 - DNA, 40 bp, Artificial Sequence
  PCR primer for ORF amplification
ggatccagctagcaaaatgtcagaggatctttcacctaca

SEQ ID NO: 5495 - DNA, 40 bp, Artificial Sequence
  PCR primer for ORF amplification
ggatccagctagcaaaatgtcctctgccgccgaaaagaaa

SEQ ID NO: 5496 - DNA, 40 bp, Artificial Sequence
  PCR primer for ORF amplification
ggatccagctagcaaaatgtctattgtgctacggaagagt

SEQ ID NO: 5497 - DNA, 40 bp, Artificial Sequence
  PCR primer for ORF amplification
ggatccagctagcaaaatgtctgctaaagccgaaaagaaa

SEQ ID NO: 5498 - DNA, 40 bp, Artificial Sequence
  PCR primer for ORF amplification
ggatccagctagcaaaatgtttggcccattcaaattaaca

SEQ ID NO: 5499 - DNA, 40 bp, Artificial Sequence
  PCR primer for ORF amplification
ggatccagctagcaaaatgtccggtggtaaaggtggtaaa

SEQ ID NO: 5500 - DNA, 40 bp, Artificial Sequence; identical to SEQ ID NO: 5499
  PCR primer for ORF amplification

SEQ ID NO: 5501 - DNA, 40 bp, Artificial Sequence
  PCR primer for ORF amplification
ggatccagctagcaaaatggattgcccctcaaacgttgtg

SEQ ID NO: 5502 - DNA, 40 bp, Artificial Sequence
  PCR primer for ORF amplification
ggatccagctagcaaaatggttacaattggtagttcctcc

SEQ ID NO: 5503 - DNA, 40 bp, Artificial Sequence
  PCR primer for ORF amplification
ggatccagctagcaaaatggtttttgttttccccttccca

SEQ ID NO: 5504 - DNA, 40 bp, Artificial Sequence
  PCR primer for ORF amplification
ggatccagctagcaaaatgaacaacaagctcatatatcgt

SEQ ID NO: 5505 - DNA, 40 bp, Artificial Sequence
  PCR primer for ORF amplification
ggatccagctagcaaaatgacagcaatgaaagaagacaac

SEQ ID NO: 5506 - DNA, 40 bp, Artificial Sequence
  PCR primer for ORF amplification
ggatccagctagcaaaatgcaattttctactgtcgcttct

SEQ ID NO: 5507 - DNA, 40 bp, Artificial Sequence
  PCR primer for ORF amplification
ggatccagctagcaaaatgcctagtgtagatatagatgct

SEQ ID NO: 5508 - DNA, 40 bp, Artificial Sequence
  PCR primer for ORF amplification
ggatccagctagcaaaatggacagagaccatattaatgac

SEQ ID NO: 5509 - DNA, 40 bp, Artificial Sequence
  PCR primer for ORF amplification
ggatccagctagcaaaatggacgcacaactggaatgggca

SEQ ID NO: 5510 - DNA, 40 bp, Artificial Sequence
  PCR primer for ORF amplification
ggatccagctagcaaaatggattcaatagatgaacaaatt

SEQ ID NO: 5511 - DNA, 40 bp, Artificial Sequence
  PCR primer for ORF amplification
ggatccagctagcaaaatgtcgttttggaaaacattgcag

SEQ ID NO: 5512 - DNA, 40 bp, Artificial Sequence
  PCR primer for ORF amplification
ggatccagctagcaaaatgtcaggaaaagctcatggaggt

SEQ ID NO: 5513 - DNA, 40 bp, Artificial Sequence
  PCR primer for ORF amplification
ggatccagctagcaaaatgtttggtaaagttttcgtaagc

SEQ ID NO: 5514 - DNA, 40 bp, Artificial Sequence
  PCR primer for ORF amplification
ggatccagctagcaaaatgaagttcttaaccaccaacttc

SEQ ID NO: 5515 - DNA, 40 bp, Artificial Sequence
  PCR primer for ORF amplification
ggatccagctagcaaaatgatgtttaatatttaccttttc

SEQ ID NO: 5516 - DNA, 40 bp, Artificial Sequence
  PCR primer for ORF amplification
ggatccagctagcaaaatgtcgtacaacggaatagggctc

SEQ ID NO: 5517 - DNA, 40 bp, Artificial Sequence
  PCR primer for ORF amplification
ggatccagctagcaaaatgacttatgaacaattatacgta

SEQ ID NO: 5518 - DNA, 40 bp, Artificial Sequence
  PCR primer for ORF amplification
ggatccagctagcaaaatgtcagctcaagattattacgga

SEQ ID NO: 5519 - DNA, 40 bp, Artificial Sequence
  PCR primer for ORF amplification
ggatccagctagcaaaatggccagaacaaagcaaacagca

SEQ ID NO: 5520 - DNA, 40 bp, Artificial Sequence
  PCR primer for ORF amplification
ggatccagctagcaaaatggccagaactaaacaaacagct

SEQ ID NO: 5521 - DNA, 40 bp, Artificial Sequence
  PCR primer for ORF amplification
ggatccagctagcaaaatgggagaaattttagaactaact

SEQ ID NO: 5522 - DNA, 40 bp, Artificial Sequence
  PCR primer for ORF amplification
ggatccagctagcaaaatgtcctctgtggaatcttccccc

SEQ ID NO: 5523 - DNA, 40 bp, Artificial Sequence
  PCR primer for ORF amplification
ggatccagctagcaaaatgatgaaaggttctagaagaaca

SEQ ID NO: 5524 - DNA, 40 bp, Artificial Sequence
  PCR primer for ORF amplification
ggatccagctagcaaaatggtagcatcatcgatcaatgaa

SEQ ID NO: 5525 - DNA, 40 bp, Artificial Sequence
  PCR primer for ORF amplification
ggatccagctagcaaaatggtatgttggtgtgtgtgtgtg

SEQ ID NO: 5526 - DNA, 40 bp, Artificial Sequence
  PCR primer for ORF amplification
ggatccagctagcaaaatgtcatacggcggatcggcatcc

SEQ ID NO: 5527 - DNA, 40 bp, Artificial Sequence
  PCR primer for ORF amplification
ggatccagctagcaaaatgtctaaggttgcacaacagtta

SEQ ID NO: 5528 - DNA, 40 bp, Artificial Sequence
  PCR primer for ORF amplification
ggatccagctagcaaaatgcatccacagttagaagctgaa

SEQ ID NO: 5529 - DNA, 40 bp, Artificial Sequence
  PCR primer for ORF amplification
ggatccagctagcaaaatgcttttcttctcctttttcaag

SEQ ID NO: 5530 - DNA, 40 bp, Artificial Sequence
  PCR primer for ORF amplification
ggatccagctagcaaaatgatatttctaaaatctgtcatc

SEQ ID NO: 5531 - DNA, 40 bp, Artificial Sequence
  PCR primer for ORF amplification
ggatccagctagcaaaatgatggtaacgcgcaaacactac

SEQ ID NO: 5532 - DNA, 40 bp, Artificial Sequence
  PCR primer for ORF amplification
ggatccagctagcaaaatgcaacctatcatcaagggagca

SEQ ID NO: 5533 - DNA, 40 bp, Artificial Sequence
  PCR primer for ORF amplification
ggatccagctagcaaaatggacgctactcaaccgcaatac

SEQ ID NO: 5534 - DNA, 40 bp, Artificial Sequence
  PCR primer for ORF amplification
ggatccagctagcaaaatgggattgcgttactccatatat

SEQ ID NO: 5535 - DNA, 40 bp, Artificial Sequence
  PCR primer for ORF amplification
ggatccagctagcaaaatgggtgcttggttatttatcctt

SEQ ID NO: 5536 - DNA, 40 bp, Artificial Sequence
  PCR primer for ORF amplification
ggatccagctagcaaaatgttgtgcgccatcaaaagcaca

SEQ ID NO: 5537 - DNA, 40 bp, Artificial Sequence
  PCR primer for ORF amplification
ggatccagctagcaaaatgaaaaaagaaaaaaaaactccg

SEQ ID NO: 5538 - DNA, 40 bp, Artificial Sequence
  PCR primer for ORF amplification
ggatccagctagcaaaatgctacattgcacccaggtgtgt

SEQ ID NO: 5539 - DNA, 40 bp, Artificial Sequence
  PCR primer for ORF amplification
ggatccagctagcaaaatgtggaaggccgtgatgaatgct

SEQ ID NO: 5540 - DNA, 40 bp, Artificial Sequence
  PCR primer for ORF amplification
ggatccagctagcaaaatgacagatagattaacacaattg

SEQ ID NO: 5541 - DNA, 40 bp, Artificial Sequence
  PCR primer for ORF amplification
ggatccagctagcaaaatgatggaattcaaagtgtcacca

SEQ ID NO: 5542 - DNA, 40 bp, Artificial Sequence
  PCR primer for ORF amplification
ggatccagctagcaaaatgccctctctgcgagatttatca

SEQ ID NO: 5543 - DNA, 40 bp, Artificial Sequence
  PCR primer for ORF amplification
ggatccagctagcaaaatggcactcaaaaagaatacacac

SEQ ID NO: 5544 - DNA, 40 bp, Artificial Sequence
  PCR primer for ORF amplification
ggatccagctagcaaaatggggctttgcggaagtaaaacc

SEQ ID NO: 5545 - DNA, 40 bp, Artificial Sequence
  PCR primer for ORF amplification
ggatccagctagcaaaatggttgtgaaagctattgcacga

SEQ ID NO: 5546 - DNA, 40 bp, Artificial Sequence
  PCR primer for ORF amplification
ggatccagctagcaaaatgtatacaaaagagtactactgg

SEQ ID NO: 5547 - DNA, 40 bp, Artificial Sequence
  PCR primer for ORF amplification
ggatccagctagcaaaatgtcgtatgtttgatcttaacca

SEQ ID NO: 5548 - DNA, 40 bp, Artificial Sequence
  PCR primer for ORF amplification
ggatccagctagcaaaatgtgttgctactgtgtttgttgt

SEQ ID NO: 5549 - DNA, 40 bp, Artificial Sequence
  PCR primer for ORF amplification
ggatccagctagcaaaatggaacaaaggaacaacggtatg

SEQ ID NO: 5550 - DNA, 40 bp, Artificial Sequence
  PCR primer for ORF amplification
ggatccagctagcaaaatgaacattaagactttgtgtcat

SEQ ID NO: 5551 - DNA, 40 bp, Artificial Sequence
  PCR primer for ORF amplification
ggatccagctagcaaaatgctcatcgatcaaatcgtggca

SEQ ID NO: 5552 - DNA, 40 bp, Artificial Sequence
  PCR primer for ORF amplification
ggatccagctagcaaaatgtcgaatacttgggacgatgta

SEQ ID NO: 5553 - DNA, 40 bp, Artificial Sequence
  PCR primer for ORF amplification
ggatccagctagcaaaatgtcgtttgtttccaagcttctc

SEQ ID NO: 5554 - DNA, 40 bp, Artificial Sequence
  PCR primer for ORF amplification
ggatccagctagcaaaatgaaagtaggtggcatagaagac

SEQ ID NO: 5555 - DNA, 40 bp, Artificial Sequence
  PCR primer for ORF amplification
ggatccagctagcaaaatgactgaagacatcgaacaaaaa

SEQ ID NO: 5556 - DNA, 40 bp, Artificial Sequence
  PCR primer for ORF amplification
ggatccagctagcaaaatgcggttaattttcattgcgaaa

SEQ ID NO: 5557 - DNA, 40 bp, Artificial Sequence
  PCR primer for ORF amplification
ggatccagctagcaaaatggcagatcaagtaccagttaca

SEQ ID NO: 5558 - DNA, 40 bp, Artificial Sequence
  PCR primer for ORF amplification
ggatccagctagcaaaatggcgtataatcaagaagatagt

SEQ ID NO: 5559 - DNA, 40 bp, Artificial Sequence
  PCR primer for ORF amplification
ggatccagctagcaaaatgtcaggaaccggattatcgcta

SEQ ID NO: 5560 - DNA, 40 bp, Artificial Sequence
  PCR primer for ORF amplification
ggatccagctagcaaaatgtctcaagctgttaatgccaag

SEQ ID NO: 5561 - DNA, 40 bp, Artificial Sequence
  PCR primer for ORF amplification
ggatccagctagcaaaatggctaggcatttcggtatggcc

SEQ ID NO: 5562 - DNA, 40 bp, Artificial Sequence
  PCR primer for ORF amplification
ggatccagctagcaaaatgagcaaggctacgtgttccttt

SEQ ID NO: 5563 - DNA, 40 bp, Artificial Sequence
  PCR primer for ORF amplification
ggatccagctagcaaaatggagaccaatttttccttcgac

SEQ ID NO: 5564 - DNA, 40 bp, Artificial Sequence
  PCR primer for ORF amplification
ggatccagctagcaaaatggctagtgttttgttgcctcaa

SEQ ID NO: 5565 - DNA, 40 bp, Artificial Sequence
  PCR primer for ORF amplification
ggatccagctagcaaaatgggcaaaaaccatttcttgaag

SEQ ID NO: 5566 - DNA, 40 bp, Artificial Sequence
  PCR primer for ORF amplification
ggatccagctagcaaaatggtcgttcacatcttgggtaaa

SEQ ID NO: 5567 - DNA, 40 bp, Artificial Sequence
  PCR primer for ORF amplification
ggatccagctagcaaaatgtcagttattcctccaaaattc

SEQ ID NO: 5568 - DNA, 40 bp, Artificial Sequence
  PCR primer for ORF amplification
ggatccagctagcaaaatgtctgacgttgaagaagtcgtt

SEQ ID NO: 5569 - DNA, 40 bp, Artificial Sequence; identical to SEQ ID NO: 5189
  PCR primer for ORF amplification

SEQ ID NO: 5570 - DNA, 40 bp, Artificial Sequence
  PCR primer for ORF amplification
ggatccagctagcaaaatgaataccaacgagtccgaacat

SEQ ID NO: 5571 - DNA, 40 bp, Artificial Sequence
  PCR primer for ORF amplification
ggatccagctagcaaaatgaccatattttctaggttctca

SEQ ID NO: 5572 - DNA, 40 bp, Artificial Sequence
  PCR primer for ORF amplification
ggatccagctagcaaaatgactttggcttttacgaccttc

SEQ ID NO: 5573 - DNA, 40 bp, Artificial Sequence
  PCR primer for ORF amplification
ggatccagctagcaaaatgggcaagaaagcacacggagga

SEQ ID NO: 5574 - DNA, 40 bp, Artificial Sequence
  PCR primer for ORF amplification
ggatccagctagcaaaatggtttcgaagaaaaatacggct

SEQ ID NO: 5575 - DNA, 40 bp, Artificial Sequence
  PCR primer for ORF amplification
ggatccagctagcaaaatgtcaaattctaggtattctcag

SEQ ID NO: 5576 - DNA, 40 bp, Artificial Sequence
  PCR primer for ORF amplification
ggatccagctagcaaaatggacccagagttacaagctatt

SEQ ID NO: 5577 - DNA, 40 bp, Artificial Sequence
  PCR primer for ORF amplification
ggatccagctagcaaaatggatagaaatgtatatgaagcc

SEQ ID NO: 5578 - DNA, 40 bp, Artificial Sequence
  PCR primer for ORF amplification
ggatccagctagcaaaatgggtaaaagaaagaagtcaaca

SEQ ID NO: 5579 - DNA, 40 bp, Artificial Sequence
  PCR primer for ORF amplification
ggatccagctagcaaaatgggttccgagacaaaacattct

SEQ ID NO: 5580 - DNA, 40 bp, Artificial Sequence
  PCR primer for ORF amplification
ggatccagctagcaaaatgtttttaagaaattccgttttg

SEQ ID NO: 5581 - DNA, 40 bp, Artificial Sequence
  PCR primer for ORF amplification
ggatccagctagcaaaatgaaaggctcacccatttctcaa

SEQ ID NO: 5582 - DNA, 40 bp, Artificial Sequence
  PCR primer for ORF amplification
ggatccagctagcaaaatgaagttggttaactttttaaaa

SEQ ID NO: 5583 - DNA, 40 bp, Artificial Sequence
  PCR primer for ORF amplification
ggatccagctagcaaaatgactatggatactgcgcaatta

SEQ ID NO: 5584 - DNA, 40 bp, Artificial Sequence
  PCR primer for ORF amplification
ggatccagctagcaaaatgatagatttatacaattactct

SEQ ID NO: 5585 - DNA, 40 bp, Artificial Sequence
  PCR primer for ORF amplification
ggatccagctagcaaaatgatcagttcgtgtgttactaga

SEQ ID NO: 5586 - DNA, 40 bp, Artificial Sequence
  PCR primer for ORF amplification
ggatccagctagcaaaatggcaaatactggctgtttatca

SEQ ID NO: 5587 - DNA, 40 bp, Artificial Sequence
  PCR primer for ORF amplification
ggatccagctagcaaaatggttttgcctataataattggt

SEQ ID NO: 5588 - DNA, 40 bp, Artificial Sequence
  PCR primer for ORF amplification
ggatccagctagcaaaatgtcagcatcagcttttaatttt

SEQ ID NO: 5589 - DNA, 40 bp, Artificial Sequence
  PCR primer for ORF amplification
ggatccagctagcaaaatgtctaacactctatttgatgat

SEQ ID NO: 5590 - DNA, 40 bp, Artificial Sequence
  PCR primer for ORF amplification
ggatccagctagcaaaatgtctacttttaatgcagaaacc

SEQ ID NO: 5591 - DNA, 40 bp, Artificial Sequence
  PCR primer for ORF amplification
ggatccagctagcaaaatgactgctactagcgacaaagta

SEQ ID NO: 5592 - DNA, 40 bp, Artificial Sequence
  PCR primer for ORF amplification
ggatccagctagcaaaatgataactaaatacttcagtaag

SEQ ID NO: 5593 - DNA, 40 bp, Artificial Sequence
  PCR primer for ORF amplification
ggatccagctagcaaaatgcatcagcaacactccgtatgt

SEQ ID NO: 5594 - DNA, 40 bp, Artificial Sequence
  PCR primer for ORF amplification
ggatccagctagcaaaatgctggcacaaacattcaaaaaa

SEQ ID NO: 5595 - DNA, 40 bp, Artificial Sequence
  PCR primer for ORF amplification
ggatccagctagcaaaatggcagtacagtttatactgtgc

SEQ ID NO: 5596 - DNA, 40 bp, Artificial Sequence
  PCR primer for ORF amplification
ggatccagctagcaaaatgggaattattacactatccggc

SEQ ID NO: 5597 - DNA, 40 bp, Artificial Sequence
  PCR primer for ORF amplification
ggatccagctagcaaaatgggcatgttggaactagttggt

SEQ ID NO: 5598 - DNA, 40 bp, Artificial Sequence
  PCR primer for ORF amplification
ggatccagctagcaaaatgtcctccaatcttaccgaagaa

SEQ ID NO: 5599 - DNA, 40 bp, Artificial Sequence
  PCR primer for ORF amplification
ggatccagctagcaaaatgaacaaaattcagcaaatcaac

SEQ ID NO: 5600 - DNA, 40 bp, Artificial Sequence
  PCR primer for ORF amplification
ggatccagctagcaaaatgaatatcgtcccacaagatacc

SEQ ID NO: 5601 - DNA, 40 bp, Artificial Sequence
  PCR primer for ORF amplification
ggatccagctagcaaaatgcccaaatcccgaccaaaaagg

SEQ ID NO: 5602 - DNA, 40 bp, Artificial Sequence
  PCR primer for ORF amplification
ggatccagctagcaaaatggactcgtactcaataacaaac

SEQ ID NO: 5603 - DNA, 40 bp, Artificial Sequence
  PCR primer for ORF amplification
ggatccagctagcaaaatgggcacatatacgccattaata

SEQ ID NO: 5604 - DNA, 40 bp, Artificial Sequence
  PCR primer for ORF amplification
ggatccagctagcaaaatggtttctaccgctacatttttc

SEQ ID NO: 5605 - DNA, 40 bp, Artificial Sequence
  PCR primer for ORF amplification
ggatccagctagcaaaatgtgtgaatcatcaaataagact

SEQ ID NO: 5606 - DNA, 40 bp, Artificial Sequence
  PCR primer for ORF amplification
ggatccagctagcaaaatgttagtaaagacgattagccga

SEQ ID NO: 5607 - DNA, 40 bp, Artificial Sequence
  PCR primer for ORF amplification
ggatccagctagcaaaatgttatcaagggccatattcaga

SEQ ID NO: 5608 - DNA, 40 bp, Artificial Sequence
  PCR primer for ORF amplification
ggatccagctagcaaaatgttcagcctacaagacgtaata

SEQ ID NO: 5609 - DNA, 40 bp, Artificial Sequence
  PCR primer for ORF amplification
ggatccagctagcaaaatgttgtctaacgctaagctcctt

SEQ ID NO: 5610 - DNA, 40 bp, Artificial Sequence
  PCR primer for ORF amplification
ggatccagctagcaaaatgaatctacagaacaacgtttta

SEQ ID NO: 5611 - DNA, 40 bp, Artificial Sequence
  PCR primer for ORF amplification
ggatccagctagcaaaatgaatctatacggttatttttta

SEQ ID NO: 5612 - DNA, 40 bp, Artificial Sequence
  PCR primer for ORF amplification
ggatccagctagcaaaatgcctgtagatcaagaaaaatta

SEQ ID NO: 5613 - DNA, 40 bp, Artificial Sequence
  PCR primer for ORF amplification
ggatccagctagcaaaatggctcacagggctttcatacag

SEQ ID NO: 5614 - DNA, 40 bp, Artificial Sequence
  PCR primer for ORF amplification
ggatccagctagcaaaatgtcagccaccagagccaataaa

SEQ ID NO: 5615 - DNA, 40 bp, Artificial Sequence
  PCR primer for ORF amplification
ggatccagctagcaaaatgtcgaacctctacaaaattgga

SEQ ID NO: 5616 - DNA, 40 bp, Artificial Sequence
  PCR primer for ORF amplification
ggatccagctagcaaaatgtctaacgaatctaacgacctt

SEQ ID NO: 5617 - DNA, 40 bp, Artificial Sequence
  PCR primer for ORF amplification
ggatccagctagcaaaatgttcaagcatagtacaggtatt

SEQ ID NO: 5618 - DNA, 40 bp, Artificial Sequence
  PCR primer for ORF amplification
ggatccagctagcaaaatgaaacagcgtttttctcaagta

SEQ ID NO: 5619 - DNA, 40 bp, Artificial Sequence
  PCR primer for ORF amplification
ggatccagctagcaaaatgcagtttgaagagcggttgcaa

SEQ ID NO: 5620 - DNA, 40 bp, Artificial Sequence
  PCR primer for ORF amplification
ggatccagctagcaaaatgcttttattttcttcttttttt

SEQ ID NO: 5621 - DNA, 40 bp, Artificial Sequence
  PCR primer for ORF amplification
ggatccagctagcaaaatgggcaatttcattataacagaa

SEQ ID NO: 5622 - DNA, 40 bp, Artificial Sequence
  PCR primer for ORF amplification
ggatccagctagcaaaatgtaccatcactatcacgccttc

SEQ ID NO: 5623 - DNA, 40 bp, Artificial Sequence
  PCR primer for ORF amplification
ggatccagctagcaaaatgtctcaacccactcccatcata

SEQ ID NO: 5624 - DNA, 40 bp, Artificial Sequence
  PCR primer for ORF amplification
ggatccagctagcaaaatgtctgatataaacgaaatcgaa

SEQ ID NO: 5625 - DNA, 40 bp, Artificial Sequence
  PCR primer for ORF amplification
ggatccagctagcaaaatgtgctcagcaggcggtatcaga

SEQ ID NO: 5626 - DNA, 40 bp, Artificial Sequence
  PCR primer for ORF amplification
ggatccagctagcaaaatgtttctcccaaaattcaatccc

SEQ ID NO: 5627 - DNA, 40 bp, Artificial Sequence
  PCR primer for ORF amplification
ggatccagctagcaaaatgagcgatgaaaataagagtacg

SEQ ID NO: 5628 - DNA, 40 bp, Artificial Sequence
  PCR primer for ORF amplification
ggatccagctagcaaaatgaacagatcttttcactttcta

SEQ ID NO: 5629 - DNA, 40 bp, Artificial Sequence
  PCR primer for ORF amplification
ggatccagctagcaaaatgacgaacgatattaaggagata

SEQ ID NO: 5630 - DNA, 40 bp, Artificial Sequence
  PCR primer for ORF amplification
ggatccagctagcaaaatgatatttggacctactagtgtc

SEQ ID NO: 5631 - DNA, 40 bp, Artificial Sequence
  PCR primer for ORF amplification
ggatccagctagcaaaatggagaagcccagccccaccagg

SEQ ID NO: 5632 - DNA, 40 bp, Artificial Sequence
  PCR primer for ORF amplification
ggatccagctagcaaaatgggtacagccaagcaaaatcaa

SEQ ID NO: 5633 - DNA, 40 bp, Artificial Sequence
  PCR primer for ORF amplification
ggatccagctagcaaaatgtctgactgggatacaaatact

SEQ ID NO: 5634 - DNA, 40 bp, Artificial Sequence
  PCR primer for ORF amplification
ggatccagctagcaaaatgggtggtaacgttctccccatt

SEQ ID NO: 5635 - DNA, 40 bp, Artificial Sequence; identical to SEQ ID NO: 5561
  PCR primer for ORF amplification

SEQ ID NO: 5636 - DNA, 40 bp, Artificial Sequence
  PCR primer for ORF amplification
ggatccagctagcaaaatgagcttgaggccttgcttcgta

SEQ ID NO: 5637 - DNA, 40 bp, Artificial Sequence
  PCR primer for ORF amplification
ggatccagctagcaaaatgcaaattttcgtcaagacttta

SEQ ID NO: 5638 - DNA, 40 bp, Artificial Sequence
  PCR primer for ORF amplification
ggatccagctagcaaaatgcagtaccattccgctctatat

SEQ ID NO: 5639 - DNA, 40 bp, Artificial Sequence
  PCR primer for ORF amplification
ggatccagctagcaaaatggtcgaattaactgaaattaaa

SEQ ID NO: 5640 - DNA, 40 bp, Artificial Sequence
  PCR primer for ORF amplification
ggatccagctagcaaaatgtccttcattaaaaacttgtta

SEQ ID NO: 5641 - DNA, 40 bp, Artificial Sequence
  PCR primer for ORF amplification
ggatccagctagcaaaatgtggtttcctcagatcattgct

SEQ ID NO: 5642 - DNA, 40 bp, Artificial Sequence
  PCR primer for ORF amplification
ggatccagctagcaaaatgaaattctcaactattttcgga

SEQ ID NO: 5643 - DNA, 40 bp, Artificial Sequence
  PCR primer for ORF amplification
ggatccagctagcaaaatgaactctgaacagctgctgcat

SEQ ID NO: 5644 - DNA, 40 bp, Artificial Sequence
  PCR primer for ORF amplification
ggatccagctagcaaaatgacctttttacaatttatcaat

SEQ ID NO: 5645 - DNA, 40 bp, Artificial Sequence
  PCR primer for ORF amplification
ggatccagctagcaaaatgggtaagaaaaacactaaaggt

SEQ ID NO: 5646 - DNA, 40 bp, Artificial Sequence
  PCR primer for ORF amplification
ggatccagctagcaaaatggttacgttcaactgtgaggtg

SEQ ID NO: 5647 - DNA, 40 bp, Artificial Sequence
  PCR primer for ORF amplification
ggatccagctagcaaaatggttgtcttgaatccaaataac

SEQ ID NO: 5648 - DNA, 40 bp, Artificial Sequence
  PCR primer for ORF amplification
ggatccagctagcaaaatgtctagtcaaacagaaagaact

SEQ ID NO: 5649 - DNA, 40 bp, Artificial Sequence
  PCR primer for ORF amplification
ggatccagctagcaaaatgtctcaaaaagcttgttacgtt

SEQ ID NO: 5650 - DNA, 40 bp, Artificial Sequence
  PCR primer for ORF amplification
ggatccagctagcaaaatgtctgacgaagcaaaggaaaag

SEQ ID NO: 5651 - DNA, 40 bp, Artificial Sequence
  PCR primer for ORF amplification
ggatccagctagcaaaatgttacgtaacacttttactaga

SEQ ID NO: 5652 - DNA, 40 bp, Artificial Sequence
  PCR primer for ORF amplification
ggatccagctagcaaaatgttgtcgaggtttatgtccaac

SEQ ID NO: 5653 - DNA, 40 bp, Artificial Sequence
  PCR primer for ORF amplification
ggatccagctagcaaaatgactccacttttgcaggcggaa

SEQ ID NO: 5654 - DNA, 40 bp, Artificial Sequence
  PCR primer for ORF amplification
ggatccagctagcaaaatgctaagagttatatggaagcat

SEQ ID NO: 5655 - DNA, 40 bp, Artificial Sequence
  PCR primer for ORF amplification
ggatccagctagcaaaatggaagccgattggaggagaatt

SEQ ID NO: 5656 - DNA, 40 bp, Artificial Sequence
  PCR primer for ORF amplification
ggatccagctagcaaaatggttcaagcagtcgcagtgtta

SEQ ID NO: 5657 - DNA, 40 bp, Artificial Sequence
  PCR primer for ORF amplification
ggatccagctagcaaaatgtcgtcatctactccctttgac

SEQ ID NO: 5658 - DNA, 40 bp, Artificial Sequence
  PCR primer for ORF amplification
ggatccagctagcaaaatgaaggttgaaatcgattctttt

SEQ ID NO: 5659 - DNA, 40 bp, Artificial Sequence
  PCR primer for ORF amplification
ggatccagctagcaaaatgaaggttgaagttgattccttt

SEQ ID NO: 5660 - DNA, 40 bp, Artificial Sequence
  PCR primer for ORF amplification
ggatccagctagcaaaatgaattcaactaaaaggctgaaa

SEQ ID NO: 5661 - DNA, 40 bp, Artificial Sequence
  PCR primer for ORF amplification
ggatccagctagcaaaatgaccaaagtagatttttggcca

SEQ ID NO: 5662 - DNA, 40 bp, Artificial Sequence
  PCR primer for ORF amplification
ggatccagctagcaaaatgagtggaaatcaaatggctatg

SEQ ID NO: 5663 - DNA, 40 bp, Artificial Sequence
  PCR primer for ORF amplification
ggatccagctagcaaaatgatgaggggagcgagtaagagg

SEQ ID NO: 5664 - DNA, 40 bp, Artificial Sequence
  PCR primer for ORF amplification
ggatccagctagcaaaatgcgatcgatttttctgctgcat

SEQ ID NO: 5665 - DNA, 40 bp, Artificial Sequence
  PCR primer for ORF amplification
ggatccagctagcaaaatgctttcactacgtcaatctata

SEQ ID NO: 5666 - DNA, 40 bp, Artificial Sequence
  PCR primer for ORF amplification
ggatccagctagcaaaatggatagaccaagaacattacgc

SEQ ID NO: 5667 - DNA, 40 bp, Artificial Sequence
  PCR primer for ORF amplification
ggatccagctagcaaaatgtcgttggtcaaacttgcgaat

SEQ ID NO: 5668 - DNA, 40 bp, Artificial Sequence
  PCR primer for ORF amplification
ggatccagctagcaaaatgacgcaattaaaatatttgttg

SEQ ID NO: 5669 - DNA, 40 bp, Artificial Sequence
  PCR primer for ORF amplification
ggatccagctagcaaaatgagtatgagttcaactgtaatt

SEQ ID NO: 5670 - DNA, 40 bp, Artificial Sequence
  PCR primer for ORF amplification
ggatccagctagcaaaatgagttcccggtttgcaagaagt

SEQ ID NO: 5671 - DNA, 40 bp, Artificial Sequence
  PCR primer for ORF amplification
ggatccagctagcaaaatgatggatggttccataacaagg

SEQ ID NO: 5672 - DNA, 40 bp, Artificial Sequence
  PCR primer for ORF amplification
ggatccagctagcaaaatggcacgttcaagaggatcatca

SEQ ID NO: 5673 - DNA, 40 bp, Artificial Sequence
  PCR primer for ORF amplification
ggatccagctagcaaaatggcagtagaagagggtggttgc

SEQ ID NO: 5674 - DNA, 40 bp, Artificial Sequence
  PCR primer for ORF amplification
ggatccagctagcaaaatgggtaaagacaacaaggaacat

SEQ ID NO: 5675 - DNA, 40 bp, Artificial Sequence
  PCR primer for ORF amplification
ggatccagctagcaaaatggtactgtttggactaggtaga

SEQ ID NO: 5676 - DNA, 40 bp, Artificial Sequence
  PCR primer for ORF amplification
ggatccagctagcaaaatgtccaacactagcgaagataac

SEQ ID NO: 5677 - DNA, 40 bp, Artificial Sequence
  PCR primer for ORF amplification
ggatccagctagcaaaatgttcgccagactcgctaatcct

SEQ ID NO: 5678 - DNA, 40 bp, Artificial Sequence
  PCR primer for ORF amplification
ggatccagctagcaaaatgaagagtttgttctatctcaaa

SEQ ID NO: 5679 - DNA, 40 bp, Artificial Sequence
  PCR primer for ORF amplification
ggatccagctagcaaaatgaacggcggaggcaagaatgtt

SEQ ID NO: 5680 - DNA, 40 bp, Artificial Sequence
  PCR primer for ORF amplification
ggatccagctagcaaaatgaatggaaacagcactaacaat

SEQ ID NO: 5681 - DNA, 40 bp, Artificial Sequence
  PCR primer for ORF amplification
ggatccagctagcaaaatgatagaggcgttggaaatagtt

SEQ ID NO: 5682 - DNA, 40 bp, Artificial Sequence
  PCR primer for ORF amplification
ggatccagctagcaaaatgccaattgaccaagaaaaatta

SEQ ID NO: 5683 - DNA, 40 bp, Artificial Sequence
  PCR primer for ORF amplification
ggatccagctagcaaaatgccgcgcataaagaccagaaga

SEQ ID NO: 5684 - DNA, 40 bp, Artificial Sequence
  PCR primer for ORF amplification
ggatccagctagcaaaatggacccacagacgctcattact

SEQ ID NO: 5685 - DNA, 40 bp, Artificial Sequence
  PCR primer for ORF amplification
ggatccagctagcaaaatgtcatacaaacagtattttgat

SEQ ID NO: 5686 - DNA, 40 bp, Artificial Sequence
  PCR primer for ORF amplification
ggatccagctagcaaaatgtctgacgaagaacacaccttt

SEQ ID NO: 5687 - DNA, 40 bp, Artificial Sequence
  PCR primer for ORF amplification
ggatccagctagcaaaatgtctgacgaagaacataccttt

SEQ ID NO: 5688 - DNA, 40 bp, Artificial Sequence
  PCR primer for ORF amplification
ggatccagctagcaaaatgtctgctaaacccgctactgac

SEQ ID NO: 5689 - DNA, 40 bp, Artificial Sequence
  PCR primer for ORF amplification
ggatccagctagcaaaatgatcaatggcgtatattacaat

SEQ ID NO: 5690 - DNA, 40 bp, Artificial Sequence
  PCR primer for ORF amplification
ggatccagctagcaaaatggggaaaaagacttttagagaa

SEQ ID NO: 5691 - DNA, 40 bp, Artificial Sequence
  PCR primer for ORF amplification
ggatccagctagcaaaatggtgacagggggaatggcaagc

SEQ ID NO: 5692 - DNA, 40 bp, Artificial Sequence
  PCR primer for ORF amplification
ggatccagctagcaaaatgtcacaggcagcaaaaaacgtg

SEQ ID NO: 5693 - DNA, 40 bp, Artificial Sequence
  PCR primer for ORF amplification
ggatccagctagcaaaatgtcagccgatcattcgagagat

SEQ ID NO: 5694 - DNA, 40 bp, Artificial Sequence
  PCR primer for ORF amplification
ggatccagctagcaaaatgaagtgcactttagtttccaca

SEQ ID NO: 5695 - DNA, 40 bp, Artificial Sequence
  PCR primer for ORF amplification
ggatccagctagcaaaatgagcttacccgatggattttat

SEQ ID NO: 5696 - DNA, 40 bp, Artificial Sequence
  PCR primer for ORF amplification
ggatccagctagcaaaatggggatatattcattttggatc

SEQ ID NO: 5697 - DNA, 40 bp, Artificial Sequence
  PCR primer for ORF amplification
ggatccagctagcaaaatgtcacgcatgccatctagtttc

SEQ ID NO: 5698 - DNA, 40 bp, Artificial Sequence
  PCR primer for ORF amplification
ggatccagctagcaaaatgtcgcacaacgcaatggaacat

SEQ ID NO: 5699 - DNA, 40 bp, Artificial Sequence
  PCR primer for ORF amplification
ggatccagctagcaaaatgatgcctgctaaactgcagctt

SEQ ID NO: 5700 - DNA, 40 bp, Artificial Sequence
  PCR primer for ORF amplification
ggatccagctagcaaaatgactgaattgtgtcctgtctac

SEQ ID NO: 5701 - DNA, 40 bp, Artificial Sequence
  PCR primer for ORF amplification
ggatccagctagcaaaatgagccagttagttctagactta

SEQ ID NO: 5702 - DNA, 40 bp, Artificial Sequence
  PCR primer for ORF amplification
ggatccagctagcaaaatgggtgtttatttggcagtactc

SEQ ID NO: 5703 - DNA, 40 bp, Artificial Sequence
  PCR primer for ORF amplification
ggatccagctagcaaaatgtctataccccattccgtattt

SEQ ID NO: 5704 - DNA, 40 bp, Artificial Sequence
  PCR primer for ORF amplification
ggatccagctagcaaaatgttacgttcaattattggaaag

SEQ ID NO: 5705 - DNA, 40 bp, Artificial Sequence
  PCR primer for ORF amplification
ggatccagctagcaaaatgaaagttcttgaggaaaggaat

SEQ ID NO: 5706 - DNA, 40 bp, Artificial Sequence
  PCR primer for ORF amplification
ggatccagctagcaaaatgaagatcagtcaatttggctct

SEQ ID NO: 5707 - DNA, 40 bp, Artificial Sequence
  PCR primer for ORF amplification
ggatccagctagcaaaatgaagctaggacatcgtgagcaa

SEQ ID NO: 5708 - DNA, 40 bp, Artificial Sequence
  PCR primer for ORF amplification
ggatccagctagcaaaatgacaaagaaggataagaaggaa

SEQ ID NO: 5709 - DNA, 40 bp, Artificial Sequence
  PCR primer for ORF amplification
ggatccagctagcaaaatgacaattgaaaaaccaaaaata

SEQ ID NO: 5710 - DNA, 40 bp, Artificial Sequence
  PCR primer for ORF amplification
ggatccagctagcaaaatgagtaagaacaggtcatcgcta

SEQ ID NO: 5711 - DNA, 40 bp, Artificial Sequence
  PCR primer for ORF amplification
ggatccagctagcaaaatgatcaagtatactatcgatgag

SEQ ID NO: 5712 - DNA, 40 bp, Artificial Sequence
  PCR primer for ORF amplification
ggatccagctagcaaaatgccacaagtacagtcgtggttt

SEQ ID NO: 5713 - DNA, 40 bp, Artificial Sequence
  PCR primer for ORF amplification
ggatccagctagcaaaatgctacaactgaaattcatatgg

SEQ ID NO: 5714 - DNA, 40 bp, Artificial Sequence
  PCR primer for ORF amplification
ggatccagctagcaaaatggagaagatcaaagagaaattg

SEQ ID NO: 5715 - DNA, 40 bp, Artificial Sequence
  PCR primer for ORF amplification
ggatccagctagcaaaatggatgatatttgtagtatggcg

SEQ ID NO: 5716 - DNA, 40 bp, Artificial Sequence
  PCR primer for ORF amplification
ggatccagctagcaaaatgaccacatctttttatgattta

SEQ ID NO: 5717 - DNA, 40 bp, Artificial Sequence
  PCR primer for ORF amplification
ggatccagctagcaaaatgatcgaagagaagaaggaactt

SEQ ID NO: 5718 - DNA, 40 bp, Artificial Sequence
  PCR primer for ORF amplification
ggatccagctagcaaaatgcaacaaagatcaaataggaga

SEQ ID NO: 5719 - DNA, 40 bp, Artificial Sequence
  PCR primer for ORF amplification
ggatccagctagcaaaatgcacaatatgtttccagcactc

SEQ ID NO: 5720 - DNA, 40 bp, Artificial Sequence
  PCR primer for ORF amplification
ggatccagctagcaaaatgccaagagaattcaaatccttt

SEQ ID NO: 5721 - DNA, 40 bp, Artificial Sequence
  PCR primer for ORF amplification
ggatccagctagcaaaatggtaatgagggaagaaacaata

SEQ ID NO: 5722 - DNA, 40 bp, Artificial Sequence
  PCR primer for ORF amplification
ggatccagctagcaaaatggtgatgctccattctaaaaac

SEQ ID NO: 5723 - DNA, 40 bp, Artificial Sequence
  PCR primer for ORF amplification
ggatccagctagcaaaatgtcccaagtctattttgatgtc

SEQ ID NO: 5724 - DNA, 40 bp, Artificial Sequence
  PCR primer for ORF amplification
ggatccagctagcaaaatgtcttcttcccaggtcgtcagg

SEQ ID NO: 5725 - DNA, 40 bp, Artificial Sequence
  PCR primer for ORF amplification
ggatccagctagcaaaatgtttttacgtactcaagctcgt

SEQ ID NO: 5726 - DNA, 40 bp, Artificial Sequence
  PCR primer for ORF amplification
ggatccagctagcaaaatgaatagcgcaggccgcgtccat

SEQ ID NO: 5727 - DNA, 40 bp, Artificial Sequence
  PCR primer for ORF amplification
ggatccagctagcaaaatggaccatagtgaatcgctaacg

SEQ ID NO: 5728 - DNA, 40 bp, Artificial Sequence
  PCR primer for ORF amplification
ggatccagctagcaaaatgtcagaattctataagctagca

SEQ ID NO: 5729 - DNA, 40 bp, Artificial Sequence
  PCR primer for ORF amplification
ggatccagctagcaaaatgtcgcagaagattggacacagt

SEQ ID NO: 5730 - DNA, 40 bp, Artificial Sequence
  PCR primer for ORF amplification
ggatccagctagcaaaatgaccaatgaaggaataggtata

SEQ ID NO: 5731 - DNA, 40 bp, Artificial Sequence
  PCR primer for ORF amplification
ggatccagctagcaaaatgacgaaaaaggataagaaagca

SEQ ID NO: 5732 - DNA, 40 bp, Artificial Sequence
  PCR primer for ORF amplification
ggatccagctagcaaaatggcagaacaaattagtcacaaa

SEQ ID NO: 5733 - DNA, 40 bp, Artificial Sequence
  PCR primer for ORF amplification
ggatccagctagcaaaatggtatctagtgcagttaaatgt

SEQ ID NO: 5734 - DNA, 40 bp, Artificial Sequence
  PCR primer for ORF amplification
ggatccagctagcaaaatgtcaacgcaactcgcaagtaac

SEQ ID NO: 5735 - DNA, 40 bp, Artificial Sequence
  PCR primer for ORF amplification
ggatccagctagcaaaatgcctccaaagtttgatccaaat

SEQ ID NO: 5736 - DNA, 40 bp, Artificial Sequence
  PCR primer for ORF amplification
ggatccagctagcaaaatgcctccaaagtttgatcctaat

SEQ ID NO: 5737 - DNA, 40 bp, Artificial Sequence
  PCR primer for ORF amplification
ggatccagctagcaaaatgaaagttaaaataaacgaagtg

SEQ ID NO: 5738 - DNA, 40 bp, Artificial Sequence
  PCR primer for ORF amplification
ggatccagctagcaaaatgacagatgctttggaacagagc

SEQ ID NO: 5739 - DNA, 40 bp, Artificial Sequence
  PCR primer for ORF amplification
ggatccagctagcaaaatgaccactcgaaaaacagtagat

SEQ ID NO: 5740 - DNA, 40 bp, Artificial Sequence
  PCR primer for ORF amplification
ggatccagctagcaaaatgagatttccttcaatttttact

SEQ ID NO: 5741 - DNA, 40 bp, Artificial Sequence
  PCR primer for ORF amplification
ggatccagctagcaaaatgcaattgttttccatcctctct

SEQ ID NO: 5742 - DNA, 40 bp, Artificial Sequence
  PCR primer for ORF amplification
ggatccagctagcaaaatgcttcctgttataacgagattt

SEQ ID NO: 5743 - DNA, 40 bp, Artificial Sequence
  PCR primer for ORF amplification
ggatccagctagcaaaatgtcgaaaaccgctcagaaacgt

SEQ ID NO: 5744 - DNA, 40 bp, Artificial Sequence
  PCR primer for ORF amplification
ggatccagctagcaaaatgtcaaaagtgtatgttattata

SEQ ID NO: 5745 - DNA, 40 bp, Artificial Sequence
  PCR primer for ORF amplification
ggatccagctagcaaaatgtggctcacagaggctcaaagt

SEQ ID NO: 5746 - DNA, 40 bp, Artificial Sequence
  PCR primer for ORF amplification
ggatccagctagcaaaatgagcggtagtaggggcaatagc

SEQ ID NO: 5747 - DNA, 40 bp, Artificial Sequence
  PCR primer for ORF amplification
ggatccagctagcaaaatgggtagatattcggtgaagaga

SEQ ID NO: 5748 - DNA, 40 bp, Artificial Sequence
  PCR primer for ORF amplification
ggatccagctagcaaaatgtcaagatatggcaaaaacctt

SEQ ID NO: 5749 - DNA, 40 bp, Artificial Sequence
  PCR primer for ORF amplification
ggatccagctagcaaaatgtctgcaacgtatgtacactaa

SEQ ID NO: 5750 - DNA, 40 bp, Artificial Sequence
  PCR primer for ORF amplification
ggatccagctagcaaaatgaacaacgagactagtggtaaa

SEQ ID NO: 5751 - DNA, 40 bp, Artificial Sequence
  PCR primer for ORF amplification
ggatccagctagcaaaatgaatctaagatttgaattgcag

SEQ ID NO: 5752 - DNA, 40 bp, Artificial Sequence
  PCR primer for ORF amplification
ggatccagctagcaaaatgattatttacaaggatatcttc

SEQ ID NO: 5753 - DNA, 40 bp, Artificial Sequence
  PCR primer for ORF amplification
ggatccagctagcaaaatgattccttaccaggagtggcat

SEQ ID NO: 5754 - DNA, 40 bp, Artificial Sequence
  PCR primer for ORF amplification
ggatccagctagcaaaatgcaagaattttattctttttca

SEQ ID NO: 5755 - DNA, 40 bp, Artificial Sequence
  PCR primer for ORF amplification
ggatccagctagcaaaatgcagggcgatatcagaaggaaa

SEQ ID NO: 5756 - DNA, 40 bp, Artificial Sequence
  PCR primer for ORF amplification
ggatccagctagcaaaatggctttaagtttaggacagttc

SEQ ID NO: 5757 - DNA, 40 bp, Artificial Sequence
  PCR primer for ORF amplification
ggatccagctagcaaaatgtctactattccctcagaaatc

SEQ ID NO: 5758 - DNA, 40 bp, Artificial Sequence
  PCR primer for ORF amplification
ggatccagctagcaaaatgtctaggaagctgaaaaaaacg

SEQ ID NO: 5759 - DNA, 40 bp, Artificial Sequence
  PCR primer for ORF amplification
ggatccagctagcaaaatgtctgtgaaacccattgacaac

SEQ ID NO: 5760 - DNA, 40 bp, Artificial Sequence
  PCR primer for ORF amplification
ggatccagctagcaaaatgaaagaagcatctgatagagaa

SEQ ID NO: 5761 - DNA, 40 bp, Artificial Sequence
  PCR primer for ORF amplification
ggatccagctagcaaaatgaataagtggagcaggctgtac

SEQ ID NO: 5762 - DNA, 40 bp, Artificial Sequence
  PCR primer for ORF amplification
ggatccagctagcaaaatgagttctcaaagtaatactggt

SEQ ID NO: 5763 - DNA, 40 bp, Artificial Sequence
  PCR primer for ORF amplification
ggatccagctagcaaaatggtatgtgccattacattacgt

SEQ ID NO: 5764 - DNA, 40 bp, Artificial Sequence
  PCR primer for ORF amplification
ggatccagctagcaaaatgtcatcgactaagtttttgaaa

SEQ ID NO: 5765 - DNA, 40 bp, Artificial Sequence
  PCR primer for ORF amplification
ggatccagctagcaaaatgtccaatctattaaacaagttt

SEQ ID NO: 5766 - DNA, 40 bp, Artificial Sequence
  PCR primer for ORF amplification
ggatccagctagcaaaatgtcgaatgaaaacttatctccc

SEQ ID NO: 5767 - DNA, 40 bp, Artificial Sequence
  PCR primer for ORF amplification
ggatccagctagcaaaatgactttgaataacgttgcaagg

SEQ ID NO: 5768 - DNA, 40 bp, Artificial Sequence
  PCR primer for ORF amplification
ggatccagctagcaaaatgacgccctatgcagtagcaatt

SEQ ID NO: 5769 - DNA, 40 bp, Artificial Sequence
  PCR primer for ORF amplification
ggatccagctagcaaaatgagcagtgaaattgcctactcg

SEQ ID NO: 5770 - DNA, 40 bp, Artificial Sequence
  PCR primer for ORF amplification
ggatccagctagcaaaatgatagcgtggtccctagtggct

SEQ ID NO: 5771 - DNA, 40 bp, Artificial Sequence
  PCR primer for ORF amplification
ggatccagctagcaaaatggcagttaaaggattaggcaaa

SEQ ID NO: 5772 - DNA, 40 bp, Artificial Sequence
  PCR primer for ORF amplification
ggatccagctagcaaaatgtacattcctaaacattttgag

SEQ ID NO: 5773 - DNA, 40 bp, Artificial Sequence
  PCR primer for ORF amplification
ggatccagctagcaaaatgtggagcaggaacgtcagattg

SEQ ID NO: 5774 - DNA, 40 bp, Artificial Sequence
  PCR primer for ORF amplification
ggatccagctagcaaaatgttcacaaatacacgtacaata

SEQ ID NO: 5775 - DNA, 40 bp, Artificial Sequence
  PCR primer for ORF amplification
ggatccagctagcaaaatgagtaagaatgttggtaagcta

SEQ ID NO: 5776 - DNA, 40 bp, Artificial Sequence
  PCR primer for ORF amplification
ggatccagctagcaaaatgagttcaagttcttatagggat

SEQ ID NO: 5777 - DNA, 40 bp, Artificial Sequence
  PCR primer for ORF amplification
ggatccagctagcaaaatgcagtgcgcgataactcctaga

SEQ ID NO: 5778 - DNA, 40 bp, Artificial Sequence
  PCR primer for ORF amplification
ggatccagctagcaaaatgccatctgacgtagcatcgagg

SEQ ID NO: 5779 - DNA, 40 bp, Artificial Sequence
  PCR primer for ORF amplification
ggatccagctagcaaaatggagggccgcaaaagtgaagat

SEQ ID NO: 5780 - DNA, 40 bp, Artificial Sequence
  PCR primer for ORF amplification
ggatccagctagcaaaatgggttcaaacacttccaaagtg

SEQ ID NO: 5781 - DNA, 40 bp, Artificial Sequence
  PCR primer for ORF amplification
ggatccagctagcaaaatgttacgcactactagactatgg

SEQ ID NO: 5782 - DNA, 40 bp, Artificial Sequence
  PCR primer for ORF amplification
ggatccagctagcaaaatggttcccttatttggtttattt

SEQ ID NO: 5783 - DNA, 40 bp, Artificial Sequence
  PCR primer for ORF amplification
ggatccagctagcaaaatgtcacaatcattacgtccgtat

SEQ ID NO: 5784 - DNA, 40 bp, Artificial Sequence
  PCR primer for ORF amplification
ggatccagctagcaaaatgttttttattaaagacctttcg

SEQ ID NO: 5785 - DNA, 40 bp, Artificial Sequence
  PCR primer for ORF amplification
ggatccagctagcaaaatgctgaaaattgttactcgggct

SEQ ID NO: 5786 - DNA, 40 bp, Artificial Sequence
  PCR primer for ORF amplification
ggatccagctagcaaaatggagcacgtatcaaagaggtca

SEQ ID NO: 5787 - DNA, 40 bp, Artificial Sequence
  PCR primer for ORF amplification
ggatccagctagcaaaatgtcaaaactatcgtcttatcct

SEQ ID NO: 5788 - DNA, 40 bp, Artificial Sequence
  PCR primer for ORF amplification
ggatccagctagcaaaatgtcattggtgaattcgttaaca

SEQ ID NO: 5789 - DNA, 40 bp, Artificial Sequence
  PCR primer for ORF amplification
ggatccagctagcaaaatgtccacaccagctagaagaagg

SEQ ID NO: 5790 - DNA, 40 bp, Artificial Sequence
  PCR primer for ORF amplification
ggatccagctagcaaaatgtctgcaaatagcaaggacaga

SEQ ID NO: 5791 - DNA, 40 bp, Artificial Sequence
  PCR primer for ORF amplification
ggatccagctagcaaaatgaatttcaaggagccgctagtg

SEQ ID NO: 5792 - DNA, 40 bp, Artificial Sequence
  PCR primer for ORF amplification
ggatccagctagcaaaatgacccacagcttgaaagctcta

SEQ ID NO: 5793 - DNA, 40 bp, Artificial Sequence
  PCR primer for ORF amplification
ggatccagctagcaaaatgagttttgcatcgaggaatatt

SEQ ID NO: 5794 - DNA, 40 bp, Artificial Sequence
  PCR primer for ORF amplification
ggatccagctagcaaaatgctagccctagctgataacatt

SEQ ID NO: 5795 - DNA, 40 bp, Artificial Sequence
  PCR primer for ORF amplification
ggatccagctagcaaaatggtacgtttaaaaagtagatat

SEQ ID NO: 5796 - DNA, 40 bp, Artificial Sequence
  PCR primer for ORF amplification
ggatccagctagcaaaatgtcatctaccagtgataataat

SEQ ID NO: 5797 - DNA, 40 bp, Artificial Sequence
  PCR primer for ORF amplification
ggatccagctagcaaaatgtccaacaaggcaagtgaccaa

SEQ ID NO: 5798 - DNA, 40 bp, Artificial Sequence
  PCR primer for ORF amplification
ggatccagctagcaaaatgaagattgtcttacaaaaagtc

SEQ ID NO: 5799 - DNA, 40 bp, Artificial Sequence; identical to SEQ ID NO: 5422
  PCR primer for ORF amplification

SEQ ID NO: 5800 - DNA, 40 bp, Artificial Sequence
  PCR primer for ORF amplification
ggatccagctagcaaaatgattaagcggtctctcgcaagt

SEQ ID NO: 5801 - DNA, 40 bp, Artificial Sequence
  PCR primer for ORF amplification
ggatccagctagcaaaatgattccgaggactagaacacta

SEQ ID NO: 5802 - DNA, 40 bp, Artificial Sequence
  PCR primer for ORF amplification
ggatccagctagcaaaatgcaacatttcgaaagttcagat

SEQ ID NO: 5803 - DNA, 40 bp, Artificial Sequence
  PCR primer for ORF amplification
ggatccagctagcaaaatgctatcagctgcagataattta

SEQ ID NO: 5804 - DNA, 40 bp, Artificial Sequence
  PCR primer for ORF amplification
ggatccagctagcaaaatgggcgaaggtttgctggattta

SEQ ID NO: 5805 - DNA, 40 bp, Artificial Sequence
  PCR primer for ORF amplification
ggatccagctagcaaaatgtctactaaagcccaaaaccct

SEQ ID NO: 5806 - DNA, 40 bp, Artificial Sequence
  PCR primer for ORF amplification
ggatccagctagcaaaatgtctgccaaagctcaaaaccct

SEQ ID NO: 5807 - DNA, 40 bp, Artificial Sequence
  PCR primer for ORF amplification
ggatccagctagcaaaatgtctgctatcccagaaaacgcc

SEQ ID NO: 5808 - DNA, 40 bp, Artificial Sequence
  PCR primer for ORF amplification
ggatccagctagcaaaatgtctttggccaaatccgctgct

SEQ ID NO: 5809 - DNA, 40 bp, Artificial Sequence
  PCR primer for ORF amplification
ggatccagctagcaaaatgtttacttcgaagcctgctttc

SEQ ID NO: 5810 - DNA, 40 bp, Artificial Sequence
  PCR primer for ORF amplification
ggatccagctagcaaaatgaatgaaagtgagaatagtccc

SEQ ID NO: 5811 - DNA, 40 bp, Artificial Sequence
  PCR primer for ORF amplification
ggatccagctagcaaaatgaccacatcacacagaccacag

SEQ ID NO: 5812 - DNA, 40 bp, Artificial Sequence
  PCR primer for ORF amplification
ggatccagctagcaaaatgcctcagtattttgccattatt

SEQ ID NO: 5813 - DNA, 40 bp, Artificial Sequence
  PCR primer for ORF amplification
ggatccagctagcaaaatgccttctaaaaactccatcaac

SEQ ID NO: 5814 - DNA, 40 bp, Artificial Sequence
  PCR primer for ORF amplification
ggatccagctagcaaaatgcgtaataatgtgactgaattg

SEQ ID NO: 5815 - DNA, 40 bp, Artificial Sequence
  PCR primer for ORF amplification
ggatccagctagcaaaatgcttatcaaccacttgagtaag

SEQ ID NO: 5816 - DNA, 40 bp, Artificial Sequence
  PCR primer for ORF amplification
ggatccagctagcaaaatggaatctattatcctcagcatt

SEQ ID NO: 5817 - DNA, 40 bp, Artificial Sequence
  PCR primer for ORF amplification
ggatccagctagcaaaatggacggccttagctttgttgat

SEQ ID NO: 5818 - DNA, 40 bp, Artificial Sequence
  PCR primer for ORF amplification
ggatccagctagcaaaatggatttgaaaagggattggtta

SEQ ID NO: 5819 - DNA, 40 bp, Artificial Sequence
  PCR primer for ORF amplification
ggatccagctagcaaaatggtccttttacacaaaagcaca

SEQ ID NO: 5820 - DNA, 40 bp, Artificial Sequence
  PCR primer for ORF amplification
ggatccagctagcaaaatgtcgacggataccatgtatttc

SEQ ID NO: 5821 - DNA, 40 bp, Artificial Sequence
  PCR primer for ORF amplification
ggatccagctagcaaaatggaaatagtgtacaagccattg

SEQ ID NO: 5822 - DNA, 40 bp, Artificial Sequence
  PCR primer for ORF amplification
ggatccagctagcaaaatgggccgtgatatatgcacatta

SEQ ID NO: 5823 - DNA, 40 bp, Artificial Sequence
  PCR primer for ORF amplification
ggatccagctagcaaaatgtctgacttagttaacaagaaa

SEQ ID NO: 5824 - DNA, 40 bp, Artificial Sequence
  PCR primer for ORF amplification
ggatccagctagcaaaatggctggagactccgataatgtg

SEQ ID NO: 5825 - DNA, 40 bp, Artificial Sequence
  PCR primer for ORF amplification
ggatccagctagcaaaatgaaactggcgcaagacatgaat

SEQ ID NO: 5826 - DNA, 40 bp, Artificial Sequence
  PCR primer for ORF amplification
ggatccagctagcaaaatgacgtcgaatagcgacggttca

SEQ ID NO: 5827 - DNA, 40 bp, Artificial Sequence
  PCR primer for ORF amplification
ggatccagctagcaaaatgagcaaatccactaacgttagt

SEQ ID NO: 5828 - DNA, 40 bp, Artificial Sequence
  PCR primer for ORF amplification
ggatccagctagcaaaatgagcagcattccagctggcact

SEQ ID NO: 5829 - DNA, 40 bp, Artificial Sequence
  PCR primer for ORF amplification
ggatccagctagcaaaatgtcgaacatcacttatgtcaaa

SEQ ID NO: 5830 - DNA, 40 bp, Artificial Sequence
  PCR primer for ORF amplification
ggatccagctagcaaaatgttgaagagcacgctgaggctt

SEQ ID NO: 5831 - DNA, 40 bp, Artificial Sequence
  PCR primer for ORF amplification
ggatccagctagcaaaatgttgaagtctatatttgcgaag

SEQ ID NO: 5832 - DNA, 40 bp, Artificial Sequence
  PCR primer for ORF amplification
ggatccagctagcaaaatgtttaatactacaccaattaat

SEQ ID NO: 5833 - DNA, 40 bp, Artificial Sequence
  PCR primer for ORF amplification
ggatccagctagcaaaatgtttcgagccggatcatcaaaa

SEQ ID NO: 5834 - DNA, 40 bp, Artificial Sequence
  PCR primer for ORF amplification
ggatccagctagcaaaatgaccttgtggccacatccgggg

SEQ ID NO: 5835 - DNA, 40 bp, Artificial Sequence
  PCR primer for ORF amplification
ggatccagctagcaaaatgactggataccctgacgtggcc

SEQ ID NO: 5836 - DNA, 40 bp, Artificial Sequence
  PCR primer for ORF amplification
ggatccagctagcaaaatgagttctgctaaacctattaat

SEQ ID NO: 5837 - DNA, 40 bp, Artificial Sequence
  PCR primer for ORF amplification
ggatccagctagcaaaatgccggttactaaatctttatct

SEQ ID NO: 5838 - DNA, 40 bp, Artificial Sequence
  PCR primer for ORF amplification
ggatccagctagcaaaatgcctgcgtatcactcgactttc

SEQ ID NO: 5839 - DNA, 40 bp, Artificial Sequence
  PCR primer for ORF amplification
ggatccagctagcaaaatgtcttcctccaagcgtattgcc

SEQ ID NO: 5840 - DNA, 40 bp, Artificial Sequence
  PCR primer for ORF amplification
ggatccagctagcaaaatgtcaaatccatttcaaaatata

SEQ ID NO: 5841 - DNA, 40 bp, Artificial Sequence
  PCR primer for ORF amplification
ggatccagctagcaaaatgaaaaagaccccagacccatct

SEQ ID NO: 5842 - DNA, 40 bp, Artificial Sequence
  PCR primer for ORF amplification
ggatccagctagcaaaatgaaatcatttcaaaaatcttat

SEQ ID NO: 5843 - DNA, 40 bp, Artificial Sequence
  PCR primer for ORF amplification
ggatccagctagcaaaatgagagaatataccagtaaaaaa

SEQ ID NO: 5844 - DNA, 40 bp, Artificial Sequence
  PCR primer for ORF amplification
ggatccagctagcaaaatgatatcatatgaattccaaact

SEQ ID NO: 5845 - DNA, 40 bp, Artificial Sequence
  PCR primer for ORF amplification
ggatccagctagcaaaatgatcaatttcctcctttttgtc

SEQ ID NO: 5846 - DNA, 40 bp, Artificial Sequence
  PCR primer for ORF amplification
ggatccagctagcaaaatgcctggtcttaagcttgttgaa

SEQ ID NO: 5847 - DNA, 40 bp, Artificial Sequence
  PCR primer for ORF amplification
ggatccagctagcaaaatggggtcgggcgatttgaatctg

SEQ ID NO: 5848 - DNA, 40 bp, Artificial Sequence
  PCR primer for ORF amplification
ggatccagctagcaaaatggtggttttagacaagaagtta

SEQ ID NO: 5849 - DNA, 40 bp, Artificial Sequence
  PCR primer for ORF amplification
ggatccagctagcaaaatggttaaggtatatattcatgac

SEQ ID NO: 5850 - DNA, 40 bp, Artificial Sequence
  PCR primer for ORF amplification
ggatccagctagcaaaatggctgtcaagactggtatgttt

SEQ ID NO: 5851 - DNA, 40 bp, Artificial Sequence
  PCR primer for ORF amplification
ggatccagctagcaaaatggctgtatgttagaaagatatt

SEQ ID NO: 5852 - DNA, 40 bp, Artificial Sequence
  PCR primer for ORF amplification
ggatccagctagcaaaatgtcttcttctaaacgtattgct

SEQ ID NO: 5853 - DNA, 40 bp, Artificial Sequence
  PCR primer for ORF amplification
ggatccagctagcaaaatgagtggaagtaatatgggatac

SEQ ID NO: 5854 - DNA, 40 bp, Artificial Sequence
  PCR primer for ORF amplification
ggatccagctagcaaaatgccaccaccatcaagaagtaga

SEQ ID NO: 5855 - DNA, 40 bp, Artificial Sequence
  PCR primer for ORF amplification
ggatccagctagcaaaatgctatacacaaggttgttacgt

SEQ ID NO: 5856 - DNA, 40 bp, Artificial Sequence
  PCR primer for ORF amplification
ggatccagctagcaaaatgggctcatcaaccgggtttcat

SEQ ID NO: 5857 - DNA, 40 bp, Artificial Sequence
  PCR primer for ORF amplification
ggatccagctagcaaaatgtcagactacgaggaggcgtat

SEQ ID NO: 5858 - DNA, 40 bp, Artificial Sequence
  PCR primer for ORF amplification
ggatccagctagcaaaatgaatactgaaggtgcttcttta

SEQ ID NO: 5859 - DNA, 40 bp, Artificial Sequence
  PCR primer for ORF amplification
ggatccagctagcaaaatgacaaacagtagtgaaaaacaa

SEQ ID NO: 5860 - DNA, 40 bp, Artificial Sequence
  PCR primer for ORF amplification
ggatccagctagcaaaatgagacagctaacagaagaagag

SEQ ID NO: 5861 - DNA, 40 bp, Artificial Sequence
  PCR primer for ORF amplification
ggatccagctagcaaaatgagtgaaacaaggatggcacag

SEQ ID NO: 5862 - DNA, 40 bp, Artificial Sequence
  PCR primer for ORF amplification
ggatccagctagcaaaatgatgttgccaagatccatgaaa

SEQ ID NO: 5863 - DNA, 40 bp, Artificial Sequence
  PCR primer for ORF amplification
ggatccagctagcaaaatgccttataaaacagctatagat

SEQ ID NO: 5864 - DNA, 40 bp, Artificial Sequence
  PCR primer for ORF amplification
ggatccagctagcaaaatggctggcaaagcagggaggaaa

SEQ ID NO: 5865 - DNA, 40 bp, Artificial Sequence
  PCR primer for ORF amplification
ggatccagctagcaaaatgggtctatacgcttctaagtta

SEQ ID NO: 5866 - DNA, 40 bp, Artificial Sequence
  PCR primer for ORF amplification
ggatccagctagcaaaatgggtttgtttgcctctaagttg

SEQ ID NO: 5867 - DNA, 40 bp, Artificial Sequence
  PCR primer for ORF amplification
ggatccagctagcaaaatgtctatttctgaatcttacgca

SEQ ID NO: 5868 - DNA, 40 bp, Artificial Sequence
  PCR primer for ORF amplification
ggatccagctagcaaaatgagcatgtataacaaacactga

SEQ ID NO: 5869 - DNA, 40 bp, Artificial Sequence
  PCR primer for ORF amplification
ggatccagctagcaaaatgccgaaagtaattctggagtct

SEQ ID NO: 5870 - DNA, 40 bp, Artificial Sequence
  PCR primer for ORF amplification
ggatccagctagcaaaatggtcagtataacatgattttat

SEQ ID NO: 5871 - DNA, 40 bp, Artificial Sequence
  PCR primer for ORF amplification
ggatccagctagcaaaatgatattacttcatgccatatat

SEQ ID NO: 5872 - DNA, 40 bp, Artificial Sequence
  PCR primer for ORF amplification
ggatccagctagcaaaatgccgttatttttggttctgaaa

SEQ ID NO: 5873 - DNA, 40 bp, Artificial Sequence
  PCR primer for ORF amplification
ggatccagctagcaaaatgtccatcgaggaggaagataca

SEQ ID NO: 5874 - DNA, 40 bp, Artificial Sequence
  PCR primer for ORF amplification
ggatccagctagcaaaatgttaaaaagacgctctaatgct

SEQ ID NO: 5875 - DNA, 40 bp, Artificial Sequence
  PCR primer for ORF amplification
ggatccagctagcaaaatgtttaaacgttccatcattcaa

SEQ ID NO: 5876 - DNA, 40 bp, Artificial Sequence
  PCR primer for ORF amplification
ggatccagctagcaaaatgaacagttacagcctattaact

SEQ ID NO: 5877 - DNA, 40 bp, Artificial Sequence
  PCR primer for ORF amplification
ggatccagctagcaaaatgaattctttgatttttggtaaa

SEQ ID NO: 5878 - DNA, 40 bp, Artificial Sequence
  PCR primer for ORF amplification
ggatccagctagcaaaatgccaaacttctggattcttgag

SEQ ID NO: 5879 - DNA, 40 bp, Artificial Sequence
  PCR primer for ORF amplification
ggatccagctagcaaaatgggcaattcaatttcgaaggtt

SEQ ID NO: 5880 - DNA, 40 bp, Artificial Sequence
  PCR primer for ORF amplification
ggatccagctagcaaaatgggtaacatttttagttcaatg

SEQ ID NO: 5881 - DNA, 40 bp, Artificial Sequence
  PCR primer for ORF amplification
ggatccagctagcaaaatggttagaaaactaaagcatcat

SEQ ID NO: 5882 - DNA, 40 bp, Artificial Sequence
  PCR primer for ORF amplification
ggatccagctagcaaaatgtacaaaacatggcgtctatgc

SEQ ID NO: 5883 - DNA, 40 bp, Artificial Sequence
  PCR primer for ORF amplification
ggatccagctagcaaaatgtcaaacagtcatcatacatcc

SEQ ID NO: 5884 - DNA, 40 bp, Artificial Sequence
  PCR primer for ORF amplification
ggatccagctagcaaaatgtcccagtcgaaccctatctta

SEQ ID NO: 5885 - DNA, 40 bp, Artificial Sequence
  PCR primer for ORF amplification
ggatccagctagcaaaatgtatgcatataatagaggaatt

SEQ ID NO: 5886 - DNA, 40 bp, Artificial Sequence
  PCR primer for ORF amplification
ggatccagctagcaaaatgaacaccaatagtaatactatg

SEQ ID NO: 5887 - DNA, 40 bp, Artificial Sequence
  PCR primer for ORF amplification
ggatccagctagcaaaatggaagatatcgaaaagataaaa

SEQ ID NO: 5888 - DNA, 40 bp, Artificial Sequence
  PCR primer for ORF amplification
ggatccagctagcaaaatggaggcagatgatcatgttagc

SEQ ID NO: 5889 - DNA, 40 bp, Artificial Sequence
  PCR primer for ORF amplification
ggatccagctagcaaaatgggagccgtactcagctgttgt

SEQ ID NO: 5890 - DNA, 40 bp, Artificial Sequence
  PCR primer for ORF amplification
ggatccagctagcaaaatgtcgtcgcttatttcaaaaacc

SEQ ID NO: 5891 - DNA, 40 bp, Artificial Sequence
  PCR primer for ORF amplification
ggatccagctagcaaaatgttctcctttgtccaaagattc

SEQ ID NO: 5892 - DNA, 40 bp, Artificial Sequence
  PCR primer for ORF amplification
ggatccagctagcaaaatgttgaaatacttggttcaacga

SEQ ID NO: 5893 - DNA, 40 bp, Artificial Sequence
  PCR primer for ORF amplification
ggatccagctagcaaaatgaggtatgttattcattaccaa

SEQ ID NO: 5894 - DNA, 40 bp, Artificial Sequence
  PCR primer for ORF amplification
ggatccagctagcaaaatgaaatgtctatatatcttgagt

SEQ ID NO: 5895 - DNA, 40 bp, Artificial Sequence
  PCR primer for ORF amplification
ggatccagctagcaaaatgaacatcagtggcaccttaaat

SEQ ID NO: 5896 - DNA, 40 bp, Artificial Sequence
  PCR primer for ORF amplification
ggatccagctagcaaaatgacaacaacctcaacaaccagt

SEQ ID NO: 5897 - DNA, 40 bp, Artificial Sequence
  PCR primer for ORF amplification
ggatccagctagcaaaatgagcaagttttcacttaagttg

SEQ ID NO: 5898 - DNA, 40 bp, Artificial Sequence
  PCR primer for ORF amplification
ggatccagctagcaaaatgcaggctaaattattgtttacc

SEQ ID NO: 5899 - DNA, 40 bp, Artificial Sequence
  PCR primer for ORF amplification
ggatccagctagcaaaatggatgcattcagcttaaagaag

SEQ ID NO: 5900 - DNA, 40 bp, Artificial Sequence
  PCR primer for ORF amplification
ggatccagctagcaaaatgttcagacaatcaattaggcca

SEQ ID NO: 5901 - DNA, 40 bp, Artificial Sequence
  PCR primer for ORF amplification
ggatccagctagcaaaatgagttcaaggtatgagaaatta

SEQ ID NO: 5902 - DNA, 40 bp, Artificial Sequence
  PCR primer for ORF amplification
ggatccagctagcaaaatgagtaggatcctagagagcgaa

SEQ ID NO: 5903 - DNA, 40 bp, Artificial Sequence
  PCR primer for ORF amplification
ggatccagctagcaaaatgagtgctaacaatggtgtcact

SEQ ID NO: 5904 - DNA, 40 bp, Artificial Sequence
  PCR primer for ORF amplification
ggatccagctagcaaaatgccggtcttaaatacgagaact

SEQ ID NO: 5905 - DNA, 40 bp, Artificial Sequence
  PCR primer for ORF amplification
ggatccagctagcaaaatgagtgcgaaacaagggtgggaa

SEQ ID NO: 5906 - DNA, 40 bp, Artificial Sequence
  PCR primer for ORF amplification
ggatccagctagcaaaatgagtgtcagccttgagcaaacg

SEQ ID NO: 5907 - DNA, 40 bp, Artificial Sequence
  PCR primer for ORF amplification
ggatccagctagcaaaatgataataacaattaaattcgag

SEQ ID NO: 5908 - DNA, 40 bp, Artificial Sequence
  PCR primer for ORF amplification
ggatccagctagcaaaatgcaagtctccccagctattgta

SEQ ID NO: 5909 - DNA, 40 bp, Artificial Sequence
  PCR primer for ORF amplification
ggatccagctagcaaaatgctacctttatatcttttaaca

SEQ ID NO: 5910 - DNA, 40 bp, Artificial Sequence
  PCR primer for ORF amplification
ggatccagctagcaaaatgtcccgtcctatcgtaatttct

SEQ ID NO: 5911 - DNA, 40 bp, Artificial Sequence
  PCR primer for ORF amplification
ggatccagctagcaaaatgtctatagcaagttatgcccaa

SEQ ID NO: 5912 - DNA, 40 bp, Artificial Sequence
  PCR primer for ORF amplification
ggatccagctagcaaaatgttatataacaaagagcaggga

SEQ ID NO: 5913 - DNA, 40 bp, Artificial Sequence
  PCR primer for ORF amplification
ggatccagctagcaaaatgaaggaactgctttactataca

SEQ ID NO: 5914 - DNA, 40 bp, Artificial Sequence
  PCR primer for ORF amplification
ggatccagctagcaaaatgaatcctcaagtcagtaacatc

SEQ ID NO: 5915 - DNA, 40 bp, Artificial Sequence
  PCR primer for ORF amplification
ggatccagctagcaaaatgcctttagaatctatatgggcc

SEQ ID NO: 5916 - DNA, 40 bp, Artificial Sequence
  PCR primer for ORF amplification
ggatccagctagcaaaatggattacgatagctctgataca

SEQ ID NO: 5917 - DNA, 40 bp, Artificial Sequence
  PCR primer for ORF amplification
ggatccagctagcaaaatggatttacccaaggacaaaagt

SEQ ID NO: 5918 - DNA, 40 bp, Artificial Sequence
  PCR primer for ORF amplification
ggatccagctagcaaaatgggcaaaaccgcggataatcat

SEQ ID NO: 5919 - DNA, 40 bp, Artificial Sequence
  PCR primer for ORF amplification
ggatccagctagcaaaatggatgataagaaaacatggagt

SEQ ID NO: 5920 - DNA, 40 bp, Artificial Sequence
  PCR primer for ORF amplification
ggatccagctagcaaaatgggtaaagctaagaaaacaaga

SEQ ID NO: 5921 - DNA, 40 bp, Artificial Sequence
  PCR primer for ORF amplification
ggatccagctagcaaaatggtgccgaatttggatttggaa

SEQ ID NO: 5922 - DNA, 40 bp, Artificial Sequence
  PCR primer for ORF amplification
ggatccagctagcaaaatgtccaattttttacttgtgatc

SEQ ID NO: 5923 - DNA, 40 bp, Artificial Sequence
  PCR primer for ORF amplification
ggatccagctagcaaaatgtcttctttatcgctatatact

SEQ ID NO: 5924 - DNA, 40 bp, Artificial Sequence
  PCR primer for ORF amplification
ggatccagctagcaaaatgacggttggtacacttcccatc

SEQ ID NO: 5925 - DNA, 40 bp, Artificial Sequence
  PCR primer for ORF amplification
ggatccagctagcaaaatgagtgaacaggagccttacgaa

SEQ ID NO: 5926 - DNA, 40 bp, Artificial Sequence
  PCR primer for ORF amplification
ggatccagctagcaaaatggatccattgactgtatacaaa

SEQ ID NO: 5927 - DNA, 40 bp, Artificial Sequence
  PCR primer for ORF amplification
ggatccagctagcaaaatgggagccaagacgtcaaagctt

SEQ ID NO: 5928 - DNA, 40 bp, Artificial Sequence
  PCR primer for ORF amplification
ggatccagctagcaaaatgtccagattaagaagattcaat

SEQ ID NO: 5929 - DNA, 40 bp, Artificial Sequence
  PCR primer for ORF amplification
ggatccagctagcaaaatgtccggtaaatggagactagtg

SEQ ID NO: 5930 - DNA, 40 bp, Artificial Sequence
  PCR primer for ORF amplification
ggatccagctagcaaaatgtcctctcaaaaaagtatgtaa

SEQ ID NO: 5931 - DNA, 40 bp, Artificial Sequence
  PCR primer for ORF amplification
ggatccagctagcaaaatgaaagtgggtattataatgggt

SEQ ID NO: 5932 - DNA, 40 bp, Artificial Sequence
  PCR primer for ORF amplification
ggatccagctagcaaaatgaaatacatccaaactgaacaa

SEQ ID NO: 5933 - DNA, 40 bp, Artificial Sequence
  PCR primer for ORF amplification
ggatccagctagcaaaatgaagtacattcaaaccgaacaa

SEQ ID NO: 5934 - DNA, 40 bp, Artificial Sequence
  PCR primer for ORF amplification
ggatccagctagcaaaatgcaaacgctaaagtgtgttgtt

SEQ ID NO: 5935 - DNA, 40 bp, Artificial Sequence
  PCR primer for ORF amplification
ggatccagctagcaaaatggaaaaatttggtttaaaagcg

SEQ ID NO: 5936 - DNA, 40 bp, Artificial Sequence
  PCR primer for ORF amplification
ggatccagctagcaaaatggaggatcaggatgctgcattt

SEQ ID NO: 5937 - DNA, 40 bp, Artificial Sequence
  PCR primer for ORF amplification
ggatccagctagcaaaatggcctcctcaagtagcacgcta

SEQ ID NO: 5938 - DNA, 40 bp, Artificial Sequence
  PCR primer for ORF amplification
ggatccagctagcaaaatggctgtttctaatatatggcaa

SEQ ID NO: 5939 - DNA, 40 bp, Artificial Sequence
  PCR primer for ORF amplification
ggatccagctagcaaaatgggactactaagtattatcagg

SEQ ID NO: 5940 - DNA, 40 bp, Artificial Sequence
  PCR primer for ORF amplification
ggatccagctagcaaaatgctattgtttcctggcttgaag

SEQ ID NO: 5941 - DNA, 40 bp, Artificial Sequence
  PCR primer for ORF amplification
ggatccagctagcaaaatgtctgaaaaggccgttagaagg

SEQ ID NO: 5942 - DNA, 40 bp, Artificial Sequence
  PCR primer for ORF amplification
ggatccagctagcaaaatgacagagaaacacaaaactatg

SEQ ID NO: 5943 - DNA, 40 bp, Artificial Sequence
  PCR primer for ORF amplification
ggatccagctagcaaaatgacagctcatgcaaatgaaagg

SEQ ID NO: 5944 - DNA, 40 bp, Artificial Sequence
  PCR primer for ORF amplification
ggatccagctagcaaaatggttacccttgaatacaatgca

SEQ ID NO: 5945 - DNA, 40 bp, Artificial Sequence
  PCR primer for ORF amplification
ggatccagctagcaaaatggtttctaccacgcaatcgagg

SEQ ID NO: 5946 - DNA, 40 bp, Artificial Sequence
  PCR primer for ORF amplification
ggatccagctagcaaaatgtccccaactggaaactactta

SEQ ID NO: 5947 - DNA, 40 bp, Artificial Sequence
  PCR primer for ORF amplification
ggatccagctagcaaaatgtctgctgttgcaacttatttg

SEQ ID NO: 5948 - DNA, 40 bp, Artificial Sequence
  PCR primer for ORF amplification
ggatccagctagcaaaatgtgtttagtcaaaactacggct

SEQ ID NO: 5949 - DNA, 40 bp, Artificial Sequence
  PCR primer for ORF amplification
ggatccagctagcaaaatgagtagtttgtgtctacagcgt

SEQ ID NO: 5950 - DNA, 40 bp, Artificial Sequence
  PCR primer for ORF amplification
ggatccagctagcaaaatgggttactatgacattgatgat

SEQ ID NO: 5951 - DNA, 40 bp, Artificial Sequence
  PCR primer for ORF amplification
ggatccagctagcaaaatggtgacttctaatgttgtccta

SEQ ID NO: 5952 - DNA, 40 bp, Artificial Sequence
  PCR primer for ORF amplification
ggatccagctagcaaaatgtccttacgtatactagcgaag

SEQ ID NO: 5953 - DNA, 40 bp, Artificial Sequence
  PCR primer for ORF amplification
ggatccagctagcaaaatgtcgaattttggcagaagaact

SEQ ID NO: 5954 - DNA, 40 bp, Artificial Sequence
  PCR primer for ORF amplification
ggatccagctagcaaaatggaaaacgataagggccaatta

SEQ ID NO: 5955 - DNA, 40 bp, Artificial Sequence
  PCR primer for ORF amplification
ggatccagctagcaaaatgacaacaattcagccttttgaa

SEQ ID NO: 5956 - DNA, 40 bp, Artificial Sequence
  PCR primer for ORF amplification
ggatccagctagcaaaatgacagatccccacttgaacacg

SEQ ID NO: 5957 - DNA, 40 bp, Artificial Sequence
  PCR primer for ORF amplification
ggatccagctagcaaaatgattggcagaggtgtgtgctgc

SEQ ID NO: 5958 - DNA, 40 bp, Artificial Sequence
  PCR primer for ORF amplification
ggatccagctagcaaaatggagccattgatatcggcaccg

SEQ ID NO: 5959 - DNA, 40 bp, Artificial Sequence
  PCR primer for ORF amplification
ggatccagctagcaaaatggccttcaccacaattcgatcg

SEQ ID NO: 5960 - DNA, 40 bp, Artificial Sequence
  PCR primer for ORF amplification
ggatccagctagcaaaatggtgaccgtggtggcggagaca

SEQ ID NO: 5961 - DNA, 40 bp, Artificial Sequence
  PCR primer for ORF amplification
ggatccagctagcaaaatgtccgggtcgttaaaatctcta

SEQ ID NO: 5962 - DNA, 40 bp, Artificial Sequence
  PCR primer for ORF amplification
ggatccagctagcaaaatgtcttggcaaggtatgtgaacg

SEQ ID NO: 5963 - DNA, 40 bp, Artificial Sequence
  PCR primer for ORF amplification
ggatccagctagcaaaatgaaacagatagtcaaaagaagc

SEQ ID NO: 5964 - DNA, 40 bp, Artificial Sequence
  PCR primer for ORF amplification
ggatccagctagcaaaatgaaagcaaccattcaaagagta

SEQ ID NO: 5965 - DNA, 40 bp, Artificial Sequence
  PCR primer for ORF amplification
ggatccagctagcaaaatgaatgttacagttactgtttat

SEQ ID NO: 5966 - DNA, 40 bp, Artificial Sequence
  PCR primer for ORF amplification
ggatccagctagcaaaatgagcaaaatacaggtggcacat

SEQ ID NO: 5967 - DNA, 40 bp, Artificial Sequence
  PCR primer for ORF amplification
ggatccagctagcaaaatgagtagggccaaagaattacaa

SEQ ID NO: 5968 - DNA, 40 bp, Artificial Sequence
  PCR primer for ORF amplification
ggatccagctagcaaaatgcagataataaccactacgttc

SEQ ID NO: 5969 - DNA, 40 bp, Artificial Sequence
  PCR primer for ORF amplification
ggatccagctagcaaaatgccaccaaaaggttggagaaaa

SEQ ID NO: 5970 - DNA, 40 bp, Artificial Sequence
  PCR primer for ORF amplification
ggatccagctagcaaaatgggcgtattagaaaatatagta

SEQ ID NO: 5971 - DNA, 40 bp, Artificial Sequence
  PCR primer for ORF amplification
ggatccagctagcaaaatggtagcagaagttcaaaaacaa

SEQ ID NO: 5972 - DNA, 40 bp, Artificial Sequence
  PCR primer for ORF amplification
ggatccagctagcaaaatggtcgctcaagttcaaaagcaa

SEQ ID NO: 5973 - DNA, 40 bp, Artificial Sequence
  PCR primer for ORF amplification
ggatccagctagcaaaatggttgataataggcgtacgttt

SEQ ID NO: 5974 - DNA, 40 bp, Artificial Sequence
  PCR primer for ORF amplification
ggatccagctagcaaaatgtcacaatcaatatcactaaag

SEQ ID NO: 5975 - DNA, 40 bp, Artificial Sequence
  PCR primer for ORF amplification
ggatccagctagcaaaatgaaatacatacccccattaaat

SEQ ID NO: 5976 - DNA, 40 bp, Artificial Sequence
  PCR primer for ORF amplification
ggatccagctagcaaaatgaagttattgcatttatatgaa

SEQ ID NO: 5977 - DNA, 40 bp, Artificial Sequence
  PCR primer for ORF amplification
ggatccagctagcaaaatgagcaacaacgaaattgtattt

SEQ ID NO: 5978 - DNA, 40 bp, Artificial Sequence
  PCR primer for ORF amplification
ggatccagctagcaaaatgatgcattttagaaagaaatcc

SEQ ID NO: 5979 - DNA, 40 bp, Artificial Sequence
  PCR primer for ORF amplification
ggatccagctagcaaaatgatgttaagactagtaactaaa

SEQ ID NO: 5980 - DNA, 40 bp, Artificial Sequence
  PCR primer for ORF amplification
ggatccagctagcaaaatggaactccgtagtttttctaga

SEQ ID NO: 5981 - DNA, 40 bp, Artificial Sequence
  PCR primer for ORF amplification
ggatccagctagcaaaatggaagcaagacggtatggaccg

SEQ ID NO: 5982 - DNA, 40 bp, Artificial Sequence
  PCR primer for ORF amplification
ggatccagctagcaaaatgtctgtttgtttagccatcaca

SEQ ID NO: 5983 - DNA, 40 bp, Artificial Sequence
  PCR primer for ORF amplification
ggatccagctagcaaaatgtttaccagtgccattagattg

SEQ ID NO: 5984 - DNA, 40 bp, Artificial Sequence; identical to SEQ ID NO: 5456
  PCR primer for ORF amplification

SEQ ID NO: 5985 - DNA, 40 bp, Artificial Sequence
  PCR primer for ORF amplification
ggatccagctagcaaaatgaataaagaccaggcagaaaaa

SEQ ID NO: 5986 - DNA, 40 bp, Artificial Sequence
  PCR primer for ORF amplification
ggatccagctagcaaaatgactttggcttttaatatgcaa

SEQ ID NO: 5987 - DNA, 40 bp, Artificial Sequence
  PCR primer for ORF amplification
ggatccagctagcaaaatgcaacaagatatcgtcaacgat

SEQ ID NO: 5988 - DNA, 40 bp, Artificial Sequence
  PCR primer for ORF amplification
ggatccagctagcaaaatgccaagagtagctatcatcatt

SEQ ID NO: 5989 - DNA, 40 bp, Artificial Sequence
  PCR primer for ORF amplification
ggatccagctagcaaaatggatattattctgggcatccgt

SEQ ID NO: 5990 - DNA, 40 bp, Artificial Sequence
  PCR primer for ORF amplification
ggatccagctagcaaaatggctattaaaccaaccaaaagt

SEQ ID NO: 5991 - DNA, 40 bp, Artificial Sequence
  PCR primer for ORF amplification
ggatccagctagcaaaatggtccggcctcagaatgttcac

SEQ ID NO: 5992 - DNA, 40 bp, Artificial Sequence
  PCR primer for ORF amplification
ggatccagctagcaaaatggtcgaatctaagaatactgaa

SEQ ID NO: 5993 - DNA, 40 bp, Artificial Sequence
  PCR primer for ORF amplification
ggatccagctagcaaaatggtgagaaatcgttttataaga

SEQ ID NO: 5994 - DNA, 40 bp, Artificial Sequence
  PCR primer for ORF amplification
ggatccagctagcaaaatgtcaatttctctattaggtaga

SEQ ID NO: 5995 - DNA, 40 bp, Artificial Sequence
  PCR primer for ORF amplification
ggatccagctagcaaaatgtctaaagacacgcatgatgat

SEQ ID NO: 5996 - DNA, 40 bp, Artificial Sequence
  PCR primer for ORF amplification
ggatccagctagcaaaatgtctgaattcttttgggatgta

SEQ ID NO: 5997 - DNA, 40 bp, Artificial Sequence
  PCR primer for ORF amplification
ggatccagctagcaaaatgtctgcaatgatggtcaagtta

SEQ ID NO: 5998 - DNA, 40 bp, Artificial Sequence
  PCR primer for ORF amplification
ggatccagctagcaaaatgttaagagaagtcatctattgt

SEQ ID NO: 5999 - DNA, 40 bp, Artificial Sequence
  PCR primer for ORF amplification
ggatccagctagcaaaatgtttcatttagtcaagggactt

SEQ ID NO: 6000 - DNA, 40 bp, Artificial Sequence
  PCR primer for ORF amplification
ggatccagctagcaaaatgacatcgattaacagttttccc

SEQ ID NO: 6001 - DNA, 40 bp, Artificial Sequence
  PCR primer for ORF amplification
ggatccagctagcaaaatgagaatttatcaatgccatttt

SEQ ID NO: 6002 - DNA, 40 bp, Artificial Sequence
  PCR primer for ORF amplification
ggatccagctagcaaaatggaagcaaccatcaaagtggta

SEQ ID NO: 6003 - DNA, 40 bp, Artificial Sequence
  PCR primer for ORF amplification
ggatccagctagcaaaatggacaaaatcagagaaaagcta

SEQ ID NO: 6004 - DNA, 40 bp, Artificial Sequence
  PCR primer for ORF amplification
ggatccagctagcaaaatggacacactgttcaactccacg

SEQ ID NO: 6005 - DNA, 40 bp, Artificial Sequence
  PCR primer for ORF amplification
ggatccagctagcaaaatggaccaggcaagaaatttctac

SEQ ID NO: 6006 - DNA, 40 bp, Artificial Sequence
  PCR primer for ORF amplification
ggatccagctagcaaaatggcgaaacacattgttgctgcc

SEQ ID NO: 6007 - DNA, 40 bp, Artificial Sequence
  PCR primer for ORF amplification
ggatccagctagcaaaatggtatgttagtatccaataaat

SEQ ID NO: 6008 - DNA, 40 bp, Artificial Sequence
  PCR primer for ORF amplification
ggatccagctagcaaaatgtctgcaaacgaattctactca

SEQ ID NO: 6009 - DNA, 40 bp, Artificial Sequence
  PCR primer for ORF amplification
ggatccagctagcaaaatgggtatttctcgtgattctcgt

SEQ ID NO: 6010 - DNA, 40 bp, Artificial Sequence
  PCR primer for ORF amplification
ggatccagctagcaaaatgaagtctagtaagcaattggtt

SEQ ID NO: 6011 - DNA, 40 bp, Artificial Sequence
  PCR primer for ORF amplification
ggatccagctagcaaaatgagaatctactacatcggtgta

SEQ ID NO: 6012 - DNA, 40 bp, Artificial Sequence
  PCR primer for ORF amplification
ggatccagctagcaaaatgagttacgataagaaggcagat

SEQ ID NO: 6013 - DNA, 40 bp, Artificial Sequence
  PCR primer for ORF amplification
ggatccagctagcaaaatggagcaaatattatataatcaa

SEQ ID NO: 6014 - DNA, 40 bp, Artificial Sequence
  PCR primer for ORF amplification
ggatccagctagcaaaatggcaggtatcaagttgacgcat

SEQ ID NO: 6015 - DNA, 40 bp, Artificial Sequence
  PCR primer for ORF amplification
ggatccagctagcaaaatggcttggactagtacattacca

SEQ ID NO: 6016 - DNA, 40 bp, Artificial Sequence
  PCR primer for ORF amplification
ggatccagctagcaaaatgggcctacacagtgaaccgtta

SEQ ID NO: 6017 - DNA, 40 bp, Artificial Sequence
  PCR primer for ORF amplification
ggatccagctagcaaaatggtacgttaatattgtgttaaa

SEQ ID NO: 6018 - DNA, 40 bp, Artificial Sequence
  PCR primer for ORF amplification
ggatccagctagcaaaatgggtgctgctccttccaaaatt

SEQ ID NO: 6019 - DNA, 40 bp, Artificial Sequence
  PCR primer for ORF amplification
ggatccagctagcaaaatgaaaccagtaacatgttgcaac

SEQ ID NO: 6020 - DNA, 40 bp, Artificial Sequence
  PCR primer for ORF amplification
ggatccagctagcaaaatgagtagtgacggcatgaacaga

SEQ ID NO: 6021 - DNA, 40 bp, Artificial Sequence
  PCR primer for ORF amplification
ggatccagctagcaaaatggatgagatggataatgtgata

SEQ ID NO: 6022 - DNA, 40 bp, Artificial Sequence
  PCR primer for ORF amplification
ggatccagctagcaaaatggctaggccagttaatacaaac

SEQ ID NO: 6023 - DNA, 40 bp, Artificial Sequence
  PCR primer for ORF amplification
ggatccagctagcaaaatggttaactcacatggaatacgg

SEQ ID NO: 6024 - DNA, 40 bp, Artificial Sequence
  PCR primer for ORF amplification
ggatccagctagcaaaatgtcagccaatgtacaagaagct

SEQ ID NO: 6025 - DNA, 40 bp, Artificial Sequence
  PCR primer for ORF amplification
ggatccagctagcaaaatgtccaacttagttaaagaaaaa

SEQ ID NO: 6026 - DNA, 40 bp, Artificial Sequence
  PCR primer for ORF amplification
ggatccagctagcaaaatgtctagcgaagataagaaacct

SEQ ID NO: 6027 - DNA, 40 bp, Artificial Sequence
  PCR primer for ORF amplification
ggatccagctagcaaaatgtctagtgccatcgttgctaaa

SEQ ID NO: 6028 - DNA, 40 bp, Artificial Sequence; identical to SEQ ID NO: 5422
  PCR primer for ORF amplification

SEQ ID NO: 6029 - DNA, 40 bp, Artificial Sequence
  PCR primer for ORF amplification
ggatccagctagcaaaatgacaacattgatgggaaagttt

SEQ ID NO: 6030 - DNA, 40 bp, Artificial Sequence
  PCR primer for ORF amplification
ggatccagctagcaaaatgctaaattataaattgatttta

SEQ ID NO: 6031 - DNA, 40 bp, Artificial Sequence
  PCR primer for ORF amplification
ggatccagctagcaaaatggccgaagaaagtaccgacttt

SEQ ID NO: 6032 - DNA, 40 bp, Artificial Sequence
  PCR primer for ORF amplification
ggatccagctagcaaaatggctactaatattacttggcat

SEQ ID NO: 6033 - DNA, 40 bp, Artificial Sequence
  PCR primer for ORF amplification
ggatccagctagcaaaatgggtattattgaagaaaaggct

SEQ ID NO: 6034 - DNA, 40 bp, Artificial Sequence
  PCR primer for ORF amplification
ggatccagctagcaaaatgtctgcattacctccagtatac

SEQ ID NO: 6035 - DNA, 40 bp, Artificial Sequence
  PCR primer for ORF amplification
ggatccagctagcaaaatgaatcagttaggagctttagcc

SEQ ID NO: 6036 - DNA, 40 bp, Artificial Sequence
  PCR primer for ORF amplification
ggatccagctagcaaaatgtctagatctgggtatgctaaa

SEQ ID NO: 6037 - DNA, 40 bp, Artificial Sequence
  PCR primer for ORF amplification
ggatccagctagcaaaatgttcaatcgttttaacaaattc

SEQ ID NO: 6038 - DNA, 40 bp, Artificial Sequence
  PCR primer for ORF amplification
ggatccagctagcaaaatgaaagaggcagaacttagtgcg

SEQ ID NO: 6039 - DNA, 40 bp, Artificial Sequence
  PCR primer for ORF amplification
ggatccagctagcaaaatgataaatgagtacgttgccaga

SEQ ID NO: 6040 - DNA, 40 bp, Artificial Sequence
  PCR primer for ORF amplification
ggatccagctagcaaaatgcttagaaataccattgcatta

SEQ ID NO: 6041 - DNA, 40 bp, Artificial Sequence
  PCR primer for ORF amplification
ggatccagctagcaaaatggacaaagcatttgacgaaatt

SEQ ID NO: 6042 - DNA, 40 bp, Artificial Sequence
  PCR primer for ORF amplification
ggatccagctagcaaaatggaggattcgagattgcttatc

SEQ ID NO: 6043 - DNA, 40 bp, Artificial Sequence
  PCR primer for ORF amplification
ggatccagctagcaaaatggcctcatttgctactaagttt

SEQ ID NO: 6044 - DNA, 40 bp, Artificial Sequence
  PCR primer for ORF amplification
ggatccagctagcaaaatggctattgttataaacaaaaga

SEQ ID NO: 6045 - DNA, 40 bp, Artificial Sequence
  PCR primer for ORF amplification
ggatccagctagcaaaatggctcaagccttgaactccacc

SEQ ID NO: 6046 - DNA, 40 bp, Artificial Sequence
  PCR primer for ORF amplification
ggatccagctagcaaaatggtttcgataagaaggtatttg

SEQ ID NO: 6047 - DNA, 40 bp, Artificial Sequence
  PCR primer for ORF amplification
ggatccagctagcaaaatgtcagcagaagattacaagaac

SEQ ID NO: 6048 - DNA, 40 bp, Artificial Sequence
  PCR primer for ORF amplification
ggatccagctagcaaaatgtcagttgaagaaaaaaagcgc

SEQ ID NO: 6049 - DNA, 40 bp, Artificial Sequence
  PCR primer for ORF amplification
ggatccagctagcaaaatgtcattatattacaccttggtt

SEQ ID NO: 6050 - DNA, 40 bp, Artificial Sequence
  PCR primer for ORF amplification
ggatccagctagcaaaatgaaactcaatgaacaaatacca

SEQ ID NO: 6051 - DNA, 40 bp, Artificial Sequence
  PCR primer for ORF amplification
ggatccagctagcaaaatgaaattctcttccgctttggtt

SEQ ID NO: 6052 - DNA, 40 bp, Artificial Sequence
  PCR primer for ORF amplification
ggatccagctagcaaaatgaagttctcttctgttactgct

SEQ ID NO: 6053 - DNA, 40 bp, Artificial Sequence
  PCR primer for ORF amplification
ggatccagctagcaaaatgaatagcggtggtagtgatagt

SEQ ID NO: 6054 - DNA, 40 bp, Artificial Sequence
  PCR primer for ORF amplification
ggatccagctagcaaaatgacagctgccactacatcacag

SEQ ID NO: 6055 - DNA, 40 bp, Artificial Sequence
  PCR primer for ORF amplification
ggatccagctagcaaaatggcaccaaagaaaccttctaag

SEQ ID NO: 6056 - DNA, 40 bp, Artificial Sequence
  PCR primer for ORF amplification
ggatccagctagcaaaatgggagcctacaaatatttagaa

SEQ ID NO: 6057 - DNA, 40 bp, Artificial Sequence
  PCR primer for ORF amplification
ggatccagctagcaaaatgggcaatgtgtctgtggcagtg

SEQ ID NO: 6058 - DNA, 40 bp, Artificial Sequence
  PCR primer for ORF amplification
ggatccagctagcaaaatgggtgcctacaaatatttggaa

SEQ ID NO: 6059 - DNA, 40 bp, Artificial Sequence
  PCR primer for ORF amplification
ggatccagctagcaaaatgtcacgtaattctgcagcaggt

SEQ ID NO: 6060 - DNA, 40 bp, Artificial Sequence
  PCR primer for ORF amplification
ggatccagctagcaaaatgtttcacagacgcaaaagacct

SEQ ID NO: 6061 - DNA, 40 bp, Artificial Sequence
  PCR primer for ORF amplification
ggatccagctagcaaaatgagaatagtgccagaaaagctg

SEQ ID NO: 6062 - DNA, 40 bp, Artificial Sequence
  PCR primer for ORF amplification
ggatccagctagcaaaatgaaattcagtggcttgtggtgt

SEQ ID NO: 6063 - DNA, 40 bp, Artificial Sequence
  PCR primer for ORF amplification
ggatccagctagcaaaatgagcacacaatatattgatgag

SEQ ID NO: 6064 - DNA, 40 bp, Artificial Sequence
  PCR primer for ORF amplification
ggatccagctagcaaaatgagtttcagaggaggtaataga

SEQ ID NO: 6065 - DNA, 40 bp, Artificial Sequence
  PCR primer for ORF amplification
ggatccagctagcaaaatgcaacgtacgagggaattggaa

SEQ ID NO: 6066 - DNA, 40 bp, Artificial Sequence
  PCR primer for ORF amplification
ggatccagctagcaaaatgcgttggtggccgtggtcaaat

SEQ ID NO: 6067 - DNA, 40 bp, Artificial Sequence
  PCR primer for ORF amplification
ggatccagctagcaaaatgcttgtgcggctgttgcgtgtg

SEQ ID NO: 6068 - DNA, 40 bp, Artificial Sequence
  PCR primer for ORF amplification
ggatccagctagcaaaatgtcggatccaagttctattaac

SEQ ID NO: 6069 - DNA, 40 bp, Artificial Sequence
  PCR primer for ORF amplification
ggatccagctagcaaaatgaaggagtcagtccaagagatc

SEQ ID NO: 6070 - DNA, 40 bp, Artificial Sequence
  PCR primer for ORF amplification
ggatccagctagcaaaatgaatagcgagtacgattacctg

SEQ ID NO: 6071 - DNA, 40 bp, Artificial Sequence
  PCR primer for ORF amplification
ggatccagctagcaaaatgagtttatactttacgacatta

SEQ ID NO: 6072 - DNA, 40 bp, Artificial Sequence
  PCR primer for ORF amplification
ggatccagctagcaaaatgagtttcctaaacatttttact

SEQ ID NO: 6073 - DNA, 40 bp, Artificial Sequence
  PCR primer for ORF amplification
ggatccagctagcaaaatgagtttcctaagcatttttact

SEQ ID NO: 6074 - DNA, 40 bp, Artificial Sequence
  PCR primer for ORF amplification
ggatccagctagcaaaatgatgccctacaacacccctcca

SEQ ID NO: 6075 - DNA, 40 bp, Artificial Sequence
  PCR primer for ORF amplification
ggatccagctagcaaaatgattttattaaagaggacaaaa

SEQ ID NO: 6076 - DNA, 40 bp, Artificial Sequence
  PCR primer for ORF amplification
ggatccagctagcaaaatgcctagtcatcgcaattcaaac

SEQ ID NO: 6077 - DNA, 40 bp, Artificial Sequence
  PCR primer for ORF amplification
ggatccagctagcaaaatggattttgaggaagattacgat

SEQ ID NO: 6078 - DNA, 40 bp, Artificial Sequence
  PCR primer for ORF amplification
ggatccagctagcaaaatgtcatcttcgctgagccaaaca

SEQ ID NO: 6079 - DNA, 40 bp, Artificial Sequence
  PCR primer for ORF amplification
ggatccagctagcaaaatgtccgaatttaatgaaacaaaa

SEQ ID NO: 6080 - DNA, 40 bp, Artificial Sequence
  PCR primer for ORF amplification
ggatccagctagcaaaatggtacgtaatgcctcattagga

SEQ ID NO: 6081 - DNA, 40 bp, Artificial Sequence
  PCR primer for ORF amplification
ggatccagctagcaaaatgtctgactctattatttccttt

SEQ ID NO: 6082 - DNA, 40 bp, Artificial Sequence
  PCR primer for ORF amplification
ggatccagctagcaaaatgacagtacagtcaagccccatt

SEQ ID NO: 6083 - DNA, 40 bp, Artificial Sequence
  PCR primer for ORF amplification
ggatccagctagcaaaatgactgtcatgaatcttttcttc

SEQ ID NO: 6084 - DNA, 40 bp, Artificial Sequence
  PCR primer for ORF amplification
ggatccagctagcaaaatgcgcgtttttactttgattgcg

SEQ ID NO: 6085 - DNA, 40 bp, Artificial Sequence
  PCR primer for ORF amplification
ggatccagctagcaaaatgctcaagcgtattgttggattg

SEQ ID NO: 6086 - DNA, 40 bp, Artificial Sequence
  PCR primer for ORF amplification
ggatccagctagcaaaatggtgtacacaggatttggtttg

SEQ ID NO: 6087 - DNA, 40 bp, Artificial Sequence
  PCR primer for ORF amplification
ggatccagctagcaaaatggttttgataataaggccctca

SEQ ID NO: 6088 - DNA, 40 bp, Artificial Sequence
  PCR primer for ORF amplification
ggatccagctagcaaaatgtctacatatgaaggtatgtaa

SEQ ID NO: 6089 - DNA, 40 bp, Artificial Sequence
  PCR primer for ORF amplification
ggatccagctagcaaaatgggtagtatgtagtaggacatt

SEQ ID NO: 6090 - DNA, 40 bp, Artificial Sequence
  PCR primer for ORF amplification
ggatccagctagcaaaatgagcctaattcaccccgataca

SEQ ID NO: 6091 - DNA, 40 bp, Artificial Sequence
  PCR primer for ORF amplification
ggatccagctagcaaaatggaaaagatgacagtttcttcg

SEQ ID NO: 6092 - DNA, 40 bp, Artificial Sequence
  PCR primer for ORF amplification
ggatccagctagcaaaatggtgtatttctatgaatcaaaa

SEQ ID NO: 6093 - DNA, 40 bp, Artificial Sequence
  PCR primer for ORF amplification
ggatccagctagcaaaatgtacagcaatcataatttaaat

SEQ ID NO: 6094 - DNA, 40 bp, Artificial Sequence
  PCR primer for ORF amplification
ggatccagctagcaaaatgtatggagatttaggtaataaa

SEQ ID NO: 6095 - DNA, 40 bp, Artificial Sequence
  PCR primer for ORF amplification
ggatccagctagcaaaatgtccctggaagaatttgacgaa

SEQ ID NO: 6096 - DNA, 40 bp, Artificial Sequence
  PCR primer for ORF amplification
ggatccagctagcaaaatgtcttctagaaaaaaaaatatt

SEQ ID NO: 6097 - DNA, 40 bp, Artificial Sequence
  PCR primer for ORF amplification
ggatccagctagcaaaatgtttacaccaattgatcaagct

SEQ ID NO: 6098 - DNA, 40 bp, Artificial Sequence
  PCR primer for ORF amplification
ggatccagctagcaaaatgaacatatacacatcacccacg

SEQ ID NO: 6099 - DNA, 40 bp, Artificial Sequence
  PCR primer for ORF amplification
ggatccagctagcaaaatgactactttagcatcaagtatt

SEQ ID NO: 6100 - DNA, 40 bp, Artificial Sequence
  PCR primer for ORF amplification
ggatccagctagcaaaatgatatcaccatcaaaaaagaga

SEQ ID NO: 6101 - DNA, 40 bp, Artificial Sequence
  PCR primer for ORF amplification
ggatccagctagcaaaatggaatacgccactatgtcttct

SEQ ID NO: 6102 - DNA, 40 bp, Artificial Sequence
  PCR primer for ORF amplification
ggatccagctagcaaaatggccgaaaatgagagaatgtac

SEQ ID NO: 6103 - DNA, 40 bp, Artificial Sequence
  PCR primer for ORF amplification
ggatccagctagcaaaatgtcacaacaagttggtaacagt

SEQ ID NO: 6104 - DNA, 40 bp, Artificial Sequence
  PCR primer for ORF amplification
ggatccagctagcaaaatgaataaaatacccattaaagac

SEQ ID NO: 6105 - DNA, 40 bp, Artificial Sequence
  PCR primer for ORF amplification
ggatccagctagcaaaatgaacaatactgatcctacttca

SEQ ID NO: 6106 - DNA, 40 bp, Artificial Sequence
  PCR primer for ORF amplification
ggatccagctagcaaaatgaacacatcagtcacttccata

SEQ ID NO: 6107 - DNA, 40 bp, Artificial Sequence
  PCR primer for ORF amplification
ggatccagctagcaaaatgatgagtcaagtatcgcattcc

SEQ ID NO: 6108 - DNA, 40 bp, Artificial Sequence
  PCR primer for ORF amplification
ggatccagctagcaaaatgattttacgggagcagatcgac

SEQ ID NO: 6109 - DNA, 40 bp, Artificial Sequence
  PCR primer for ORF amplification
ggatccagctagcaaaatgccgaaagtcgctattttgatt

SEQ ID NO: 6110 - DNA, 40 bp, Artificial Sequence
  PCR primer for ORF amplification
ggatccagctagcaaaatgcctgattcatcacattcaata

SEQ ID NO: 6111 - DNA, 40 bp, Artificial Sequence
  PCR primer for ORF amplification
ggatccagctagcaaaatgcttcaatccgttgtctttttc

SEQ ID NO: 6112 - DNA, 40 bp, Artificial Sequence
  PCR primer for ORF amplification
ggatccagctagcaaaatggttgctaagaagagaaacacg

SEQ ID NO: 6113 - DNA, 40 bp, Artificial Sequence
  PCR primer for ORF amplification
ggatccagctagcaaaatgtccgtttccaagattgctttc

SEQ ID NO: 6114 - DNA, 40 bp, Artificial Sequence
  PCR primer for ORF amplification
ggatccagctagcaaaatgttctcatattcagatttctgt

SEQ ID NO: 6115 - DNA, 40 bp, Artificial Sequence
  PCR primer for ORF amplification
ggatccagctagcaaaatgagaggaaaacaaccgaaaagg

SEQ ID NO: 6116 - DNA, 40 bp, Artificial Sequence
  PCR primer for ORF amplification
ggatccagctagcaaaatgagcaccgcattcaacgattac

SEQ ID NO: 6117 - DNA, 40 bp, Artificial Sequence
  PCR primer for ORF amplification
ggatccagctagcaaaatgcaaaacggcacagaagacaaa

SEQ ID NO: 6118 - DNA, 40 bp, Artificial Sequence
  PCR primer for ORF amplification
ggatccagctagcaaaatgcaggtgttacagttatggttg

SEQ ID NO: 6119 - DNA, 40 bp, Artificial Sequence
  PCR primer for ORF amplification
ggatccagctagcaaaatgctaagacgctctaaaaattcc

SEQ ID NO: 6120 - DNA, 40 bp, Artificial Sequence
  PCR primer for ORF amplification
ggatccagctagcaaaatggatagcaaagaatatctgata

SEQ ID NO: 6121 - DNA, 40 bp, Artificial Sequence
  PCR primer for ORF amplification
ggatccagctagcaaaatggatgctgtaatactgaatctc

SEQ ID NO: 6122 - DNA, 40 bp, Artificial Sequence
  PCR primer for ORF amplification
ggatccagctagcaaaatggccactaagcaattactgaga

SEQ ID NO: 6123 - DNA, 40 bp, Artificial Sequence
  PCR primer for ORF amplification
ggatccagctagcaaaatggctcaaagtaaaagtaatcct

SEQ ID NO: 6124 - DNA, 40 bp, Artificial Sequence
  PCR primer for ORF amplification
ggatccagctagcaaaatggctggaggaaagattcctatt

SEQ ID NO: 6125 - DNA, 40 bp, Artificial Sequence
  PCR primer for ORF amplification
ggatccagctagcaaaatgggtaatattataacggatacg

SEQ ID NO: 6126 - DNA, 40 bp, Artificial Sequence
  PCR primer for ORF amplification
ggatccagctagcaaaatgaaatataatatagtgcatgga

SEQ ID NO: 6127 - DNA, 40 bp, Artificial Sequence
  PCR primer for ORF amplification
ggatccagctagcaaaatgagcacatccgccagcggtcca

SEQ ID NO: 6128 - DNA, 40 bp, Artificial Sequence
  PCR primer for ORF amplification
ggatccagctagcaaaatgctctcatactatgaacacaat

SEQ ID NO: 6129 - DNA, 40 bp, Artificial Sequence
  PCR primer for ORF amplification
ggatccagctagcaaaatggctgatttatttgctcctgct

SEQ ID NO: 6130 - DNA, 40 bp, Artificial Sequence
  PCR primer for ORF amplification
ggatccagctagcaaaatgtcgtccacggatatcaagcct

SEQ ID NO: 6131 - DNA, 40 bp, Artificial Sequence
  PCR primer for ORF amplification
ggatccagctagcaaaatgtgggaacaaagacgacaaaag

SEQ ID NO: 6132 - DNA, 40 bp, Artificial Sequence
  PCR primer for ORF amplification
ggatccagctagcaaaatgtttaatagagtctttaccagg

SEQ ID NO: 6133 - DNA, 40 bp, Artificial Sequence
  PCR primer for ORF amplification
ggatccagctagcaaaatgtttatcctttcaaaaatcgct

SEQ ID NO: 6134 - DNA, 40 bp, Artificial Sequence
  PCR primer for ORF amplification
ggatccagctagcaaaatgaaagtaaaggctacaaaacta

SEQ ID NO: 6135 - DNA, 40 bp, Artificial Sequence
  PCR primer for ORF amplification
ggatccagctagcaaaatgaacaaggaatctaaagatgat

SEQ ID NO: 6136 - DNA, 40 bp, Artificial Sequence
  PCR primer for ORF amplification
ggatccagctagcaaaatgaactacagcgcagactctggt

SEQ ID NO: 6137 - DNA, 40 bp, Artificial Sequence
  PCR primer for ORF amplification
ggatccagctagcaaaatgaagtacattattgagcatatg

SEQ ID NO: 6138 - DNA, 40 bp, Artificial Sequence
  PCR primer for ORF amplification
ggatccagctagcaaaatgattatgaatagtacaaacaca

SEQ ID NO: 6139 - DNA, 40 bp, Artificial Sequence
  PCR primer for ORF amplification
ggatccagctagcaaaatggaatatgaagatttggaactg

SEQ ID NO: 6140 - DNA, 40 bp, Artificial Sequence
  PCR primer for ORF amplification
ggatccagctagcaaaatgggacttatttcatacgaaaat

SEQ ID NO: 6141 - DNA, 40 bp, Artificial Sequence
  PCR primer for ORF amplification
ggatccagctagcaaaatgtcacaaaaggataacctactc

SEQ ID NO: 6142 - DNA, 40 bp, Artificial Sequence
  PCR primer for ORF amplification
ggatccagctagcaaaatgtcactaccggcacatttgcag

SEQ ID NO: 6143 - DNA, 40 bp, Artificial Sequence
  PCR primer for ORF amplification
ggatccagctagcaaaatgtccgttgaagaagttagcaag

SEQ ID NO: 6144 - DNA, 40 bp, Artificial Sequence
  PCR primer for ORF amplification
ggatccagctagcaaaatgaacattctgcgaatagcatgt

SEQ ID NO: 6145 - DNA, 40 bp, Artificial Sequence
  PCR primer for ORF amplification
ggatccagctagcaaaatgagcgacaagatatcctttcta

SEQ ID NO: 6146 - DNA, 40 bp, Artificial Sequence
  PCR primer for ORF amplification
ggatccagctagcaaaatgagtaatggacacgtcaagttt

SEQ ID NO: 6147 - DNA, 40 bp, Artificial Sequence
  PCR primer for ORF amplification
ggatccagctagcaaaatgataaagtcaacactaatctac

SEQ ID NO: 6148 - DNA, 40 bp, Artificial Sequence
  PCR primer for ORF amplification
ggatccagctagcaaaatggccagaattgtcgtattaatt

SEQ ID NO: 6149 - DNA, 40 bp, Artificial Sequence
  PCR primer for ORF amplification
ggatccagctagcaaaatgtcatttaacagtccatttttt

SEQ ID NO: 6150 - DNA, 40 bp, Artificial Sequence
  PCR primer for ORF amplification
ggatccagctagcaaaatgtcatttattcagaggaggtta

SEQ ID NO: 6151 - DNA, 40 bp, Artificial Sequence
  PCR primer for ORF amplification
ggatccagctagcaaaatgactgcagttaacatctggaag

SEQ ID NO: 6152 - DNA, 40 bp, Artificial Sequence
  PCR primer for ORF amplification
ggatccagctagcaaaatgagcagatccgggaaatcattg

SEQ ID NO: 6153 - DNA, 40 bp, Artificial Sequence
  PCR primer for ORF amplification
ggatccagctagcaaaatgagcgaggaaccaccttctgac

SEQ ID NO: 6154 - DNA, 40 bp, Artificial Sequence
  PCR primer for ORF amplification
ggatccagctagcaaaatgagctgtaccactgataagtta

SEQ ID NO: 6155 - DNA, 40 bp, Artificial Sequence
  PCR primer for ORF amplification
ggatccagctagcaaaatgatcaaatctacaattgctcta

SEQ ID NO: 6156 - DNA, 40 bp, Artificial Sequence
  PCR primer for ORF amplification
ggatccagctagcaaaatggaccaagaaaatgaaagaaac

SEQ ID NO: 6157 - DNA, 40 bp, Artificial Sequence
  PCR primer for ORF amplification
ggatccagctagcaaaatggatttttacaaattagacgag

SEQ ID NO: 6158 - DNA, 40 bp, Artificial Sequence
  PCR primer for ORF amplification
ggatccagctagcaaaatgggccttttggcttatatccct

SEQ ID NO: 6159 - DNA, 40 bp, Artificial Sequence
  PCR primer for ORF amplification
ggatccagctagcaaaatgggtgaagcactacgtagatca

SEQ ID NO: 6160 - DNA, 40 bp, Artificial Sequence
  PCR primer for ORF amplification
ggatccagctagcaaaatgtcaggcttgagaactgtttct

SEQ ID NO: 6161 - DNA, 40 bp, Artificial Sequence
  PCR primer for ORF amplification
ggatccagctagcaaaatgtctagggctaagagaattatg

SEQ ID NO: 6162 - DNA, 40 bp, Artificial Sequence
  PCR primer for ORF amplification
ggatccagctagcaaaatgtctgcttcattgattaatcgt

SEQ ID NO: 6163 - DNA, 40 bp, Artificial Sequence
  PCR primer for ORF amplification
ggatccagctagcaaaatgttaggaataagatcatctgtc

SEQ ID NO: 6164 - DNA, 40 bp, Artificial Sequence
  PCR primer for ORF amplification
ggatccagctagcaaaatgttcgaaattaaactgaatgat

SEQ ID NO: 6165 - DNA, 40 bp, Artificial Sequence
  PCR primer for ORF amplification
ggatccagctagcaaaatgagtgatactacggaagtccct

SEQ ID NO: 6166 - DNA, 40 bp, Artificial Sequence
  PCR primer for ORF amplification
ggatccagctagcaaaatgtttaagaagtatgtctaacat

SEQ ID NO: 6167 - DNA, 40 bp, Artificial Sequence
  PCR primer for ORF amplification
ggatccagctagcaaaatgcaagcaagtttacctggcgaa

SEQ ID NO: 6168 - DNA, 40 bp, Artificial Sequence
  PCR primer for ORF amplification
ggatccagctagcaaaatgaagactttaattgttgttgat

SEQ ID NO: 6169 - DNA, 40 bp, Artificial Sequence
  PCR primer for ORF amplification
ggatccagctagcaaaatgatgggtcgtggcaaattaata

SEQ ID NO: 6170 - DNA, 40 bp, Artificial Sequence
  PCR primer for ORF amplification
ggatccagctagcaaaatgattgaccgcactaaaaacgaa

SEQ ID NO: 6171 - DNA, 40 bp, Artificial Sequence
  PCR primer for ORF amplification
ggatccagctagcaaaatgtcacaaggtcagtccaaaaaa

SEQ ID NO: 6172 - DNA, 40 bp, Artificial Sequence
  PCR primer for ORF amplification
ggatccagctagcaaaatgtccgataaagttattaaccct

SEQ ID NO: 6173 - DNA, 40 bp, Artificial Sequence
  PCR primer for ORF amplification
ggatccagctagcaaaatgtcttcggaaccatttaagaac

SEQ ID NO: 6174 - DNA, 40 bp, Artificial Sequence
  PCR primer for ORF amplification
ggatccagctagcaaaatgttatcacactacatcttcctg

SEQ ID NO: 6175 - DNA, 40 bp, Artificial Sequence
  PCR primer for ORF amplification
ggatccagctagcaaaatgttattggacgcgcagcgattt

SEQ ID NO: 6176 - DNA, 40 bp, Artificial Sequence
  PCR primer for ORF amplification
ggatccagctagcaaaatgtttatggcaagacaagtgtta

SEQ ID NO: 6177 - DNA, 40 bp, Artificial Sequence
  PCR primer for ORF amplification
ggatccagctagcaaaatggtagtatccatcataccgcaa

SEQ ID NO: 6178 - DNA, 40 bp, Artificial Sequence
  PCR primer for ORF amplification
ggatccagctagcaaaatgaaagcaatagataaaatgacg

SEQ ID NO: 6179 - DNA, 40 bp, Artificial Sequence
  PCR primer for ORF amplification
ggatccagctagcaaaatgagttccctattaatatcatac

SEQ ID NO: 6180 - DNA, 40 bp, Artificial Sequence
  PCR primer for ORF amplification
ggatccagctagcaaaatgctgttacaacctgtttggaaa

SEQ ID NO: 6181 - DNA, 40 bp, Artificial Sequence
  PCR primer for ORF amplification
ggatccagctagcaaaatggatcaaagtgtggaagactta

SEQ ID NO: 6182 - DNA, 40 bp, Artificial Sequence
  PCR primer for ORF amplification
ggatccagctagcaaaatgggaaaggcctgtttgaataaa

SEQ ID NO: 6183 - DNA, 40 bp, Artificial Sequence
  PCR primer for ORF amplification
ggatccagctagcaaaatgggagtgaagcaaaccccacca

SEQ ID NO: 6184 - DNA, 40 bp, Artificial Sequence
  PCR primer for ORF amplification
ggatccagctagcaaaatgtcaaaaaaacttgcgtcacca

SEQ ID NO: 6185 - DNA, 40 bp, Artificial Sequence
  PCR primer for ORF amplification
ggatccagctagcaaaatgtcatggaggtatgcgttaaaa

SEQ ID NO: 6186 - DNA, 40 bp, Artificial Sequence
  PCR primer for ORF amplification
ggatccagctagcaaaatgtccaagatcacttcttctcaa

SEQ ID NO: 6187 - DNA, 40 bp, Artificial Sequence
  PCR primer for ORF amplification
ggatccagctagcaaaatgtctaagatcacctcttctcaa

SEQ ID NO: 6188 - DNA, 40 bp, Artificial Sequence
  PCR primer for ORF amplification
ggatccagctagcaaaatgggtagtatgtacaggaattat

SEQ ID NO: 6189 - DNA, 40 bp, Artificial Sequence
  PCR primer for ORF amplification
ggatccagctagcaaaatgaagattgaaaaggcttctcat

SEQ ID NO: 6190 - DNA, 40 bp, Artificial Sequence
  PCR primer for ORF amplification
ggatccagctagcaaaatgacaaagctacaaggactacag

SEQ ID NO: 6191 - DNA, 40 bp, Artificial Sequence
  PCR primer for ORF amplification
ggatccagctagcaaaatgacacaatataatttcattata

SEQ ID NO: 6192 - DNA, 40 bp, Artificial Sequence
  PCR primer for ORF amplification
ggatccagctagcaaaatggcagattattcttcccttact

SEQ ID NO: 6193 - DNA, 40 bp, Artificial Sequence
  PCR primer for ORF amplification
ggatccagctagcaaaatggtgaccggaatatcggaggaa

SEQ ID NO: 6194 - DNA, 40 bp, Artificial Sequence
  PCR primer for ORF amplification
ggatccagctagcaaaatgtttacgtggactatttatgtt

SEQ ID NO: 6195 - DNA, 40 bp, Artificial Sequence
  PCR primer for ORF amplification
ggatccagctagcaaaatgaaccaagcaatagacttcgca

SEQ ID NO: 6196 - DNA, 40 bp, Artificial Sequence
  PCR primer for ORF amplification
ggatccagctagcaaaatgaggttccagcttttcatatat

SEQ ID NO: 6197 - DNA, 40 bp, Artificial Sequence
  PCR primer for ORF amplification
ggatccagctagcaaaatgccagctaaaaaaaggactaga

SEQ ID NO: 6198 - DNA, 40 bp, Artificial Sequence
  PCR primer for ORF amplification
ggatccagctagcaaaatgcttttaacctctcttttacag

SEQ ID NO: 6199 - DNA, 40 bp, Artificial Sequence
  PCR primer for ORF amplification
ggatccagctagcaaaatggaacatctcgccaacgaaaac

SEQ ID NO: 6200 - DNA, 40 bp, Artificial Sequence
  PCR primer for ORF amplification
ggatccagctagcaaaatggccatcgaaacaatacttgta

SEQ ID NO: 6201 - DNA, 40 bp, Artificial Sequence
  PCR primer for ORF amplification
ggatccagctagcaaaatggcttcatgcttttcagtttca

SEQ ID NO: 6202 - DNA, 40 bp, Artificial Sequence
  PCR primer for ORF amplification
ggatccagctagcaaaatgtctaacgaaattgaattactg

SEQ ID NO: 6203 - DNA, 40 bp, Artificial Sequence
  PCR primer for ORF amplification
ggatccagctagcaaaatgtctgccccagctgctaacggt

SEQ ID NO: 6204 - DNA, 40 bp, Artificial Sequence
  PCR primer for ORF amplification
ggatccagctagcaaaatgttaaagttaacaacaacatcc

SEQ ID NO: 6205 - DNA, 40 bp, Artificial Sequence
  PCR primer for ORF amplification
ggatccagctagcaaaatgattcatgcagttctaatatgt

SEQ ID NO: 6206 - DNA, 40 bp, Artificial Sequence
  PCR primer for ORF amplification
ggatccagctagcaaaatgacagagcagaaagccctagta

SEQ ID NO: 6207 - DNA, 40 bp, Artificial Sequence
  PCR primer for ORF amplification
ggatccagctagcaaaatgagttcgaattcaacaccagaa

SEQ ID NO: 6208 - DNA, 40 bp, Artificial Sequence
  PCR primer for ORF amplification
ggatccagctagcaaaatggaggaagaagaattaagtaaa

SEQ ID NO: 6209 - DNA, 40 bp, Artificial Sequence
  PCR primer for ORF amplification
ggatccagctagcaaaatggataaacatacagcagctatt

SEQ ID NO: 6210 - DNA, 40 bp, Artificial Sequence
  PCR primer for ORF amplification
ggatccagctagcaaaatggcttctagagtggacgaaact

SEQ ID NO: 6211 - DNA, 40 bp, Artificial Sequence
  PCR primer for ORF amplification
ggatccagctagcaaaatggtaaagtcaacaagcaaaact

SEQ ID NO: 6212 - DNA, 40 bp, Artificial Sequence
  PCR primer for ORF amplification
ggatccagctagcaaaatgtcagcacctgctcaaaacaat

SEQ ID NO: 6213 - DNA, 40 bp, Artificial Sequence
  PCR primer for ORF amplification
ggatccagctagcaaaatgtccataggttacaaagacaac

SEQ ID NO: 6214 - DNA, 40 bp, Artificial Sequence
  PCR primer for ORF amplification
ggatccagctagcaaaatgtcggcaggtgatatatcagcc

SEQ ID NO: 6215 - DNA, 40 bp, Artificial Sequence
  PCR primer for ORF amplification
ggatccagctagcaaaatgaatgtttctacatcaaccttt

SEQ ID NO: 6216 - DNA, 40 bp, Artificial Sequence
  PCR primer for ORF amplification
ggatccagctagcaaaatgagcgctaccgaatcttcatct

SEQ ID NO: 6217 - DNA, 40 bp, Artificial Sequence
  PCR primer for ORF amplification
ggatccagctagcaaaatgagtgaccaaatcaacgttttg

SEQ ID NO: 6218 - DNA, 40 bp, Artificial Sequence
  PCR primer for ORF amplification
ggatccagctagcaaaatgcgatataataattatgacaac

SEQ ID NO: 6219 - DNA, 40 bp, Artificial Sequence
  PCR primer for ORF amplification
ggatccagctagcaaaatgctaccgaccccttatgtaaaa

SEQ ID NO: 6220 - DNA, 40 bp, Artificial Sequence
  PCR primer for ORF amplification
ggatccagctagcaaaatggccagcatagacgcattttcg

SEQ ID NO: 6221 - DNA, 40 bp, Artificial Sequence
  PCR primer for ORF amplification
ggatccagctagcaaaatggctagaagaccagctagatgt

SEQ ID NO: 6222 - DNA, 40 bp, Artificial Sequence
  PCR primer for ORF amplification
ggatccagctagcaaaatgggaattcaggaaaagacattg

SEQ ID NO: 6223 - DNA, 40 bp, Artificial Sequence
  PCR primer for ORF amplification
ggatccagctagcaaaatgggccaaaaaagtagtaaagtg

SEQ ID NO: 6224 - DNA, 40 bp, Artificial Sequence
  PCR primer for ORF amplification
ggatccagctagcaaaatgtcggcaaacgataagcaatac

SEQ ID NO: 6225 - DNA, 40 bp, Artificial Sequence
  PCR primer for ORF amplification
ggatccagctagcaaaatgaccgtcgttatcggagtcttg

SEQ ID NO: 6226 - DNA, 40 bp, Artificial Sequence
  PCR primer for ORF amplification
ggatccagctagcaaaatgaacgctaatatatgggtggct

SEQ ID NO: 6227 - DNA, 40 bp, Artificial Sequence
  PCR primer for ORF amplification
ggatccagctagcaaaatgaagtttttcccactccttttg

SEQ ID NO: 6228 - DNA, 40 bp, Artificial Sequence
  PCR primer for ORF amplification
ggatccagctagcaaaatgaccgaattagattatcaagga

SEQ ID NO: 6229 - DNA, 40 bp, Artificial Sequence
  PCR primer for ORF amplification
ggatccagctagcaaaatgagcaacgaagattacggatac

SEQ ID NO: 6230 - DNA, 40 bp, Artificial Sequence
  PCR primer for ORF amplification
ggatccagctagcaaaatgcacaatcaggaagagtggcta

SEQ ID NO: 6231 - DNA, 40 bp, Artificial Sequence
  PCR primer for ORF amplification
ggatccagctagcaaaatgtccaatgatcctggtaatgag

SEQ ID NO: 6232 - DNA, 40 bp, Artificial Sequence
  PCR primer for ORF amplification
ggatccagctagcaaaatgtcgtggctttttggagataag

SEQ ID NO: 6233 - DNA, 40 bp, Artificial Sequence
  PCR primer for ORF amplification
ggatccagctagcaaaatgtctagctcagaatccattaga

SEQ ID NO: 6234 - DNA, 40 bp, Artificial Sequence
  PCR primer for ORF amplification
ggatccagctagcaaaatgaaaaccaataagaaaatttct

SEQ ID NO: 6235 - DNA, 40 bp, Artificial Sequence
  PCR primer for ORF amplification
ggatccagctagcaaaatgaagaaacaaatattaatagtt

SEQ ID NO: 6236 - DNA, 40 bp, Artificial Sequence
  PCR primer for ORF amplification
ggatccagctagcaaaatgacgaagaatgtattgatgtta

SEQ ID NO: 6237 - DNA, 40 bp, Artificial Sequence
  PCR primer for ORF amplification
ggatccagctagcaaaatgagcagcgaggactacgggtat

SEQ ID NO: 6238 - DNA, 40 bp, Artificial Sequence
  PCR primer for ORF amplification
ggatccagctagcaaaatgagcgtccaagcagaaataggg

SEQ ID NO: 6239 - DNA, 40 bp, Artificial Sequence
  PCR primer for ORF amplification
ggatccagctagcaaaatgagctcacaaccgtctttcgtc

SEQ ID NO: 6240 - DNA, 40 bp, Artificial Sequence
  PCR primer for ORF amplification
ggatccagctagcaaaatggaggataaggagaaacttatt

SEQ ID NO: 6241 - DNA, 40 bp, Artificial Sequence
  PCR primer for ORF amplification
ggatccagctagcaaaatggcagccaggaatcgtagaaag

SEQ ID NO: 6242 - DNA, 40 bp, Artificial Sequence
  PCR primer for ORF amplification
ggatccagctagcaaaatgtcacaatctactgcatcactg

SEQ ID NO: 6243 - DNA, 40 bp, Artificial Sequence
  PCR primer for ORF amplification
ggatccagctagcaaaatgtcgaaggatgtaatagaatac

SEQ ID NO: 6244 - DNA, 40 bp, Artificial Sequence
  PCR primer for ORF amplification
ggatccagctagcaaaatgaaagtacaaatgatagaaagg

SEQ ID NO: 6245 - DNA, 40 bp, Artificial Sequence
  PCR primer for ORF amplification
ggatccagctagcaaaatgaacaacagtgaagatccgttt

SEQ ID NO: 6246 - DNA, 40 bp, Artificial Sequence
  PCR primer for ORF amplification
ggatccagctagcaaaatgaagattttaacccaagacgaa

SEQ ID NO: 6247 - DNA, 40 bp, Artificial Sequence
  PCR primer for ORF amplification
ggatccagctagcaaaatgacactagtgactccgttacaa

SEQ ID NO: 6248 - DNA, 40 bp, Artificial Sequence
  PCR primer for ORF amplification
ggatccagctagcaaaatgatatttgctccttctttctcc

SEQ ID NO: 6249 - DNA, 40 bp, Artificial Sequence
  PCR primer for ORF amplification
ggatccagctagcaaaatgatgtcttcagaccaacagggg

SEQ ID NO: 6250 - DNA, 40 bp, Artificial Sequence
  PCR primer for ORF amplification
ggatccagctagcaaaatgcacaaaacccacagtacaatg

SEQ ID NO: 6251 - DNA, 40 bp, Artificial Sequence
  PCR primer for ORF amplification
ggatccagctagcaaaatggattatataaaaaaagccata

SEQ ID NO: 6252 - DNA, 40 bp, Artificial Sequence
  PCR primer for ORF amplification
ggatccagctagcaaaatgtctgttattaatttcacaggt

SEQ ID NO: 6253 - DNA, 40 bp, Artificial Sequence
  PCR primer for ORF amplification
ggatccagctagcaaaatgtctttcactgaggatcaagaa

SEQ ID NO: 6254 - DNA, 40 bp, Artificial Sequence
  PCR primer for ORF amplification
ggatccagctagcaaaatgtgggattcgttaattgtaagc

SEQ ID NO: 6255 - DNA, 40 bp, Artificial Sequence
  PCR primer for ORF amplification
ggatccagctagcaaaatgtccgaatatgcatctagtatt

SEQ ID NO: 6256 - DNA, 40 bp, Artificial Sequence
  PCR primer for ORF amplification
ggatccagctagcaaaatgtcacagtacggatttgtaaga

SEQ ID NO: 6257 - DNA, 40 bp, Artificial Sequence
  PCR primer for ORF amplification
ggatccagctagcaaaatgaaagcagacgcgaaacaaata

SEQ ID NO: 6258 - DNA, 40 bp, Artificial Sequence
  PCR primer for ORF amplification
ggatccagctagcaaaatgaagcttcaatttttttccttt

SEQ ID NO: 6259 - DNA, 40 bp, Artificial Sequence
  PCR primer for ORF amplification
ggatccagctagcaaaatgaggttttctatgttaatcggg

SEQ ID NO: 6260 - DNA, 40 bp, Artificial Sequence
  PCR primer for ORF amplification
ggatccagctagcaaaatggggtccgaggaagataaaaag

SEQ ID NO: 6261 - DNA, 40 bp, Artificial Sequence
  PCR primer for ORF amplification
ggatccagctagcaaaatggtcgtaattaacggggtcaaa

SEQ ID NO: 6262 - DNA, 40 bp, Artificial Sequence
  PCR primer for ORF amplification
ggatccagctagcaaaatgtccaatttatgtgtacttttc

SEQ ID NO: 6263 - DNA, 40 bp, Artificial Sequence
  PCR primer for ORF amplification
ggatccagctagcaaaatgtctgacaccgaagctccagtt

SEQ ID NO: 6264 - DNA, 40 bp, Artificial Sequence
  PCR primer for ORF amplification
ggatccagctagcaaaatgtctgacggaacactgtttact

SEQ ID NO: 6265 - DNA, 40 bp, Artificial Sequence
  PCR primer for ORF amplification
ggatccagctagcaaaatgaaggtaaaccattcaatttca

SEQ ID NO: 6266 - DNA, 40 bp, Artificial Sequence
  PCR primer for ORF amplification
ggatccagctagcaaaatgcctattatgttggaagactac

SEQ ID NO: 6267 - DNA, 40 bp, Artificial Sequence
  PCR primer for ORF amplification
ggatccagctagcaaaatggccgacatcaataaatatatt

SEQ ID NO: 6268 - DNA, 40 bp, Artificial Sequence
  PCR primer for ORF amplification
ggatccagctagcaaaatggcgacgattgaagatattaag

SEQ ID NO: 6269 - DNA, 40 bp, Artificial Sequence
  PCR primer for ORF amplification
ggatccagctagcaaaatggctccgacaataagcaaaagg

SEQ ID NO: 6270 - DNA, 40 bp, Artificial Sequence
  PCR primer for ORF amplification
ggatccagctagcaaaatgtatgatatattacgcacacga

SEQ ID NO: 6271 - DNA, 40 bp, Artificial Sequence
  PCR primer for ORF amplification
ggatccagctagcaaaatgaatggacttagagttgcagca

SEQ ID NO: 6272 - DNA, 40 bp, Artificial Sequence
  PCR primer for ORF amplification
ggatccagctagcaaaatgcaattcaaaaacgtcgcccta

SEQ ID NO: 6273 - DNA, 40 bp, Artificial Sequence
  PCR primer for ORF amplification
ggatccagctagcaaaatgggagacaattactcgacttac

SEQ ID NO: 6274 - DNA, 40 bp, Artificial Sequence
  PCR primer for ORF amplification
ggatccagctagcaaaatgtctcctatgaaagttgcggtt

SEQ ID NO: 6275 - DNA, 40 bp, Artificial Sequence
  PCR primer for ORF amplification
ggatccagctagcaaaatgtctgcatctactacaagttta

SEQ ID NO: 6276 - DNA, 40 bp, Artificial Sequence
  PCR primer for ORF amplification
ggatccagctagcaaaatgactaaacaagctgaggagacc

SEQ ID NO: 6277 - DNA, 40 bp, Artificial Sequence
  PCR primer for ORF amplification
ggatccagctagcaaaatgactgtttctacttccaagacc

SEQ ID NO: 6278 - DNA, 40 bp, Artificial Sequence
  PCR primer for ORF amplification
ggatccagctagcaaaatgagagctttttcagcagccacc

SEQ ID NO: 6279 - DNA, 40 bp, Artificial Sequence
  PCR primer for ORF amplification
ggatccagctagcaaaatgctgttagaattgatttcttat

SEQ ID NO: 6280 - DNA, 40 bp, Artificial Sequence
  PCR primer for ORF amplification
ggatccagctagcaaaatggctgaattaaacgattatagt

SEQ ID NO: 6281 - DNA, 40 bp, Artificial Sequence
  PCR primer for ORF amplification
ggatccagctagcaaaatgtctaattatcctttgcatcaa

SEQ ID NO: 6282 - DNA, 40 bp, Artificial Sequence
  PCR primer for ORF amplification
ggatccagctagcaaaatgaacaggattttcggatatggg

SEQ ID NO: 6283 - DNA, 40 bp, Artificial Sequence
  PCR primer for ORF amplification
ggatccagctagcaaaatggatggaaatcataggtttact

SEQ ID NO: 6284 - DNA, 40 bp, Artificial Sequence
  PCR primer for ORF amplification
ggatccagctagcaaaatggctccaaacgtacgttaattt

SEQ ID NO: 6285 - DNA, 40 bp, Artificial Sequence
  PCR primer for ORF amplification
ggatccagctagcaaaatgggaggtatacttaaaaacccg

SEQ ID NO: 6286 - DNA, 40 bp, Artificial Sequence
  PCR primer for ORF amplification
ggatccagctagcaaaatgtcaagtaaacaacaatgggtt

SEQ ID NO: 6287 - DNA, 40 bp, Artificial Sequence
  PCR primer for ORF amplification
ggatccagctagcaaaatgttgaggacaaaagtgtttgca

SEQ ID NO: 6288 - DNA, 40 bp, Artificial Sequence
  PCR primer for ORF amplification
ggatccagctagcaaaatggccggtttaaaagacgttgtc

SEQ ID NO: 6289 - DNA, 40 bp, Artificial Sequence
  PCR primer for ORF amplification
ggatccagctagcaaaatgaaattgtttcaaaacagttac

SEQ ID NO: 6290 - DNA, 40 bp, Artificial Sequence
  PCR primer for ORF amplification
ggatccagctagcaaaatgactaaggaagtaccatattat

SEQ ID NO: 6291 - DNA, 40 bp, Artificial Sequence
  PCR primer for ORF amplification
ggatccagctagcaaaatgattttaaccacagctagatta

SEQ ID NO: 6292 - DNA, 40 bp, Artificial Sequence
  PCR primer for ORF amplification
ggatccagctagcaaaatgcctgtcccatctgttactgtc

SEQ ID NO: 6293 - DNA, 40 bp, Artificial Sequence
  PCR primer for ORF amplification
ggatccagctagcaaaatgcgccaggtactacaaaaagat

SEQ ID NO: 6294 - DNA, 40 bp, Artificial Sequence
  PCR primer for ORF amplification
ggatccagctagcaaaatgcgtaagccttctattacgata

SEQ ID NO: 6295 - DNA, 40 bp, Artificial Sequence
  PCR primer for ORF amplification
ggatccagctagcaaaatggaagataaattagacagatac

SEQ ID NO: 6296 - DNA, 40 bp, Artificial Sequence
  PCR primer for ORF amplification
ggatccagctagcaaaatgggtgtttgcactatttttagg

SEQ ID NO: 6297 - DNA, 40 bp, Artificial Sequence
  PCR primer for ORF amplification
ggatccagctagcaaaatgaatgggttggtattaggcgct

SEQ ID NO: 6298 - DNA, 40 bp, Artificial Sequence
  PCR primer for ORF amplification
ggatccagctagcaaaatgacatccgttagaaaaagaaag

SEQ ID NO: 6299 - DNA, 40 bp, Artificial Sequence
  PCR primer for ORF amplification
ggatccagctagcaaaatgaccggagcagcaactgcagca

SEQ ID NO: 6300 - DNA, 40 bp, Artificial Sequence
  PCR primer for ORF amplification
ggatccagctagcaaaatgacgagatactattgtgaatac

SEQ ID NO: 6301 - DNA, 40 bp, Artificial Sequence
  PCR primer for ORF amplification
ggatccagctagcaaaatgataccttccaataagagaaat

SEQ ID NO: 6302 - DNA, 40 bp, Artificial Sequence
  PCR primer for ORF amplification
ggatccagctagcaaaatgtcagcttgcccttgcaacatc

SEQ ID NO: 6303 - DNA, 40 bp, Artificial Sequence
  PCR primer for ORF amplification
ggatccagctagcaaaatgtcatttctatgtgggtcagct

SEQ ID NO: 6304 - DNA, 40 bp, Artificial Sequence
  PCR primer for ORF amplification
ggatccagctagcaaaatgtctgagtttttgaatgaaaat

SEQ ID NO: 6305 - DNA, 40 bp, Artificial Sequence
  PCR primer for ORF amplification
ggatccagctagcaaaatgttttacccatataactatagt

SEQ ID NO: 6306 - DNA, 40 bp, Artificial Sequence
  PCR primer for ORF amplification
ggatccagctagcaaaatgtttttgagaaacgtaagagtt

SEQ ID NO: 6307 - DNA, 40 bp, Artificial Sequence
  PCR primer for ORF amplification
ggatccagctagcaaaatgactaatgacaacagtggtatc

SEQ ID NO: 6308 - DNA, 40 bp, Artificial Sequence
  PCR primer for ORF amplification
ggatccagctagcaaaatggacagaaaagctgtcgaagaa

SEQ ID NO: 6309 - DNA, 40 bp, Artificial Sequence
  PCR primer for ORF amplification
ggatccagctagcaaaatggacgtgcctgcagattcccat

SEQ ID NO: 6310 - DNA, 40 bp, Artificial Sequence
  PCR primer for ORF amplification
ggatccagctagcaaaatggcagattatgatagtgcgaaa

SEQ ID NO: 6311 - DNA, 40 bp, Artificial Sequence
  PCR primer for ORF amplification
ggatccagctagcaaaatgtccttcgagaacaaactgcca

SEQ ID NO: 6312 - DNA, 40 bp, Artificial Sequence
  PCR primer for ORF amplification
ggatccagctagcaaaatgtctggaaatagtcaactgcca

SEQ ID NO: 6313 - DNA, 40 bp, Artificial Sequence
  PCR primer for ORF amplification
ggatccagctagcaaaatgttcccctatttaacaagaatg

SEQ ID NO: 6314 - DNA, 40 bp, Artificial Sequence
  PCR primer for ORF amplification
ggatccagctagcaaaatggtacgtagatgcaactatatc

SEQ ID NO: 6315 - DNA, 40 bp, Artificial Sequence
  PCR primer for ORF amplification
ggatccagctagcaaaatgaaacagtttggactggcagcc

SEQ ID NO: 6316 - DNA, 40 bp, Artificial Sequence
  PCR primer for ORF amplification
ggatccagctagcaaaatgaatggcagaggtttcctgatt

SEQ ID NO: 6317 - DNA, 40 bp, Artificial Sequence
  PCR primer for ORF amplification
ggatccagctagcaaaatgacaaaagatttttaccgtcag

SEQ ID NO: 6318 - DNA, 40 bp, Artificial Sequence
  PCR primer for ORF amplification
ggatccagctagcaaaatggcaaatgatgggattcagagg

SEQ ID NO: 6319 - DNA, 40 bp, Artificial Sequence
  PCR primer for ORF amplification
ggatccagctagcaaaatggctaaattacagaggaagaga

SEQ ID NO: 6320 - DNA, 40 bp, Artificial Sequence
  PCR primer for ORF amplification
ggatccagctagcaaaatgtcagagaaattccctcctttg

SEQ ID NO: 6321 - DNA, 40 bp, Artificial Sequence
  PCR primer for ORF amplification
ggatccagctagcaaaatgtccaagctttcgaaagattac

SEQ ID NO: 6322 - DNA, 40 bp, Artificial Sequence
  PCR primer for ORF amplification
ggatccagctagcaaaatgtcctccgctattactgctttg

SEQ ID NO: 6323 - DNA, 40 bp, Artificial Sequence
  PCR primer for ORF amplification
ggatccagctagcaaaatgttatcccgtgtttcagttttc

SEQ ID NO: 6324 - DNA, 40 bp, Artificial Sequence
  PCR primer for ORF amplification
ggatccagctagcaaaatgttcgcgaaaacagcagctgct

SEQ ID NO: 6325 - DNA, 40 bp, Artificial Sequence
  PCR primer for ORF amplification
ggatccagctagcaaaatgaggtttttgaggggatttgta

SEQ ID NO: 6326 - DNA, 40 bp, Artificial Sequence
  PCR primer for ORF amplification
ggatccagctagcaaaatgcaaacaccttcagaaaatacc

SEQ ID NO: 6327 - DNA, 40 bp, Artificial Sequence
  PCR primer for ORF amplification
ggatccagctagcaaaatgcagacccctccagaaagtacc

SEQ ID NO: 6328 - DNA, 40 bp, Artificial Sequence
  PCR primer for ORF amplification
ggatccagctagcaaaatgcagacccctctagaaagtacc

SEQ ID NO: 6329 - DNA, 40 bp, Artificial Sequence
  PCR primer for ORF amplification
ggatccagctagcaaaatggtaaatttttatgatgacgtg

SEQ ID NO: 6330 - DNA, 40 bp, Artificial Sequence
  PCR primer for ORF amplification
ggatccagctagcaaaatgtcagatcttcaaaagttacag

SEQ ID NO: 6331 - DNA, 40 bp, Artificial Sequence
  PCR primer for ORF amplification
ggatccagctagcaaaatgtcgttgccaattatcaaagtc

SEQ ID NO: 6332 - DNA, 40 bp, Artificial Sequence
  PCR primer for ORF amplification
ggatccagctagcaaaatgttcaggaacaattacgacggg

SEQ ID NO: 6333 - DNA, 40 bp, Artificial Sequence
  PCR primer for ORF amplification
ggatccagctagcaaaatgttgcaatttaaactagtttta

SEQ ID NO: 6334 - DNA, 40 bp, Artificial Sequence
  PCR primer for ORF amplification
ggatccagctagcaaaatgttttcacagattgttctttta

SEQ ID NO: 6335 - DNA, 40 bp, Artificial Sequence
  PCR primer for ORF amplification
ggatccagctagcaaaatgcaaaccccttcagaaaatacc

SEQ ID NO: 6336 - DNA, 40 bp, Artificial Sequence
  PCR primer for ORF amplification
ggatccagctagcaaaatgaaaaatattaaaaaaaatcaa

SEQ ID NO: 6337 - DNA, 40 bp, Artificial Sequence
  PCR primer for ORF amplification
ggatccagctagcaaaatgagtagaaatgtagataaggcc

SEQ ID NO: 6338 - DNA, 40 bp, Artificial Sequence
  PCR primer for ORF amplification
ggatccagctagcaaaatgagtcacaagagaaggggcctg

SEQ ID NO: 6339 - DNA, 40 bp, Artificial Sequence
  PCR primer for ORF amplification
ggatccagctagcaaaatgagttcagaattattaatatct

SEQ ID NO: 6340 - DNA, 40 bp, Artificial Sequence
  PCR primer for ORF amplification
ggatccagctagcaaaatgcattgggcagcagcggtagcg

SEQ ID NO: 6341 - DNA, 40 bp, Artificial Sequence
  PCR primer for ORF amplification
ggatccagctagcaaaatggataccaagctatctgtaaca

SEQ ID NO: 6342 - DNA, 40 bp, Artificial Sequence
  PCR primer for ORF amplification
ggatccagctagcaaaatggctgttcacaccaataggcaa

SEQ ID NO: 6343 - DNA, 40 bp, Artificial Sequence
  PCR primer for ORF amplification
ggatccagctagcaaaatgtcatacggaagagaagacact

SEQ ID NO: 6344 - DNA, 40 bp, Artificial Sequence
  PCR primer for ORF amplification
ggatccagctagcaaaatgttttttttcccgaagcttaga

SEQ ID NO: 6345 - DNA, 40 bp, Artificial Sequence
  PCR primer for ORF amplification
ggatccagctagcaaaatgacacatcctgtagcagtgaag

SEQ ID NO: 6346 - DNA, 40 bp, Artificial Sequence
  PCR primer for ORF amplification
ggatccagctagcaaaatgagcggagaaaatcgtgctgtg

SEQ ID NO: 6347 - DNA, 40 bp, Artificial Sequence
  PCR primer for ORF amplification
ggatccagctagcaaaatgccaagatcaaaacgttccaag

SEQ ID NO: 6348 - DNA, 40 bp, Artificial Sequence
  PCR primer for ORF amplification
ggatccagctagcaaaatggagcaaatgcattcattggaa

SEQ ID NO: 6349 - DNA, 40 bp, Artificial Sequence
  PCR primer for ORF amplification
ggatccagctagcaaaatggcaacgatggaaacgaccaca

SEQ ID NO: 6350 - DNA, 40 bp, Artificial Sequence
  PCR primer for ORF amplification
ggatccagctagcaaaatggcgaatttaaatatatttggg

SEQ ID NO: 6351 - DNA, 40 bp, Artificial Sequence
  PCR primer for ORF amplification
ggatccagctagcaaaatggtctgtgatacactggtatat

SEQ ID NO: 6352 - DNA, 40 bp, Artificial Sequence
  PCR primer for ORF amplification
ggatccagctagcaaaatgttaggattatatctatcctcc

SEQ ID NO: 6353 - DNA, 40 bp, Artificial Sequence
  PCR primer for ORF amplification
ggatccagctagcaaaatggctggttgggatatttttggt

SEQ ID NO: 6354 - DNA, 40 bp, Artificial Sequence
  PCR primer for ORF amplification
ggatccagctagcaaaatgactccaaaaagagcgctaata

SEQ ID NO: 6355 - DNA, 40 bp, Artificial Sequence; identical to SEQ ID NO: 6335
  PCR primer for ORF amplification

SEQ ID NO: 6356 - DNA, 40 bp, Artificial Sequence
  PCR primer for ORF amplification
ggatccagctagcaaaatgaaaacggcctacttggcgtca

SEQ ID NO: 6357 - DNA, 40 bp, Artificial Sequence
  PCR primer for ORF amplification
ggatccagctagcaaaatgaacagcaaatctcaacaacaa

SEQ ID NO: 6358 - DNA, 40 bp, Artificial Sequence
  PCR primer for ORF amplification
ggatccagctagcaaaatgaatcaaggttacacacagctt

SEQ ID NO: 6359 - DNA, 40 bp, Artificial Sequence
  PCR primer for ORF amplification
ggatccagctagcaaaatggcaaactctaaatttggatac

SEQ ID NO: 6360 - DNA, 40 bp, Artificial Sequence
  PCR primer for ORF amplification
ggatccagctagcaaaatggccccaaaaaaagttttactc

SEQ ID NO: 6361 - DNA, 40 bp, Artificial Sequence
  PCR primer for ORF amplification
ggatccagctagcaaaatggctcgccaaaattttttaggc

SEQ ID NO: 6362 - DNA, 40 bp, Artificial Sequence
  PCR primer for ORF amplification
ggatccagctagcaaaatggttcttcaatacccccagaat

SEQ ID NO: 6363 - DNA, 40 bp, Artificial Sequence
  PCR primer for ORF amplification
ggatccagctagcaaaatgtcgttaaaggataggtatcta

SEQ ID NO: 6364 - DNA, 40 bp, Artificial Sequence
  PCR primer for ORF amplification
ggatccagctagcaaaatgtgcgatagccatcaaaaggaa

SEQ ID NO: 6365 - DNA, 40 bp, Artificial Sequence
  PCR primer for ORF amplification
ggatccagctagcaaaatgaagttcacccctagcatagtt

SEQ ID NO: 6366 - DNA, 40 bp, Artificial Sequence
  PCR primer for ORF amplification
ggatccagctagcaaaatgacagacacatataatagcata

SEQ ID NO: 6367 - DNA, 40 bp, Artificial Sequence
  PCR primer for ORF amplification
ggatccagctagcaaaatgacagcaacgatcacaaataag

SEQ ID NO: 6368 - DNA, 40 bp, Artificial Sequence
  PCR primer for ORF amplification
ggatccagctagcaaaatgacagtgggtattgctaggaaa

SEQ ID NO: 6369 - DNA, 40 bp, Artificial Sequence
  PCR primer for ORF amplification
ggatccagctagcaaaatgacatctaaagttggtgaatat

SEQ ID NO: 6370 - DNA, 40 bp, Artificial Sequence
  PCR primer for ORF amplification
ggatccagctagcaaaatgacgatacaagcgaagcccagt

SEQ ID NO: 6371 - DNA, 40 bp, Artificial Sequence
  PCR primer for ORF amplification
ggatccagctagcaaaatgcctattaatattcgcagagcg

SEQ ID NO: 6372 - DNA, 40 bp, Artificial Sequence
  PCR primer for ORF amplification
ggatccagctagcaaaatgcgtgccaccactttattatct

SEQ ID NO: 6373 - DNA, 40 bp, Artificial Sequence
  PCR primer for ORF amplification
ggatccagctagcaaaatggattacgagaagtttctgtta

SEQ ID NO: 6374 - DNA, 40 bp, Artificial Sequence
  PCR primer for ORF amplification
ggatccagctagcaaaatggtcaaaccaattatagctccc

SEQ ID NO: 6375 - DNA, 40 bp, Artificial Sequence
  PCR primer for ORF amplification
ggatccagctagcaaaatgtcccacaaattaacaatcctg

SEQ ID NO: 6376 - DNA, 40 bp, Artificial Sequence
  PCR primer for ORF amplification
ggatccagctagcaaaatgtttactggtattgtagaatgc

SEQ ID NO: 6377 - DNA, 40 bp, Artificial Sequence
  PCR primer for ORF amplification
ggatccagctagcaaaatgaaattctccactgctttgtct

SEQ ID NO: 6378 - DNA, 40 bp, Artificial Sequence
  PCR primer for ORF amplification
ggatccagctagcaaaatgaatagtaccgccgctgcaata

SEQ ID NO: 6379 - DNA, 40 bp, Artificial Sequence
  PCR primer for ORF amplification
ggatccagctagcaaaatgagctcaagtttgcctaggtct

SEQ ID NO: 6380 - DNA, 40 bp, Artificial Sequence
  PCR primer for ORF amplification
ggatccagctagcaaaatgatgtcttgtctggtaccaaca

SEQ ID NO: 6381 - DNA, 40 bp, Artificial Sequence
  PCR primer for ORF amplification
ggatccagctagcaaaatgcaccaagattttcaagaagac

SEQ ID NO: 6382 - DNA, 40 bp, Artificial Sequence
  PCR primer for ORF amplification
ggatccagctagcaaaatgcagcctcatttagacaacaac

SEQ ID NO: 6383 - DNA, 40 bp, Artificial Sequence
  PCR primer for ORF amplification
ggatccagctagcaaaatggatgttgaaaaggatgtcctg

SEQ ID NO: 6384 - DNA, 40 bp, Artificial Sequence
  PCR primer for ORF amplification
ggatccagctagcaaaatggcaatagcattatggtattgt

SEQ ID NO: 6385 - DNA, 40 bp, Artificial Sequence
  PCR primer for ORF amplification
ggatccagctagcaaaatggttagcatgatccatattgtg

SEQ ID NO: 6386 - DNA, 40 bp, Artificial Sequence
  PCR primer for ORF amplification
ggatccagctagcaaaatgtctagtatgtttaatcacata

SEQ ID NO: 6387 - DNA, 40 bp, Artificial Sequence
  PCR primer for ORF amplification
ggatccagctagcaaaatgaaagatctccagaaaaaaagc

SEQ ID NO: 6388 - DNA, 40 bp, Artificial Sequence
  PCR primer for ORF amplification
ggatccagctagcaaaatgaaaggaacaggtggagtagta

SEQ ID NO: 6389 - DNA, 40 bp, Artificial Sequence
  PCR primer for ORF amplification
ggatccagctagcaaaatgacttcgaaaaaagtgatatta

SEQ ID NO: 6390 - DNA, 40 bp, Artificial Sequence
  PCR primer for ORF amplification
ggatccagctagcaaaatggccgatgaggaacgtttaaag

SEQ ID NO: 6391 - DNA, 40 bp, Artificial Sequence
  PCR primer for ORF amplification
ggatccagctagcaaaatggtcgctttaatctctaagaaa

SEQ ID NO: 6392 - DNA, 40 bp, Artificial Sequence
  PCR primer for ORF amplification
ggatccagctagcaaaatgtcagggttcattaagagcacg

SEQ ID NO: 6393 - DNA, 40 bp, Artificial Sequence
  PCR primer for ORF amplification
ggatccagctagcaaaatgtctacgttcatattccctggt

SEQ ID NO: 6394 - DNA, 40 bp, Artificial Sequence
  PCR primer for ORF amplification
ggatccagctagcaaaatgtggtcatcactttttggttgg

SEQ ID NO: 6395 - DNA, 40 bp, Artificial Sequence
  PCR primer for ORF amplification
ggatccagctagcaaaatggaaaacgataagggtcaatta

SEQ ID NO: 6396 - DNA, 40 bp, Artificial Sequence
  PCR primer for ORF amplification
ggatccagctagcaaaatggtacgtaccacgagatgttga

SEQ ID NO: 6397 - DNA, 40 bp, Artificial Sequence
  PCR primer for ORF amplification
ggatccagctagcaaaatgaatatgggaggcagtagcagc

SEQ ID NO: 6398 - DNA, 40 bp, Artificial Sequence
  PCR primer for ORF amplification
ggatccagctagcaaaatgagtgaagaagaagcgcataaa

SEQ ID NO: 6399 - DNA, 40 bp, Artificial Sequence
  PCR primer for ORF amplification
ggatccagctagcaaaatgctggtagtgggattgacaggt

SEQ ID NO: 6400 - DNA, 40 bp, Artificial Sequence
  PCR primer for ORF amplification
ggatccagctagcaaaatggccactattgcatcagaatac

SEQ ID NO: 6401 - DNA, 40 bp, Artificial Sequence
  PCR primer for ORF amplification
ggatccagctagcaaaatggtacccgcacctgggtcacgt

SEQ ID NO: 6402 - DNA, 40 bp, Artificial Sequence
  PCR primer for ORF amplification
ggatccagctagcaaaatggtcaaagctgttatttttacc

SEQ ID NO: 6403 - DNA, 40 bp, Artificial Sequence
  PCR primer for ORF amplification
ggatccagctagcaaaatgtctgcgtcactagtgaatcga

SEQ ID NO: 6404 - DNA, 40 bp, Artificial Sequence
  PCR primer for ORF amplification
ggatccagctagcaaaatgtctttttcatctatcttatca

SEQ ID NO: 6405 - DNA, 40 bp, Artificial Sequence
  PCR primer for ORF amplification
ggatccagctagcaaaatggcaccgaaaaagaaatcaaac

SEQ ID NO: 6406 - DNA, 40 bp, Artificial Sequence
  PCR primer for ORF amplification
ggatccagctagcaaaatgttgatgccaaagcaagaaaga

SEQ ID NO: 6407 - DNA, 40 bp, Artificial Sequence
  PCR primer for ORF amplification
ggatccagctagcaaaatgactgataggaatttctcacca

SEQ ID NO: 6408 - DNA, 40 bp, Artificial Sequence
  PCR primer for ORF amplification
ggatccagctagcaaaatgataaaaaactatttgggacga

SEQ ID NO: 6409 - DNA, 40 bp, Artificial Sequence
  PCR primer for ORF amplification
ggatccagctagcaaaatgcaaaaacacaatataaaatta

SEQ ID NO: 6410 - DNA, 40 bp, Artificial Sequence
  PCR primer for ORF amplification
ggatccagctagcaaaatgctcctatttccaagaagaact

SEQ ID NO: 6411 - DNA, 40 bp, Artificial Sequence
  PCR primer for ORF amplification
ggatccagctagcaaaatggaagttttaaagaacattaga

SEQ ID NO: 6412 - DNA, 40 bp, Artificial Sequence
  PCR primer for ORF amplification
ggatccagctagcaaaatggctgtcaatgaatttcaagtg

SEQ ID NO: 6413 - DNA, 40 bp, Artificial Sequence
  PCR primer for ORF amplification
ggatccagctagcaaaatgtcctcgacagtgatttcattg

SEQ ID NO: 6414 - DNA, 40 bp, Artificial Sequence
  PCR primer for ORF amplification
ggatccagctagcaaaatgttgcatttggaagatgacaat

SEQ ID NO: 6415 - DNA, 40 bp, Artificial Sequence
  PCR primer for ORF amplification
ggatccagctagcaaaatggcatcattacccaagagaata

SEQ ID NO: 6416 - DNA, 40 bp, Artificial Sequence
  PCR primer for ORF amplification
ggatccagctagcaaaatgactgtacaaattccaaaatta

SEQ ID NO: 6417 - DNA, 40 bp, Artificial Sequence
  PCR primer for ORF amplification
ggatccagctagcaaaatgcaacaaacaaaatttggcaag

SEQ ID NO: 6418 - DNA, 40 bp, Artificial Sequence
  PCR primer for ORF amplification
ggatccagctagcaaaatgcataacatccaattagtgcaa

SEQ ID NO: 6419 - DNA, 40 bp, Artificial Sequence
  PCR primer for ORF amplification
ggatccagctagcaaaatggctagaaatagaacaacctcc

SEQ ID NO: 6420 - DNA, 40 bp, Artificial Sequence
  PCR primer for ORF amplification
ggatccagctagcaaaatgggaaaatcagcgtatgtaaag

SEQ ID NO: 6421 - DNA, 40 bp, Artificial Sequence
  PCR primer for ORF amplification
ggatccagctagcaaaatgactgtggttgaaataaaaagc

SEQ ID NO: 6422 - DNA, 40 bp, Artificial Sequence
  PCR primer for ORF amplification
ggatccagctagcaaaatgagcatgagtatgggtgtccgt

SEQ ID NO: 6423 - DNA, 40 bp, Artificial Sequence
  PCR primer for ORF amplification
ggatccagctagcaaaatgccagcattattaaaaagatta

SEQ ID NO: 6424 - DNA, 40 bp, Artificial Sequence
  PCR primer for ORF amplification
ggatccagctagcaaaatgcttagtaatacacttattatt

SEQ ID NO: 6425 - DNA, 40 bp, Artificial Sequence
  PCR primer for ORF amplification
ggatccagctagcaaaatggaaacaagaatacttgttgtg

SEQ ID NO: 6426 - DNA, 40 bp, Artificial Sequence
  PCR primer for ORF amplification
ggatccagctagcaaaatgtctgctgttgaaatttcccct

SEQ ID NO: 6427 - DNA, 40 bp, Artificial Sequence
  PCR primer for ORF amplification
ggatccagctagcaaaatgtcttcacaagatgttctgata

SEQ ID NO: 6428 - DNA, 40 bp, Artificial Sequence
  PCR primer for ORF amplification
ggatccagctagcaaaatgtctttgacaccactgtgtgaa

SEQ ID NO: 6429 - DNA, 40 bp, Artificial Sequence
  PCR primer for ORF amplification
ggatccagctagcaaaatgtttaaaagaatcgcaatagcc

SEQ ID NO: 6430 - DNA, 40 bp, Artificial Sequence
  PCR primer for ORF amplification
ggatccagctagcaaaatgaatagatgggtagagaagtgg

SEQ ID NO: 6431 - DNA, 40 bp, Artificial Sequence
  PCR primer for ORF amplification
ggatccagctagcaaaatgacaatggaaaaaaatggaggt

SEQ ID NO: 6432 - DNA, 40 bp, Artificial Sequence
  PCR primer for ORF amplification
ggatccagctagcaaaatgagacaacgaaggtctgtagta

SEQ ID NO: 6433 - DNA, 40 bp, Artificial Sequence
  PCR primer for ORF amplification
ggatccagctagcaaaatgccttatacttggaagttttta

SEQ ID NO: 6434 - DNA, 40 bp, Artificial Sequence
  PCR primer for ORF amplification
ggatccagctagcaaaatggcatgtactaatgatggtcct

SEQ ID NO: 6435 - DNA, 40 bp, Artificial Sequence
  PCR primer for ORF amplification
ggatccagctagcaaaatggctacaccaagcacgggagca

SEQ ID NO: 6436 - DNA, 40 bp, Artificial Sequence
  PCR primer for ORF amplification
ggatccagctagcaaaatggctaccaggactcaatttgaa

SEQ ID NO: 6437 - DNA, 40 bp, Artificial Sequence
  PCR primer for ORF amplification
ggatccagctagcaaaatggctctacctctgataaaacct

SEQ ID NO: 6438 - DNA, 40 bp, Artificial Sequence
  PCR primer for ORF amplification
ggatccagctagcaaaatggctgaaacttccaacgacccc

SEQ ID NO: 6439 - DNA, 40 bp, Artificial Sequence
  PCR primer for ORF amplification
ggatccagctagcaaaatgagtactttagcggaagtaagt

SEQ ID NO: 6440 - DNA, 40 bp, Artificial Sequence
  PCR primer for ORF amplification
ggatccagctagcaaaatgactacagatccttctgtcaaa

SEQ ID NO: 6441 - DNA, 40 bp, Artificial Sequence
  PCR primer for ORF amplification
ggatccagctagcaaaatgagcaaagacaaagatatcaaa

SEQ ID NO: 6442 - DNA, 40 bp, Artificial Sequence
  PCR primer for ORF amplification
ggatccagctagcaaaatgccacaattttcagtagatctt

SEQ ID NO: 6443 - DNA, 40 bp, Artificial Sequence
  PCR primer for ORF amplification
ggatccagctagcaaaatggagagtatatttggtgggttt

SEQ ID NO: 6444 - DNA, 40 bp, Artificial Sequence
  PCR primer for ORF amplification
ggatccagctagcaaaatggcagaattttcagctgatcta

SEQ ID NO: 6445 - DNA, 40 bp, Artificial Sequence
  PCR primer for ORF amplification
ggatccagctagcaaaatggcatctaatcaacctggcaag

SEQ ID NO: 6446 - DNA, 40 bp, Artificial Sequence
  PCR primer for ORF amplification
ggatccagctagcaaaatgtcaagactagaaatatactcg

SEQ ID NO: 6447 - DNA, 40 bp, Artificial Sequence
  PCR primer for ORF amplification
ggatccagctagcaaaatgtctacgttgaaagttgtttca

SEQ ID NO: 6448 - DNA, 40 bp, Artificial Sequence
  PCR primer for ORF amplification
ggatccagctagcaaaatgtttcttaagacacctaattgg

SEQ ID NO: 6449 - DNA, 40 bp, Artificial Sequence
  PCR primer for ORF amplification
ggatccagctagcaaaatgtttgctgcaattgcctcagga

SEQ ID NO: 6450 - DNA, 40 bp, Artificial Sequence
  PCR primer for ORF amplification
ggatccagctagcaaaatgatcttaagcaaaacaaagaaa

SEQ ID NO: 6451 - DNA, 40 bp, Artificial Sequence
  PCR primer for ORF amplification
ggatccagctagcaaaatggtatgtctaataaaaccatca

SEQ ID NO: 6452 - DNA, 40 bp, Artificial Sequence
  PCR primer for ORF amplification
ggatccagctagcaaaatgagtgagcaaagccaattagat

SEQ ID NO: 6453 - DNA, 40 bp, Artificial Sequence
  PCR primer for ORF amplification
ggatccagctagcaaaatgccaaagttagttttagttaga

SEQ ID NO: 6454 - DNA, 40 bp, Artificial Sequence
  PCR primer for ORF amplification
ggatccagctagcaaaatgcctttgttagataccttcaag

SEQ ID NO: 6455 - DNA, 40 bp, Artificial Sequence
  PCR primer for ORF amplification
ggatccagctagcaaaatgctgcattgtgcgaggaggtat

SEQ ID NO: 6456 - DNA, 40 bp, Artificial Sequence
  PCR primer for ORF amplification
ggatccagctagcaaaatggtaaagattgcgataattact

SEQ ID NO: 6457 - DNA, 40 bp, Artificial Sequence
  PCR primer for ORF amplification
ggatccagctagcaaaatgtggagaacaaaaacgctagaa

SEQ ID NO: 6458 - DNA, 40 bp, Artificial Sequence
  PCR primer for ORF amplification
ggatccagctagcaaaatgataagaaatcagggatggtca

SEQ ID NO: 6459 - DNA, 40 bp, Artificial Sequence
  PCR primer for ORF amplification
ggatccagctagcaaaatggatcattcaatagaagtcact

SEQ ID NO: 6460 - DNA, 40 bp, Artificial Sequence
  PCR primer for ORF amplification
ggatccagctagcaaaatggcgaaaactttggcacaagga

SEQ ID NO: 6461 - DNA, 40 bp, Artificial Sequence
  PCR primer for ORF amplification
ggatccagctagcaaaatggctagaactttctttgtcggt

SEQ ID NO: 6462 - DNA, 40 bp, Artificial Sequence
  PCR primer for ORF amplification
ggatccagctagcaaaatgtctttctacaatactagtaac

SEQ ID NO: 6463 - DNA, 40 bp, Artificial Sequence
  PCR primer for ORF amplification
ggatccagctagcaaaatgaagttctcttccggcaaatct

SEQ ID NO: 6464 - DNA, 40 bp, Artificial Sequence
  PCR primer for ORF amplification
ggatccagctagcaaaatgaccacgaacgatacatacgag

SEQ ID NO: 6465 - DNA, 40 bp, Artificial Sequence
  PCR primer for ORF amplification
ggatccagctagcaaaatgatttatacgtcgtcaaagagc

SEQ ID NO: 6466 - DNA, 40 bp, Artificial Sequence
  PCR primer for ORF amplification
ggatccagctagcaaaatgctaatagaggagatagagttt

SEQ ID NO: 6467 - DNA, 40 bp, Artificial Sequence
  PCR primer for ORF amplification
ggatccagctagcaaaatggtgacagtcggtgtgttttct

SEQ ID NO: 6468 - DNA, 40 bp, Artificial Sequence
  PCR primer for ORF amplification
ggatccagctagcaaaatgtccattatgaagcagaggcta

SEQ ID NO: 6469 - DNA, 40 bp, Artificial Sequence
  PCR primer for ORF amplification
ggatccagctagcaaaatgttgcagctaaggtttatgcct

SEQ ID NO: 6470 - DNA, 40 bp, Artificial Sequence
  PCR primer for ORF amplification
ggatccagctagcaaaatgaagttcgaagacctcttggca

SEQ ID NO: 6471 - DNA, 40 bp, Artificial Sequence
  PCR primer for ORF amplification
ggatccagctagcaaaatgaatgttcaagacagaaggagg

SEQ ID NO: 6472 - DNA, 40 bp, Artificial Sequence
  PCR primer for ORF amplification
ggatccagctagcaaaatgaccgacagatattctttttcg

SEQ ID NO: 6473 - DNA, 40 bp, Artificial Sequence
  PCR primer for ORF amplification
ggatccagctagcaaaatgagtgacgacgattatatgaac

SEQ ID NO: 6474 - DNA, 40 bp, Artificial Sequence
  PCR primer for ORF amplification
ggatccagctagcaaaatgataaacacaggaagaagcagg

SEQ ID NO: 6475 - DNA, 40 bp, Artificial Sequence
  PCR primer for ORF amplification
ggatccagctagcaaaatgattgagaataaggttgaactg

SEQ ID NO: 6476 - DNA, 40 bp, Artificial Sequence
  PCR primer for ORF amplification
ggatccagctagcaaaatgcagcatattaaacatatgagg

SEQ ID NO: 6477 - DNA, 40 bp, Artificial Sequence
  PCR primer for ORF amplification
ggatccagctagcaaaatgcctatcaatcaaccgtcggga

SEQ ID NO: 6478 - DNA, 40 bp, Artificial Sequence
  PCR primer for ORF amplification
ggatccagctagcaaaatgcctttgaccacaaaaccttta

SEQ ID NO: 6479 - DNA, 40 bp, Artificial Sequence
  PCR primer for ORF amplification
ggatccagctagcaaaatggacccgattggaataaacaaa

SEQ ID NO: 6480 - DNA, 40 bp, Artificial Sequence
  PCR primer for ORF amplification
ggatccagctagcaaaatggctaaacttgtacatgatgtt

SEQ ID NO: 6481 - DNA, 40 bp, Artificial Sequence
  PCR primer for ORF amplification
ggatccagctagcaaaatggctacaaagcaggctcacaag

SEQ ID NO: 6482 - DNA, 40 bp, Artificial Sequence
  PCR primer for ORF amplification
ggatccagctagcaaaatgggattgactactaaacctcta

SEQ ID NO: 6483 - DNA, 40 bp, Artificial Sequence
  PCR primer for ORF amplification
ggatccagctagcaaaatgggctccaagcacagagtagac

SEQ ID NO: 6484 - DNA, 40 bp, Artificial Sequence
  PCR primer for ORF amplification
ggatccagctagcaaaatgtcccaggaagagaaagtggat

SEQ ID NO: 6485 - DNA, 40 bp, Artificial Sequence
  PCR primer for ORF amplification
ggatccagctagcaaaatgcaaatgtatgttacggcgaat

SEQ ID NO: 6486 - DNA, 40 bp, Artificial Sequence
  PCR primer for ORF amplification
ggatccagctagcaaaatggccccaaacgtatgatacttt

SEQ ID NO: 6487 - DNA, 40 bp, Artificial Sequence
  PCR primer for ORF amplification
ggatccagctagcaaaatgttgatgccaaaggaagacaga

SEQ ID NO: 6488 - DNA, 40 bp, Artificial Sequence
  PCR primer for ORF amplification
ggatccagctagcaaaatgacagtaaaaaaaatagctatt

SEQ ID NO: 6489 - DNA, 40 bp, Artificial Sequence
  PCR primer for ORF amplification
ggatccagctagcaaaatgagttcttataggggcggcagt

SEQ ID NO: 6490 - DNA, 40 bp, Artificial Sequence
  PCR primer for ORF amplification
ggatccagctagcaaaatggacctagatctagccagtatc

SEQ ID NO: 6491 - DNA, 40 bp, Artificial Sequence
  PCR primer for ORF amplification
ggatccagctagcaaaatggcttacatcaagatcgcttta

SEQ ID NO: 6492 - DNA, 40 bp, Artificial Sequence
  PCR primer for ORF amplification
ggatccagctagcaaaatggctttaaggctatttcgaaaa

SEQ ID NO: 6493 - DNA, 40 bp, Artificial Sequence
  PCR primer for ORF amplification
ggatccagctagcaaaatgttagatttattaagattacaa

SEQ ID NO: 6494 - DNA, 40 bp, Artificial Sequence
  PCR primer for ORF amplification
ggatccagctagcaaaatgggtaaaggtaagccaagaggt

SEQ ID NO: 6495 - DNA, 40 bp, Artificial Sequence
  PCR primer for ORF amplification
ggatccagctagcaaaatgaatccgtttagaatcttaggt

SEQ ID NO: 6496 - DNA, 40 bp, Artificial Sequence
  PCR primer for ORF amplification
ggatccagctagcaaaatggctgccgcatgcatttgtcaa

SEQ ID NO: 6497 - DNA, 40 bp, Artificial Sequence
  PCR primer for ORF amplification
ggatccagctagcaaaatgggcttttatgaaggcgatgac

SEQ ID NO: 6498 - DNA, 40 bp, Artificial Sequence
  PCR primer for ORF amplification
ggatccagctagcaaaatggtcgaagattccagagttaga

SEQ ID NO: 6499 - DNA, 40 bp, Artificial Sequence
  PCR primer for ORF amplification
ggatccagctagcaaaatgtcgggtgctgctgctgcatct

SEQ ID NO: 6500 - DNA, 40 bp, Artificial Sequence
  PCR primer for ORF amplification
ggatccagctagcaaaatggaaaatagcatgatgtttata

SEQ ID NO: 6501 - DNA, 40 bp, Artificial Sequence
  PCR primer for ORF amplification
ggatccagctagcaaaatggattatagtaactttggaaac

SEQ ID NO: 6502 - DNA, 40 bp, Artificial Sequence
  PCR primer for ORF amplification
ggatccagctagcaaaatgggtatgtggacgattaggaat

SEQ ID NO: 6503 - DNA, 40 bp, Artificial Sequence
  PCR primer for ORF amplification
ggatccagctagcaaaatgtactttgatgaagaacaattg

SEQ ID NO: 6504 - DNA, 40 bp, Artificial Sequence
  PCR primer for ORF amplification
ggatccagctagcaaaatgttattagatgaccagctgaag

SEQ ID NO: 6505 - DNA, 40 bp, Artificial Sequence
  PCR primer for ORF amplification
ggatccagctagcaaaatgttgaagctagctcgtccattt

SEQ ID NO: 6506 - DNA, 40 bp, Artificial Sequence
  PCR primer for ORF amplification
ggatccagctagcaaaatggcccaacgtgttactttcaga

SEQ ID NO: 6507 - DNA, 40 bp, Artificial Sequence
  PCR primer for ORF amplification
ggatccagctagcaaaatggccggtttgaaagacgttgtc

SEQ ID NO: 6508 - DNA, 40 bp, Artificial Sequence
  PCR primer for ORF amplification
ggatccagctagcaaaatgaatggaattcaagtggacatc

SEQ ID NO: 6509 - DNA, 40 bp, Artificial Sequence
  PCR primer for ORF amplification
ggatccagctagcaaaatgattagtaaagagtatgaattt

SEQ ID NO: 6510 - DNA, 40 bp, Artificial Sequence
  PCR primer for ORF amplification
ggatccagctagcaaaatgaaggcctgttccatattattt

SEQ ID NO: 6511 - DNA, 40 bp, Artificial Sequence
  PCR primer for ORF amplification
ggatccagctagcaaaatgagtatcgctgaattcgcttac

SEQ ID NO: 6512 - DNA, 40 bp, Artificial Sequence
  PCR primer for ORF amplification
ggatccagctagcaaaatgagtggttacgatagagctttg

SEQ ID NO: 6513 - DNA, 40 bp, Artificial Sequence
  PCR primer for ORF amplification
ggatccagctagcaaaatgcgtcaaaagagggctaagtca

SEQ ID NO: 6514 - DNA, 40 bp, Artificial Sequence
  PCR primer for ORF amplification
ggatccagctagcaaaatggcttacactaagatcgcttta

SEQ ID NO: 6515 - DNA, 40 bp, Artificial Sequence
  PCR primer for ORF amplification
ggatccagctagcaaaatgggtaaagttattttagttaca

SEQ ID NO: 6516 - DNA, 40 bp, Artificial Sequence
  PCR primer for ORF amplification
ggatccagctagcaaaatggttagagttgtcatagagagt

SEQ ID NO: 6517 - DNA, 40 bp, Artificial Sequence
  PCR primer for ORF amplification
ggatccagctagcaaaatgtctctgaaaaagcagatacca

SEQ ID NO: 6518 - DNA, 40 bp, Artificial Sequence
  PCR primer for ORF amplification
ggatccagctagcaaaatgtctgctccagaagctcaacaa

SEQ ID NO: 6519 - DNA, 40 bp, Artificial Sequence
  PCR primer for ORF amplification
ggatccagctagcaaaatgttgactatcacgaaaagactg

SEQ ID NO: 6520 - DNA, 40 bp, Artificial Sequence
  PCR primer for ORF amplification
ggatccagctagcaaaatgaccgttaagacaggtatgtga

SEQ ID NO: 6521 - DNA, 40 bp, Artificial Sequence
  PCR primer for ORF amplification
ggatccagctagcaaaatgagatcatctcttctaaccctt

SEQ ID NO: 6522 - DNA, 40 bp, Artificial Sequence
  PCR primer for ORF amplification
ggatccagctagcaaaatgagtttgtttgagtgggtattt

SEQ ID NO: 6523 - DNA, 40 bp, Artificial Sequence
  PCR primer for ORF amplification
ggatccagctagcaaaatggatgaatcggtggatcctgtg

SEQ ID NO: 6524 - DNA, 40 bp, Artificial Sequence
  PCR primer for ORF amplification
ggatccagctagcaaaatggatgtgttgaagctgggttat

SEQ ID NO: 6525 - DNA, 40 bp, Artificial Sequence
  PCR primer for ORF amplification
ggatccagctagcaaaatggctgtcggaaagaataagaga

SEQ ID NO: 6526 - DNA, 40 bp, Artificial Sequence
  PCR primer for ORF amplification
ggatccagctagcaaaatggctgttggtaagaataagaga

SEQ ID NO: 6527 - DNA, 40 bp, Artificial Sequence
  PCR primer for ORF amplification
ggatccagctagcaaaatgggcaaatttgagcaaaaagaa

SEQ ID NO: 6528 - DNA, 40 bp, Artificial Sequence
  PCR primer for ORF amplification
ggatccagctagcaaaatggtatgtagagatgaatataca

SEQ ID NO: 6529 - DNA, 40 bp, Artificial Sequence
  PCR primer for ORF amplification
ggatccagctagcaaaatggtgaaattacaaaggtttagc

SEQ ID NO: 6530 - DNA, 40 bp, Artificial Sequence
  PCR primer for ORF amplification
ggatccagctagcaaaatgttgcgaccactgagaaaaagc

SEQ ID NO: 6531 - DNA, 40 bp, Artificial Sequence
  PCR primer for ORF amplification
ggatccagctagcaaaatgaatacttcatcaagaataact

SEQ ID NO: 6532 - DNA, 40 bp, Artificial Sequence
  PCR primer for ORF amplification
ggatccagctagcaaaatgacaaacatggctgccaagaat

SEQ ID NO: 6533 - DNA, 40 bp, Artificial Sequence
  PCR primer for ORF amplification
ggatccagctagcaaaatgagtgttcgcttatcatacggc

SEQ ID NO: 6534 - DNA, 40 bp, Artificial Sequence
  PCR primer for ORF amplification
ggatccagctagcaaaatggatttcacaaaaccagaaact

SEQ ID NO: 6535 - DNA, 40 bp, Artificial Sequence
  PCR primer for ORF amplification
ggatccagctagcaaaatggccccaggtaagaaagtcgct

SEQ ID NO: 6536 - DNA, 40 bp, Artificial Sequence
  PCR primer for ORF amplification
ggatccagctagcaaaatggctccaggtaagaaagttgct

SEQ ID NO: 6537 - DNA, 40 bp, Artificial Sequence
  PCR primer for ORF amplification
ggatccagctagcaaaatgtctggtaatagagagcaagtc

SEQ ID NO: 6538 - DNA, 40 bp, Artificial Sequence
  PCR primer for ORF amplification
ggatccagctagcaaaatgtggtcgaaaaagtttacatta

SEQ ID NO: 6539 - DNA, 40 bp, Artificial Sequence
  PCR primer for ORF amplification
ggatccagctagcaaaatgttcaaatcagtggctaaattg

SEQ ID NO: 6540 - DNA, 40 bp, Artificial Sequence
  PCR primer for ORF amplification
ggatccagctagcaaaatgtttaatttaattttatggccc

SEQ ID NO: 6541 - DNA, 40 bp, Artificial Sequence
  PCR primer for ORF amplification
ggatccagctagcaaaatgtttgtggtggattggagcgtg

SEQ ID NO: 6542 - DNA, 40 bp, Artificial Sequence
  PCR primer for ORF amplification
ggatccagctagcaaaatgaaaagaagtgaaaaaaaatcg

SEQ ID NO: 6543 - DNA, 40 bp, Artificial Sequence
  PCR primer for ORF amplification
ggatccagctagcaaaatgaactctacaaccccatcgatt

SEQ ID NO: 6544 - DNA, 40 bp, Artificial Sequence
  PCR primer for ORF amplification
ggatccagctagcaaaatgtcacggaaattatgcacacta

SEQ ID NO: 6545 - DNA, 40 bp, Artificial Sequence
  PCR primer for ORF amplification
ggatccagctagcaaaatgtccactggtattacttatgat

SEQ ID NO: 6546 - DNA, 40 bp, Artificial Sequence
  PCR primer for ORF amplification
ggatccagctagcaaaatgtttgttgattattccggactg

SEQ ID NO: 6547 - DNA, 40 bp, Artificial Sequence
  PCR primer for ORF amplification
ggatccagctagcaaaatgaagaagacgttcgagcagttt

SEQ ID NO: 6548 - DNA, 40 bp, Artificial Sequence
  PCR primer for ORF amplification
ggatccagctagcaaaatgcaaaaaattttcagaccattc

SEQ ID NO: 6549 - DNA, 40 bp, Artificial Sequence
  PCR primer for ORF amplification
ggatccagctagcaaaatggatgacgatcacgaacagttg

SEQ ID NO: 6550 - DNA, 40 bp, Artificial Sequence
  PCR primer for ORF amplification
ggatccagctagcaaaatggcacccaagaaatccactacc

SEQ ID NO: 6551 - DNA, 40 bp, Artificial Sequence
  PCR primer for ORF amplification
ggatccagctagcaaaatggctgccggtgtcccaaaaatt

SEQ ID NO: 6552 - DNA, 40 bp, Artificial Sequence
  PCR primer for ORF amplification
ggatccagctagcaaaatgggcagtagatcggagaatgtg

SEQ ID NO: 6553 - DNA, 40 bp, Artificial Sequence
  PCR primer for ORF amplification
ggatccagctagcaaaatgggttccagaagatacgattcc

SEQ ID NO: 6554 - DNA, 40 bp, Artificial Sequence
  PCR primer for ORF amplification
ggatccagctagcaaaatgttagaagcaaaatttgaagaa

SEQ ID NO: 6555 - DNA, 40 bp, Artificial Sequence
  PCR primer for ORF amplification
ggatccagctagcaaaatgagctacaattatttgaaggca

SEQ ID NO: 6556 - DNA, 40 bp, Artificial Sequence
  PCR primer for ORF amplification
ggatccagctagcaaaatgaggtatgtttgataagatata

SEQ ID NO: 6557 - DNA, 40 bp, Artificial Sequence
  PCR primer for ORF amplification
ggatccagctagcaaaatggacggatattgggatgttgta

SEQ ID NO: 6558 - DNA, 40 bp, Artificial Sequence
  PCR primer for ORF amplification
ggatccagctagcaaaatggagccagagagcataggcgat

SEQ ID NO: 6559 - DNA, 40 bp, Artificial Sequence
  PCR primer for ORF amplification
ggatccagctagcaaaatgttcagaaagagattagtgaac

SEQ ID NO: 6560 - DNA, 40 bp, Artificial Sequence
  PCR primer for ORF amplification
ggatccagctagcaaaatgtttaatttattaaatacatat

SEQ ID NO: 6561 - DNA, 40 bp, Artificial Sequence
  PCR primer for ORF amplification
ggatccagctagcaaaatgattttcaaaatattgtgtagt

SEQ ID NO: 6562 - DNA, 40 bp, Artificial Sequence
  PCR primer for ORF amplification
ggatccagctagcaaaatgctttgtcgcaatactgccaga

SEQ ID NO: 6563 - DNA, 40 bp, Artificial Sequence
  PCR primer for ORF amplification
ggatccagctagcaaaatggtgtcgttagacgatatacta

SEQ ID NO: 6564 - DNA, 40 bp, Artificial Sequence
  PCR primer for ORF amplification
ggatccagctagcaaaatgttcttaactagaagtgaatat

SEQ ID NO: 6565 - DNA, 40 bp, Artificial Sequence
  PCR primer for ORF amplification
ggatccagctagcaaaatgtttgtactgatagataatgtc

SEQ ID NO: 6566 - DNA, 40 bp, Artificial Sequence
  PCR primer for ORF amplification
ggatccagctagcaaaatgaagacctatcatttgaataat

SEQ ID NO: 6567 - DNA, 40 bp, Artificial Sequence
  PCR primer for ORF amplification
ggatccagctagcaaaatgacaaaggaagaaggtcgtacg

SEQ ID NO: 6568 - DNA, 40 bp, Artificial Sequence
  PCR primer for ORF amplification
ggatccagctagcaaaatgacgaagtttattggttgtata

SEQ ID NO: 6569 - DNA, 40 bp, Artificial Sequence
  PCR primer for ORF amplification
ggatccagctagcaaaatgacgcaagaattcattgataaa

SEQ ID NO: 6570 - DNA, 40 bp, Artificial Sequence
  PCR primer for ORF amplification
ggatccagctagcaaaatgagtgaaacacgagaatctaat

SEQ ID NO: 6571 - DNA, 40 bp, Artificial Sequence
  PCR primer for ORF amplification
ggatccagctagcaaaatgcctcaaaacgattatatcgag

SEQ ID NO: 6572 - DNA, 40 bp, Artificial Sequence
  PCR primer for ORF amplification
ggatccagctagcaaaatgctgggtttgggccaatctgct

SEQ ID NO: 6573 - DNA, 40 bp, Artificial Sequence
  PCR primer for ORF amplification
ggatccagctagcaaaatggcaccaagtatagcaacggta

SEQ ID NO: 6574 - DNA, 40 bp, Artificial Sequence
  PCR primer for ORF amplification
ggatccagctagcaaaatggcaggtttatcgttcgacaat

SEQ ID NO: 6575 - DNA, 40 bp, Artificial Sequence
  PCR primer for ORF amplification
ggatccagctagcaaaatgtcaaataccgtaagagccatt

SEQ ID NO: 6576 - DNA, 40 bp, Artificial Sequence
  PCR primer for ORF amplification
ggatccagctagcaaaatgtcaactatgtcaacgcctgcc

SEQ ID NO: 6577 - DNA, 40 bp, Artificial Sequence
  PCR primer for ORF amplification
ggatccagctagcaaaatgtcagatatagaatcattggga

SEQ ID NO: 6578 - DNA, 40 bp, Artificial Sequence
  PCR primer for ORF amplification
ggatccagctagcaaaatgtctgcaaaacagcaactacgt

SEQ ID NO: 6579 - DNA, 40 bp, Artificial Sequence
  PCR primer for ORF amplification
ggatccagctagcaaaatgtttagtagaatttgtagcgct

SEQ ID NO: 6580 - DNA, 40 bp, Artificial Sequence
  PCR primer for ORF amplification
ggatccagctagcaaaatgaattggaagtcgtacgttttt

SEQ ID NO: 6581 - DNA, 40 bp, Artificial Sequence
  PCR primer for ORF amplification
ggatccagctagcaaaatggactttttgaatgatgatgaa

SEQ ID NO: 6582 - DNA, 40 bp, Artificial Sequence
  PCR primer for ORF amplification
ggatccagctagcaaaatgtgtggcatttttggctattgc

SEQ ID NO: 6583 - DNA, 40 bp, Artificial Sequence
  PCR primer for ORF amplification
ggatccagctagcaaaatgaggaattttttcacgttattt

SEQ ID NO: 6584 - DNA, 40 bp, Artificial Sequence
  PCR primer for ORF amplification
ggatccagctagcaaaatgatcgctacctccagagccgta

SEQ ID NO: 6585 - DNA, 40 bp, Artificial Sequence
  PCR primer for ORF amplification
ggatccagctagcaaaatgccacgattgacggttggaacg

SEQ ID NO: 6586 - DNA, 40 bp, Artificial Sequence
  PCR primer for ORF amplification
ggatccagctagcaaaatggaaggtgaacaaattatggag

SEQ ID NO: 6587 - DNA, 40 bp, Artificial Sequence
  PCR primer for ORF amplification
ggatccagctagcaaaatgggcaaggttattttgattaca

SEQ ID NO: 6588 - DNA, 40 bp, Artificial Sequence
  PCR primer for ORF amplification
ggatccagctagcaaaatgaagatacaaacaaatgctgta

SEQ ID NO: 6589 - DNA, 40 bp, Artificial Sequence
  PCR primer for ORF amplification
ggatccagctagcaaaatggctaaatttttgaaagcaggt

SEQ ID NO: 6590 - DNA, 40 bp, Artificial Sequence
  PCR primer for ORF amplification
ggatccagctagcaaaatgtcgtcactgcttaaattacat

SEQ ID NO: 6591 - DNA, 40 bp, Artificial Sequence
  PCR primer for ORF amplification
ggatccagctagcaaaatgaaccaaaatggtgataagaac

SEQ ID NO: 6592 - DNA, 40 bp, Artificial Sequence
  PCR primer for ORF amplification
ggatccagctagcaaaatgagtggcacgaggtgtttgcta

SEQ ID NO: 6593 - DNA, 40 bp, Artificial Sequence
  PCR primer for ORF amplification
ggatccagctagcaaaatgagttgggaaggttttaagaaa

SEQ ID NO: 6594 - DNA, 40 bp, Artificial Sequence
  PCR primer for ORF amplification
ggatccagctagcaaaatgcagccaatttcaataaaagat

SEQ ID NO: 6595 - DNA, 40 bp, Artificial Sequence
  PCR primer for ORF amplification
ggatccagctagcaaaatggattataaggaagaacagaag

SEQ ID NO: 6596 - DNA, 40 bp, Artificial Sequence
  PCR primer for ORF amplification
ggatccagctagcaaaatggcaaaccaaaagcaaatgaga

SEQ ID NO: 6597 - DNA, 40 bp, Artificial Sequence
  PCR primer for ORF amplification
ggatccagctagcaaaatggtgttcggtcagctgtatgcc

SEQ ID NO: 6598 - DNA, 40 bp, Artificial Sequence
  PCR primer for ORF amplification
ggatccagctagcaaaatgtcagcagacgaaacggatgcg

SEQ ID NO: 6599 - DNA, 40 bp, Artificial Sequence
  PCR primer for ORF amplification
ggatccagctagcaaaatgtctctttcggtcgccgaaaag

SEQ ID NO: 6600 - DNA, 40 bp, Artificial Sequence
  PCR primer for ORF amplification
ggatccagctagcaaaatgtcttgggacgacgaagctatc

SEQ ID NO: 6601 - DNA, 40 bp, Artificial Sequence
  PCR primer for ORF amplification
ggatccagctagcaaaatggtatgtgaaagagatattaaa

SEQ ID NO: 6602 - DNA, 40 bp, Artificial Sequence
  PCR primer for ORF amplification
ggatccagctagcaaaatgaactatttagaaggcgttggg

SEQ ID NO: 6603 - DNA, 40 bp, Artificial Sequence
  PCR primer for ORF amplification
ggatccagctagcaaaatgaatcacgatcctttcagttgg

SEQ ID NO: 6604 - DNA, 40 bp, Artificial Sequence
  PCR primer for ORF amplification
ggatccagctagcaaaatgagtgaaaagaagaaagttcta

SEQ ID NO: 6605 - DNA, 40 bp, Artificial Sequence
  PCR primer for ORF amplification
ggatccagctagcaaaatgcttgttttcaaaaggggtatt

SEQ ID NO: 6606 - DNA, 40 bp, Artificial Sequence
  PCR primer for ORF amplification
ggatccagctagcaaaatggcattgcatcagtatttatca

SEQ ID NO: 6607 - DNA, 40 bp, Artificial Sequence
  PCR primer for ORF amplification
ggatccagctagcaaaatgttcttaagaagcgttaaccgt

SEQ ID NO: 6608 - DNA, 40 bp, Artificial Sequence
  PCR primer for ORF amplification
ggatccagctagcaaaatgttgaacgtgctattgagaagg

SEQ ID NO: 6609 - DNA, 40 bp, Artificial Sequence; identical to SEQ ID NO: 6494
  PCR primer for ORF amplification

SEQ ID NO: 6610 - DNA, 40 bp, Artificial Sequence
  PCR primer for ORF amplification
ggatccagctagcaaaatgagcatcgaatactctgttatc

SEQ ID NO: 6611 - DNA, 40 bp, Artificial Sequence
  PCR primer for ORF amplification
ggatccagctagcaaaatgagctgcctggtgttgccatta

SEQ ID NO: 6612 - DNA, 40 bp, Artificial Sequence
  PCR primer for ORF amplification
ggatccagctagcaaaatggatatggaaatcgaagattca

SEQ ID NO: 6613 - DNA, 40 bp, Artificial Sequence
  PCR primer for ORF amplification
ggatccagctagcaaaatggatgtcgatgagaggttgcat

SEQ ID NO: 6614 - DNA, 40 bp, Artificial Sequence
  PCR primer for ORF amplification
ggatccagctagcaaaatggccttgaacgataatcctata

SEQ ID NO: 6615 - DNA, 40 bp, Artificial Sequence
  PCR primer for ORF amplification
ggatccagctagcaaaatgtcaaccagtcgtgaagattct

SEQ ID NO: 6616 - DNA, 40 bp, Artificial Sequence
  PCR primer for ORF amplification
ggatccagctagcaaaatgtcccaaggtagaaaagctgca

SEQ ID NO: 6617 - DNA, 40 bp, Artificial Sequence
  PCR primer for ORF amplification
ggatccagctagcaaaatgtcgaaagctacatataaggaa

SEQ ID NO: 6618 - DNA, 40 bp, Artificial Sequence
  PCR primer for ORF amplification
ggatccagctagcaaaatgacattgttaaataccctcagc

SEQ ID NO: 6619 - DNA, 40 bp, Artificial Sequence
  PCR primer for ORF amplification
ggatccagctagcaaaatgaagccgaacaatcgaacttgt

SEQ ID NO: 6620 - DNA, 40 bp, Artificial Sequence
  PCR primer for ORF amplification
ggatccagctagcaaaatgactagtttagatgacagtgtg

SEQ ID NO: 6621 - DNA, 40 bp, Artificial Sequence
  PCR primer for ORF amplification
ggatccagctagcaaaatgctgatagtattattcttaaca

SEQ ID NO: 6622 - DNA, 40 bp, Artificial Sequence
  PCR primer for ORF amplification
ggatccagctagcaaaatgggtttacctgaagttaacttt

SEQ ID NO: 6623 - DNA, 40 bp, Artificial Sequence
  PCR primer for ORF amplification
ggatccagctagcaaaatggtattggaagctacagtgtta

SEQ ID NO: 6624 - DNA, 40 bp, Artificial Sequence
  PCR primer for ORF amplification
ggatccagctagcaaaatgtcctctacacatagtaataat

SEQ ID NO: 6625 - DNA, 40 bp, Artificial Sequence
  PCR primer for ORF amplification
ggatccagctagcaaaatgtctagtagtaaattcgaagag

SEQ ID NO: 6626 - DNA, 40 bp, Artificial Sequence
  PCR primer for ORF amplification
ggatccagctagcaaaatggtatgttaatatggactaaag

SEQ ID NO: 6627 - DNA, 40 bp, Artificial Sequence
  PCR primer for ORF amplification
ggatccagctagcaaaatgaaaagcattttcaaggttaga

SEQ ID NO: 6628 - DNA, 40 bp, Artificial Sequence
  PCR primer for ORF amplification
ggatccagctagcaaaatgaagacagaaggaataaaaagc

SEQ ID NO: 6629 - DNA, 40 bp, Artificial Sequence
  PCR primer for ORF amplification
ggatccagctagcaaaatgaagtggttgttgtttccggca

SEQ ID NO: 6630 - DNA, 40 bp, Artificial Sequence
  PCR primer for ORF amplification
ggatccagctagcaaaatgacacatttagaaagaagtaga

SEQ ID NO: 6631 - DNA, 40 bp, Artificial Sequence
  PCR primer for ORF amplification
ggatccagctagcaaaatgggttggttttgggcagatcaa

SEQ ID NO: 6632 - DNA, 40 bp, Artificial Sequence
  PCR primer for ORF amplification
ggatccagctagcaaaatggtgcttagtgattcgttgaag

SEQ ID NO: 6633 - DNA, 40 bp, Artificial Sequence
  PCR primer for ORF amplification
ggatccagctagcaaaatgtccactgaattaaccgttcaa

SEQ ID NO: 6634 - DNA, 40 bp, Artificial Sequence
  PCR primer for ORF amplification
ggatccagctagcaaaatgtcgaagttcctacagggatca

SEQ ID NO: 6635 - DNA, 40 bp, Artificial Sequence
  PCR primer for ORF amplification
ggatccagctagcaaaatgtctttcactaaaatcgctgcc

SEQ ID NO: 6636 - DNA, 40 bp, Artificial Sequence
  PCR primer for ORF amplification
ggatccagctagcaaaatgacgatgcgaacaaataagaaa

SEQ ID NO: 6637 - DNA, 40 bp, Artificial Sequence
  PCR primer for ORF amplification
ggatccagctagcaaaatgagtaaccaacacagccctcag

SEQ ID NO: 6638 - DNA, 40 bp, Artificial Sequence
  PCR primer for ORF amplification
ggatccagctagcaaaatggcaacacacacgagcaagaga

SEQ ID NO: 6639 - DNA, 40 bp, Artificial Sequence
  PCR primer for ORF amplification
ggatccagctagcaaaatggctatcgaaaatatatacatt

SEQ ID NO: 6640 - DNA, 40 bp, Artificial Sequence
  PCR primer for ORF amplification
ggatccagctagcaaaatgtccagaactattccatttcta

SEQ ID NO: 6641 - DNA, 40 bp, Artificial Sequence
  PCR primer for ORF amplification
ggatccagctagcaaaatgtccaccgattctattgtcaag

SEQ ID NO: 6642 - DNA, 40 bp, Artificial Sequence
  PCR primer for ORF amplification
ggatccagctagcaaaatgtccactgattctattgttaaa

SEQ ID NO: 6643 - DNA, 40 bp, Artificial Sequence; identical to SEQ ID NO: 5422
  PCR primer for ORF amplification

SEQ ID NO: 6644 - DNA, 40 bp, Artificial Sequence
  PCR primer for ORF amplification
ggatccagctagcaaaatgagcagtcgtgtgtgctaccat

SEQ ID NO: 6645 - DNA, 40 bp, Artificial Sequence
  PCR primer for ORF amplification
ggatccagctagcaaaatgccttcgctaacccccagatgt

SEQ ID NO: 6646 - DNA, 40 bp, Artificial Sequence
  PCR primer for ORF amplification
ggatccagctagcaaaatgctctctcatatcgttgagtat

SEQ ID NO: 6647 - DNA, 40 bp, Artificial Sequence
  PCR primer for ORF amplification
ggatccagctagcaaaatgggtttggcagctacaagaacc

SEQ ID NO: 6648 - DNA, 40 bp, Artificial Sequence
  PCR primer for ORF amplification
ggatccagctagcaaaatggtatcgaagacttggatatgt

SEQ ID NO: 6649 - DNA, 40 bp, Artificial Sequence
  PCR primer for ORF amplification
ggatccagctagcaaaatggtgagctatggaagtcatagt

SEQ ID NO: 6650 - DNA, 40 bp, Artificial Sequence
  PCR primer for ORF amplification
ggatccagctagcaaaatgtctcgagttgcacagctcgac

SEQ ID NO: 6651 - DNA, 40 bp, Artificial Sequence
  PCR primer for ORF amplification
ggatccagctagcaaaatgtcttttgatattaattggagt

SEQ ID NO: 6652 - DNA, 40 bp, Artificial Sequence
  PCR primer for ORF amplification
ggatccagctagcaaaatggtatgtcgaacttgtactgaa

SEQ ID NO: 6653 - DNA, 40 bp, Artificial Sequence
  PCR primer for ORF amplification
ggatccagctagcaaaatgagaaacaggcagaatcaaaag

SEQ ID NO: 6654 - DNA, 40 bp, Artificial Sequence
  PCR primer for ORF amplification
ggatccagctagcaaaatgagagactataaattagtagta

SEQ ID NO: 6655 - DNA, 40 bp, Artificial Sequence
  PCR primer for ORF amplification
ggatccagctagcaaaatgatattcaatctacctgttagt

SEQ ID NO: 6656 - DNA, 40 bp, Artificial Sequence
  PCR primer for ORF amplification
ggatccagctagcaaaatggttaaaacgactgaagtagta

SEQ ID NO: 6657 - DNA, 40 bp, Artificial Sequence
  PCR primer for ORF amplification
ggatccagctagcaaaatgtctcgcgttggtgtcatggta

SEQ ID NO: 6658 - DNA, 40 bp, Artificial Sequence
  PCR primer for ORF amplification
ggatccagctagcaaaatgcaaatgtatgcaccatatcca

SEQ ID NO: 6659 - DNA, 40 bp, Artificial Sequence
  PCR primer for ORF amplification
ggatccagctagcaaaatgaccgttcccaggaatcgtccc

SEQ ID NO: 6660 - DNA, 40 bp, Artificial Sequence
  PCR primer for ORF amplification
ggatccagctagcaaaatgcctagattagaagagattgac

SEQ ID NO: 6661 - DNA, 40 bp, Artificial Sequence
  PCR primer for ORF amplification
ggatccagctagcaaaatggctgcgcagaatgcctttgaa

SEQ ID NO: 6662 - DNA, 40 bp, Artificial Sequence
  PCR primer for ORF amplification
ggatccagctagcaaaatgggtagtgttcaacgacaagat

SEQ ID NO: 6663 - DNA, 40 bp, Artificial Sequence
  PCR primer for ORF amplification
ggatccagctagcaaaatgtatgtttctaatgggaaagac

SEQ ID NO: 6664 - DNA, 40 bp, Artificial Sequence
  PCR primer for ORF amplification
ggatccagctagcaaaatgtcatatttgccgacttattcc

SEQ ID NO: 6665 - DNA, 40 bp, Artificial Sequence
  PCR primer for ORF amplification
ggatccagctagcaaaatgtccaacccatttgatttgtta

SEQ ID NO: 6666 - DNA, 40 bp, Artificial Sequence
  PCR primer for ORF amplification
ggatccagctagcaaaatgtcccaaactcgtgaagattct

SEQ ID NO: 6667 - DNA, 40 bp, Artificial Sequence
  PCR primer for ORF amplification
ggatccagctagcaaaatgttgattactgagacctttcat

SEQ ID NO: 6668 - DNA, 40 bp, Artificial Sequence
  PCR primer for ORF amplification
ggatccagctagcaaaatgtttggagtcaaggatgctata

SEQ ID NO: 6669 - DNA, 40 bp, Artificial Sequence
  PCR primer for ORF amplification
ggatccagctagcaaaatggtatgtttgatcgccggaggc

SEQ ID NO: 6670 - DNA, 40 bp, Artificial Sequence
  PCR primer for ORF amplification
ggatccagctagcaaaatgagggaaggtgattctaattca

SEQ ID NO: 6671 - DNA, 40 bp, Artificial Sequence
  PCR primer for ORF amplification
ggatccagctagcaaaatgagtgaagttgcaccagaggag

SEQ ID NO: 6672 - DNA, 40 bp, Artificial Sequence
  PCR primer for ORF amplification
ggatccagctagcaaaatgatacgtcagctcaattattgg

SEQ ID NO: 6673 - DNA, 40 bp, Artificial Sequence
  PCR primer for ORF amplification
ggatccagctagcaaaatgatctctgtcatggcggatgag

SEQ ID NO: 6674 - DNA, 40 bp, Artificial Sequence
  PCR primer for ORF amplification
ggatccagctagcaaaatgcaggttaaatcgattaaaatg

SEQ ID NO: 6675 - DNA, 40 bp, Artificial Sequence
  PCR primer for ORF amplification
ggatccagctagcaaaatgccaggtgtttccgttaggtac

SEQ ID NO: 6676 - DNA, 40 bp, Artificial Sequence
  PCR primer for ORF amplification
ggatccagctagcaaaatgccctcgttagccgaattgacc

SEQ ID NO: 6677 - DNA, 40 bp, Artificial Sequence
  PCR primer for ORF amplification
ggatccagctagcaaaatggaggagagtaagacaaaaaga

SEQ ID NO: 6678 - DNA, 40 bp, Artificial Sequence
  PCR primer for ORF amplification
ggatccagctagcaaaatggattttaaagcaagtgggaca

SEQ ID NO: 6679 - DNA, 40 bp, Artificial Sequence
  PCR primer for ORF amplification
ggatccagctagcaaaatggcaagaagacctgataaccaa

SEQ ID NO: 6680 - DNA, 40 bp, Artificial Sequence
  PCR primer for ORF amplification
ggatccagctagcaaaatggctaacggtacgtgaaagggg

SEQ ID NO: 6681 - DNA, 40 bp, Artificial Sequence
  PCR primer for ORF amplification
ggatccagctagcaaaatggtcaaatcgctacagctagcc

SEQ ID NO: 6682 - DNA, 40 bp, Artificial Sequence
  PCR primer for ORF amplification
ggatccagctagcaaaatggtgaaagtaactgcagcttgt

SEQ ID NO: 6683 - DNA, 40 bp, Artificial Sequence
  PCR primer for ORF amplification
ggatccagctagcaaaatggttgagtcaaatgatattata

SEQ ID NO: 6684 - DNA, 40 bp, Artificial Sequence
  PCR primer for ORF amplification
ggatccagctagcaaaatggttgcgcctactgctttgaaa

SEQ ID NO: 6685 - DNA, 40 bp, Artificial Sequence
  PCR primer for ORF amplification
ggatccagctagcaaaatgtcagccgtaggtccaggtagc

SEQ ID NO: 6686 - DNA, 40 bp, Artificial Sequence
  PCR primer for ORF amplification
ggatccagctagcaaaatgtcggcggctatcgaaaaagaa

SEQ ID NO: 6687 - DNA, 40 bp, Artificial Sequence
  PCR primer for ORF amplification
ggatccagctagcaaaatgacatcgtctgcttcttctcca

SEQ ID NO: 6688 - DNA, 40 bp, Artificial Sequence
  PCR primer for ORF amplification
ggatccagctagcaaaatgccaccgctagtatttgacata

SEQ ID NO: 6689 - DNA, 40 bp, Artificial Sequence
  PCR primer for ORF amplification
ggatccagctagcaaaatgtcacgtcctgaggagttggca

SEQ ID NO: 6690 - DNA, 40 bp, Artificial Sequence
  PCR primer for ORF amplification
ggatccagctagcaaaatgtctagtcgtaaaaaagtcaga

SEQ ID NO: 6691 - DNA, 40 bp, Artificial Sequence
  PCR primer for ORF amplification
ggatccagctagcaaaatgtctgaaaaaccacaacaagag

SEQ ID NO: 6692 - DNA, 40 bp, Artificial Sequence
  PCR primer for ORF amplification
ggatccagctagcaaaatgcgtttacaaagaaattccatc

SEQ ID NO: 6693 - DNA, 40 bp, Artificial Sequence
  PCR primer for ORF amplification
ggatccagctagcaaaatggctaaacaatcattaggtatg

SEQ ID NO: 6694 - DNA, 40 bp, Artificial Sequence
  PCR primer for ORF amplification
ggatccagctagcaaaatgggtactagcatagtaaatcta

SEQ ID NO: 6695 - DNA, 40 bp, Artificial Sequence
  PCR primer for ORF amplification
ggatccagctagcaaaatggttgaatcagatgaagatttc

SEQ ID NO: 6696 - DNA, 40 bp, Artificial Sequence
  PCR primer for ORF amplification
ggatccagctagcaaaatgggtatgttataaccataattc

SEQ ID NO: 6697 - DNA, 40 bp, Artificial Sequence
  PCR primer for ORF amplification
ggatccagctagcaaaatgaaattgcacggctttttattt

SEQ ID NO: 6698 - DNA, 40 bp, Artificial Sequence
  PCR primer for ORF amplification
ggatccagctagcaaaatgaataaagaagaattattgggt

SEQ ID NO: 6699 - DNA, 40 bp, Artificial Sequence
  PCR primer for ORF amplification
ggatccagctagcaaaatgataccaaagcttatagttttt

SEQ ID NO: 6700 - DNA, 40 bp, Artificial Sequence
  PCR primer for ORF amplification
ggatccagctagcaaaatgcagtgtaacacaagtatagaa

SEQ ID NO: 6701 - DNA, 40 bp, Artificial Sequence
  PCR primer for ORF amplification
ggatccagctagcaaaatggcttactctttaacaaggaaa

SEQ ID NO: 6702 - DNA, 40 bp, Artificial Sequence
  PCR primer for ORF amplification
ggatccagctagcaaaatgggtttacctaaatcggcatat

SEQ ID NO: 6703 - DNA, 40 bp, Artificial Sequence
  PCR primer for ORF amplification
ggatccagctagcaaaatggttggtatttacagaatactt

SEQ ID NO: 6704 - DNA, 40 bp, Artificial Sequence
  PCR primer for ORF amplification
ggatccagctagcaaaatgagagcaccaccttcaccgaga

SEQ ID NO: 6705 - DNA, 40 bp, Artificial Sequence
  PCR primer for ORF amplification
ggatccagctagcaaaatgagtgtattaagatctacatgc

SEQ ID NO: 6706 - DNA, 40 bp, Artificial Sequence
  PCR primer for ORF amplification
ggatccagctagcaaaatgcattatttgcctgttgcgata

SEQ ID NO: 6707 - DNA, 40 bp, Artificial Sequence
  PCR primer for ORF amplification
ggatccagctagcaaaatggagacctccaactttgttaaa

SEQ ID NO: 6708 - DNA, 40 bp, Artificial Sequence
  PCR primer for ORF amplification
ggatccagctagcaaaatggcgaagactatcaaagttatc

SEQ ID NO: 6709 - DNA, 40 bp, Artificial Sequence
  PCR primer for ORF amplification
ggatccagctagcaaaatgtcgcaagagtttgtggaagac

SEQ ID NO: 6710 - DNA, 40 bp, Artificial Sequence
  PCR primer for ORF amplification
ggatccagctagcaaaatgtctgaaagaaaagctattaac

SEQ ID NO: 6711 - DNA, 40 bp, Artificial Sequence
  PCR primer for ORF amplification
ggatccagctagcaaaatgtttagtgcattaggtaaatgg

SEQ ID NO: 6712 - DNA, 40 bp, Artificial Sequence
  PCR primer for ORF amplification
ggatccagctagcaaaatgttttcaaggctttctttgttt

SEQ ID NO: 6713 - DNA, 40 bp, Artificial Sequence
  PCR primer for ORF amplification
ggatccagctagcaaaatggctcaacgtgttactttcaga

SEQ ID NO: 6714 - DNA, 40 bp, Artificial Sequence
  PCR primer for ORF amplification
ggatccagctagcaaaatgaacgccaactctaccacgaca

SEQ ID NO: 6715 - DNA, 40 bp, Artificial Sequence
  PCR primer for ORF amplification
ggatccagctagcaaaatgcagggcacttttaaaaggttt

SEQ ID NO: 6716 - DNA, 40 bp, Artificial Sequence
  PCR primer for ORF amplification
ggatccagctagcaaaatggagataaaccaagcggctgaa

SEQ ID NO: 6717 - DNA, 40 bp, Artificial Sequence
  PCR primer for ORF amplification
ggatccagctagcaaaatggataaagaggtaagtgaattg

SEQ ID NO: 6718 - DNA, 40 bp, Artificial Sequence
  PCR primer for ORF amplification
ggatccagctagcaaaatggatagaactcaaacgtttatt

SEQ ID NO: 6719 - DNA, 40 bp, Artificial Sequence
  PCR primer for ORF amplification
ggatccagctagcaaaatggtagagttgacaattacgggt

SEQ ID NO: 6720 - DNA, 40 bp, Artificial Sequence
  PCR primer for ORF amplification
ggatccagctagcaaaatggtagctgtatgttcgttaatc

SEQ ID NO: 6721 - DNA, 40 bp, Artificial Sequence
  PCR primer for ORF amplification
ggatccagctagcaaaatgtcaattgtttcactgttaggc

SEQ ID NO: 6722 - DNA, 40 bp, Artificial Sequence
  PCR primer for ORF amplification
ggatccagctagcaaaatgtcatcaagacccgctaataac

SEQ ID NO: 6723 - DNA, 40 bp, Artificial Sequence
  PCR primer for ORF amplification
ggatccagctagcaaaatgtgtgaatacagcaaggctctt

SEQ ID NO: 6724 - DNA, 40 bp, Artificial Sequence
  PCR primer for ORF amplification
ggatccagctagcaaaatgtctttagttgtacaagaacaa

SEQ ID NO: 6725 - DNA, 40 bp, Artificial Sequence
  PCR primer for ORF amplification
ggatccagctagcaaaatgaaatccaaaacgtggattttc

SEQ ID NO: 6726 - DNA, 40 bp, Artificial Sequence
  PCR primer for ORF amplification
ggatccagctagcaaaatgaaggcgctagttgaagagatt

SEQ ID NO: 6727 - DNA, 40 bp, Artificial Sequence
  PCR primer for ORF amplification
ggatccagctagcaaaatgacaagatctccctggaagcgc

SEQ ID NO: 6728 - DNA, 40 bp, Artificial Sequence
  PCR primer for ORF amplification
ggatccagctagcaaaatgactgttgaatatactgcatcc

SEQ ID NO: 6729 - DNA, 40 bp, Artificial Sequence
  PCR primer for ORF amplification
ggatccagctagcaaaatgagcgatagagatcagatagaa

SEQ ID NO: 6730 - DNA, 40 bp, Artificial Sequence
  PCR primer for ORF amplification
ggatccagctagcaaaatggaaccagaagatacccagctg

SEQ ID NO: 6731 - DNA, 40 bp, Artificial Sequence
  PCR primer for ORF amplification
ggatccagctagcaaaatggctccatctggtatgtgaact

SEQ ID NO: 6732 - DNA, 40 bp, Artificial Sequence
  PCR primer for ORF amplification
ggatccagctagcaaaatgggaaatatgataaagaaggca

SEQ ID NO: 6733 - DNA, 40 bp, Artificial Sequence
  PCR primer for ORF amplification
ggatccagctagcaaaatgtcgcaagaaattaggcaaaat

SEQ ID NO: 6734 - DNA, 40 bp, Artificial Sequence
  PCR primer for ORF amplification
ggatccagctagcaaaatgaaagctaggaaatcgcagaga

SEQ ID NO: 6735 - DNA, 40 bp, Artificial Sequence
  PCR primer for ORF amplification
ggatccagctagcaaaatgaagaaaacaatttacaaagtc

SEQ ID NO: 6736 - DNA, 40 bp, Artificial Sequence
  PCR primer for ORF amplification
ggatccagctagcaaaatgaaggtaaatttaatgttgaaa

SEQ ID NO: 6737 - DNA, 40 bp, Artificial Sequence
  PCR primer for ORF amplification
ggatccagctagcaaaatgagtaatcattctgaaatctta

SEQ ID NO: 6738 - DNA, 40 bp, Artificial Sequence
  PCR primer for ORF amplification
ggatccagctagcaaaatgcaagtcatcggacgtggtggg

SEQ ID NO: 6739 - DNA, 40 bp, Artificial Sequence
  PCR primer for ORF amplification
ggatccagctagcaaaatggcactacgatttttcaacgat

SEQ ID NO: 6740 - DNA, 40 bp, Artificial Sequence
  PCR primer for ORF amplification
ggatccagctagcaaaatgggtttatatcaagcaaagaat

SEQ ID NO: 6741 - DNA, 40 bp, Artificial Sequence
  PCR primer for ORF amplification
ggatccagctagcaaaatgtccgaatatcagccaagttta

SEQ ID NO: 6742 - DNA, 40 bp, Artificial Sequence
  PCR primer for ORF amplification
ggatccagctagcaaaatgaacgtttgcaagttgaaagaa

SEQ ID NO: 6743 - DNA, 40 bp, Artificial Sequence
  PCR primer for ORF amplification
ggatccagctagcaaaatgagtattgacaacaagttgttt

SEQ ID NO: 6744 - DNA, 40 bp, Artificial Sequence
  PCR primer for ORF amplification
ggatccagctagcaaaatggatccaagtttagttttagag

SEQ ID NO: 6745 - DNA, 40 bp, Artificial Sequence
  PCR primer for ORF amplification
ggatccagctagcaaaatggctgaatcccatagatgtatg

SEQ ID NO: 6746 - DNA, 40 bp, Artificial Sequence
  PCR primer for ORF amplification
ggatccagctagcaaaatggtagcagacttaactaaaggt

SEQ ID NO: 6747 - DNA, 40 bp, Artificial Sequence
  PCR primer for ORF amplification
ggatccagctagcaaaatggttcctaagttttacaaactt

SEQ ID NO: 6748 - DNA, 40 bp, Artificial Sequence
  PCR primer for ORF amplification
ggatccagctagcaaaatgtctgacagagaacaaagcagc

SEQ ID NO: 6749 - DNA, 40 bp, Artificial Sequence
  PCR primer for ORF amplification
ggatccagctagcaaaatggctgaatcccatagacgtatg

SEQ ID NO: 6750 - DNA, 40 bp, Artificial Sequence
  PCR primer for ORF amplification
ggatccagctagcaaaatgaaccagatactaaatgcacaa

SEQ ID NO: 6751 - DNA, 40 bp, Artificial Sequence
  PCR primer for ORF amplification
ggatccagctagcaaaatgaatagtaaccgatgccaaacg

SEQ ID NO: 6752 - DNA, 40 bp, Artificial Sequence
  PCR primer for ORF amplification
ggatccagctagcaaaatgattcaaatggtgcccatttat

SEQ ID NO: 6753 - DNA, 40 bp, Artificial Sequence
  PCR primer for ORF amplification
ggatccagctagcaaaatgccaggacacgaattggaagac

SEQ ID NO: 6754 - DNA, 40 bp, Artificial Sequence
  PCR primer for ORF amplification
ggatccagctagcaaaatggttcaagctatcaaattaaat

SEQ ID NO: 6755 - DNA, 40 bp, Artificial Sequence
  PCR primer for ORF amplification
ggatccagctagcaaaatgtcctttttcgacatcgaagca

SEQ ID NO: 6756 - DNA, 40 bp, Artificial Sequence
  PCR primer for ORF amplification
ggatccagctagcaaaatgtctcaaagaataattcaacca

SEQ ID NO: 6757 - DNA, 40 bp, Artificial Sequence
  PCR primer for ORF amplification
ggatccagctagcaaaatgtctcctccagtttacagcgat

SEQ ID NO: 6758 - DNA, 40 bp, Artificial Sequence
  PCR primer for ORF amplification
ggatccagctagcaaaatgtctgaatcatctatttcttct

SEQ ID NO: 6759 - DNA, 40 bp, Artificial Sequence
  PCR primer for ORF amplification
ggatccagctagcaaaatgtctgacaaggaacaaacgagc

SEQ ID NO: 6760 - DNA, 40 bp, Artificial Sequence
  PCR primer for ORF amplification
ggatccagctagcaaaatgttactaaagtgtgtttgcaga

SEQ ID NO: 6761 - DNA, 40 bp, Artificial Sequence
  PCR primer for ORF amplification
ggatccagctagcaaaatggtatgtttgagatgaacaaaa

SEQ ID NO: 6762 - DNA, 40 bp, Artificial Sequence
  PCR primer for ORF amplification
ggatccagctagcaaaatgctttactccagagaatcaagg

SEQ ID NO: 6763 - DNA, 40 bp, Artificial Sequence
  PCR primer for ORF amplification
ggatccagctagcaaaatgaatactttttttctttccttg

SEQ ID NO: 6764 - DNA, 40 bp, Artificial Sequence
  PCR primer for ORF amplification
ggatccagctagcaaaatgacaggatctttaaacagacac

SEQ ID NO: 6765 - DNA, 40 bp, Artificial Sequence
  PCR primer for ORF amplification
ggatccagctagcaaaatgactccttccaccccaccaagg

SEQ ID NO: 6766 - DNA, 40 bp, Artificial Sequence
  PCR primer for ORF amplification
ggatccagctagcaaaatgatagcggattcatcagttttg

SEQ ID NO: 6767 - DNA, 40 bp, Artificial Sequence
  PCR primer for ORF amplification
ggatccagctagcaaaatggctattgatgctcaaaagctt

SEQ ID NO: 6768 - DNA, 40 bp, Artificial Sequence
  PCR primer for ORF amplification
ggatccagctagcaaaatgtcgaatactattgtgatagtc

SEQ ID NO: 6769 - DNA, 40 bp, Artificial Sequence
  PCR primer for ORF amplification
ggatccagctagcaaaatgtctgtccaagatactaaagcg

SEQ ID NO: 6770 - DNA, 40 bp, Artificial Sequence
  PCR primer for ORF amplification
ggatccagctagcaaaatgttgtggaaagtttctaagatg

SEQ ID NO: 6771 - DNA, 40 bp, Artificial Sequence
  PCR primer for ORF amplification
ggatccagctagcaaaatgaaaatcaatgtatcccgtcca

SEQ ID NO: 6772 - DNA, 40 bp, Artificial Sequence
  PCR primer for ORF amplification
ggatccagctagcaaaatgaagtttttactgcagcaaata

SEQ ID NO: 6773 - DNA, 40 bp, Artificial Sequence
  PCR primer for ORF amplification
ggatccagctagcaaaatgcgttcttcggtatatagtgag

SEQ ID NO: 6774 - DNA, 40 bp, Artificial Sequence
  PCR primer for ORF amplification
ggatccagctagcaaaatgctatccgtagtagcgatcccg

SEQ ID NO: 6775 - DNA, 40 bp, Artificial Sequence
  PCR primer for ORF amplification
ggatccagctagcaaaatggagctaagttcaccatcaaaa

SEQ ID NO: 6776 - DNA, 40 bp, Artificial Sequence
  PCR primer for ORF amplification
ggatccagctagcaaaatggatgctgatgaattggaattg

SEQ ID NO: 6777 - DNA, 40 bp, Artificial Sequence
  PCR primer for ORF amplification
ggatccagctagcaaaatgtcctccgatttagctgctgag

SEQ ID NO: 6778 - DNA, 40 bp, Artificial Sequence
  PCR primer for ORF amplification
ggatccagctagcaaaatgtctgaattaacagaggcggaa

SEQ ID NO: 6779 - DNA, 40 bp, Artificial Sequence
  PCR primer for ORF amplification
ggatccagctagcaaaatgtgggctcaattatcatatact

SEQ ID NO: 6780 - DNA, 40 bp, Artificial Sequence
  PCR primer for ORF amplification
ggatccagctagcaaaatgtgttcttttcaggttccatct

SEQ ID NO: 6781 - DNA, 40 bp, Artificial Sequence
  PCR primer for ORF amplification
ggatccagctagcaaaatgaaagccaagccactaagccaa

SEQ ID NO: 6782 - DNA, 40 bp, Artificial Sequence
  PCR primer for ORF amplification
ggatccagctagcaaaatgacttacacattggcaatttta

SEQ ID NO: 6783 - DNA, 40 bp, Artificial Sequence
  PCR primer for ORF amplification
ggatccagctagcaaaatgcaattcttcaaaacacttgcg

SEQ ID NO: 6784 - DNA, 40 bp, Artificial Sequence
  PCR primer for ORF amplification
ggatccagctagcaaaatgcagaatgaaccaatgtttcag

SEQ ID NO: 6785 - DNA, 40 bp, Artificial Sequence
  PCR primer for ORF amplification
ggatccagctagcaaaatggaaacggatagtggtatacct

SEQ ID NO: 6786 - DNA, 40 bp, Artificial Sequence
  PCR primer for ORF amplification
ggatccagctagcaaaatggctaagcaatctctaggtatg

SEQ ID NO: 6787 - DNA, 40 bp, Artificial Sequence
  PCR primer for ORF amplification
ggatccagctagcaaaatggctagatacggtgctacttcc

SEQ ID NO: 6788 - DNA, 40 bp, Artificial Sequence
  PCR primer for ORF amplification
ggatccagctagcaaaatggttattaaagaggactgtatc

SEQ ID NO: 6789 - DNA, 40 bp, Artificial Sequence
  PCR primer for ORF amplification
ggatccagctagcaaaatgtcagacatcgaagaaggtacg

SEQ ID NO: 6790 - DNA, 40 bp, Artificial Sequence
  PCR primer for ORF amplification
ggatccagctagcaaaatgtcgaatgcagaggccagcaga

SEQ ID NO: 6791 - DNA, 40 bp, Artificial Sequence
  PCR primer for ORF amplification
ggatccagctagcaaaatgtcgattgttggaaggaatgct

SEQ ID NO: 6792 - DNA, 40 bp, Artificial Sequence
  PCR primer for ORF amplification
ggatccagctagcaaaatgacctacactaccagacaaatt

SEQ ID NO: 6793 - DNA, 40 bp, Artificial Sequence
  PCR primer for ORF amplification
ggatccagctagcaaaatgcaagctattgccgatagtttc

SEQ ID NO: 6794 - DNA, 40 bp, Artificial Sequence
  PCR primer for ORF amplification
ggatccagctagcaaaatgcattacaagaaagcatttcta

SEQ ID NO: 6795 - DNA, 40 bp, Artificial Sequence
  PCR primer for ORF amplification
ggatccagctagcaaaatggtactgtcaaatgttaaaatc

SEQ ID NO: 6796 - DNA, 40 bp, Artificial Sequence
  PCR primer for ORF amplification
ggatccagctagcaaaatgtctaattctgccaaacttatc

SEQ ID NO: 6797 - DNA, 40 bp, Artificial Sequence
  PCR primer for ORF amplification
ggatccagctagcaaaatgtctgatgctcaattcgatgct

SEQ ID NO: 6798 - DNA, 40 bp, Artificial Sequence
  PCR primer for ORF amplification
ggatccagctagcaaaatgtctgccgtcccaagtgtccaa

SEQ ID NO: 6799 - DNA, 40 bp, Artificial Sequence
  PCR primer for ORF amplification
ggatccagctagcaaaatggaaattgaaaacgaacgtacg

SEQ ID NO: 6800 - DNA, 40 bp, Artificial Sequence
  PCR primer for ORF amplification
ggatccagctagcaaaatgacatcaattggtactggttac

SEQ ID NO: 6801 - DNA, 40 bp, Artificial Sequence
  PCR primer for ORF amplification
ggatccagctagcaaaatgactgccgacaacaatagtatg

SEQ ID NO: 6802 - DNA, 40 bp, Artificial Sequence
  PCR primer for ORF amplification
ggatccagctagcaaaatgagcagagctattactagagca

SEQ ID NO: 6803 - DNA, 40 bp, Artificial Sequence
  PCR primer for ORF amplification
ggatccagctagcaaaatgatggtacccaggattagtgct

SEQ ID NO: 6804 - DNA, 40 bp, Artificial Sequence
  PCR primer for ORF amplification
ggatccagctagcaaaatgcccagtgtctgccatacaagc

SEQ ID NO: 6805 - DNA, 40 bp, Artificial Sequence
  PCR primer for ORF amplification
ggatccagctagcaaaatggaagagtgtcctatttgtttg

SEQ ID NO: 6806 - DNA, 40 bp, Artificial Sequence
  PCR primer for ORF amplification
ggatccagctagcaaaatggcatcaagaaaactgcgtgac

SEQ ID NO: 6807 - DNA, 40 bp, Artificial Sequence
  PCR primer for ORF amplification
ggatccagctagcaaaatgtcggaagacgaattttttggt

SEQ ID NO: 6808 - DNA, 40 bp, Artificial Sequence
  PCR primer for ORF amplification
ggatccagctagcaaaatgcttgttattgttctgcagggc

SEQ ID NO: 6809 - DNA, 40 bp, Artificial Sequence
  PCR primer for ORF amplification
ggatccagctagcaaaatgaacagagtttcgtttattaaa

SEQ ID NO: 6810 - DNA, 40 bp, Artificial Sequence
  PCR primer for ORF amplification
ggatccagctagcaaaatgacagaacaagttaacaatgac

SEQ ID NO: 6811 - DNA, 40 bp, Artificial Sequence
  PCR primer for ORF amplification
ggatccagctagcaaaatggcgaggcctcaaaatcatcgc

SEQ ID NO: 6812 - DNA, 40 bp, Artificial Sequence
  PCR primer for ORF amplification
ggatccagctagcaaaatggctctctcttcaaactggcag

SEQ ID NO: 6813 - DNA, 40 bp, Artificial Sequence
  PCR primer for ORF amplification
ggatccagctagcaaaatggtttcccaatttgctattgag

SEQ ID NO: 6814 - DNA, 40 bp, Artificial Sequence
  PCR primer for ORF amplification
ggatccagctagcaaaatgtctgctcccactatgagatcc

SEQ ID NO: 6815 - DNA, 40 bp, Artificial Sequence
  PCR primer for ORF amplification
ggatccagctagcaaaatgggtaaatcgtatgtcatttaa

SEQ ID NO: 6816 - DNA, 40 bp, Artificial Sequence
  PCR primer for ORF amplification
ggatccagctagcaaaatggcaagatacggtgctacttca

SEQ ID NO: 6817 - DNA, 40 bp, Artificial Sequence
  PCR primer for ORF amplification
ggatccagctagcaaaatgagttataataatccgtaccag

SEQ ID NO: 6818 - DNA, 40 bp, Artificial Sequence
  PCR primer for ORF amplification
ggatccagctagcaaaatgcgtggtttcagtggtcaacca

SEQ ID NO: 6819 - DNA, 40 bp, Artificial Sequence
  PCR primer for ORF amplification
ggatccagctagcaaaatgctaagaagacaagcccgtgaa

SEQ ID NO: 6820 - DNA, 40 bp, Artificial Sequence
  PCR primer for ORF amplification
ggatccagctagcaaaatggaaaagctattacagtggtct

SEQ ID NO: 6821 - DNA, 40 bp, Artificial Sequence
  PCR primer for ORF amplification
ggatccagctagcaaaatggaattcatatctgcagactat

SEQ ID NO: 6822 - DNA, 40 bp, Artificial Sequence
  PCR primer for ORF amplification
ggatccagctagcaaaatggggaccgaagatgccattgcc

SEQ ID NO: 6823 - DNA, 40 bp, Artificial Sequence
  PCR primer for ORF amplification
ggatccagctagcaaaatgtcaaatatcattgcaagattt

SEQ ID NO: 6824 - DNA, 40 bp, Artificial Sequence
  PCR primer for ORF amplification
ggatccagctagcaaaatgtcagtttaccatttaccaacg

SEQ ID NO: 6825 - DNA, 40 bp, Artificial Sequence
  PCR primer for ORF amplification
ggatccagctagcaaaatgtccgaaaatcacgttcctgcc

SEQ ID NO: 6826 - DNA, 40 bp, Artificial Sequence
  PCR primer for ORF amplification
ggatccagctagcaaaatgtgtgataagtcaaaaacggta

SEQ ID NO: 6827 - DNA, 40 bp, Artificial Sequence
  PCR primer for ORF amplification
ggatccagctagcaaaatgttggtaagaaataggtatctg

SEQ ID NO: 6828 - DNA, 40 bp, Artificial Sequence
  PCR primer for ORF amplification
ggatccagctagcaaaatggtatgttaaaaagtgctcaga

SEQ ID NO: 6829 - DNA, 40 bp, Artificial Sequence
  PCR primer for ORF amplification
ggatccagctagcaaaatgaactctattttagacagaaat

SEQ ID NO: 6830 - DNA, 40 bp, Artificial Sequence
  PCR primer for ORF amplification
ggatccagctagcaaaatgaatacactattatttaagcga

SEQ ID NO: 6831 - DNA, 40 bp, Artificial Sequence
  PCR primer for ORF amplification
ggatccagctagcaaaatgactcgctcttccgttttagct

SEQ ID NO: 6832 - DNA, 40 bp, Artificial Sequence
  PCR primer for ORF amplification
ggatccagctagcaaaatgagcaataaaagcaaccgcagg

SEQ ID NO: 6833 - DNA, 40 bp, Artificial Sequence
  PCR primer for ORF amplification
ggatccagctagcaaaatgagtgcttcgaagattctttca

SEQ ID NO: 6834 - DNA, 40 bp, Artificial Sequence
  PCR primer for ORF amplification
ggatccagctagcaaaatgagttttagacatttcaagagg

SEQ ID NO: 6835 - DNA, 40 bp, Artificial Sequence
  PCR primer for ORF amplification
ggatccagctagcaaaatgcctaaaactagttatttaaac

SEQ ID NO: 6836 - DNA, 40 bp, Artificial Sequence
  PCR primer for ORF amplification
ggatccagctagcaaaatggagctaagaagtagacggagc

SEQ ID NO: 6837 - DNA, 40 bp, Artificial Sequence
  PCR primer for ORF amplification
ggatccagctagcaaaatggcacccagaaaacgctttagg

SEQ ID NO: 6838 - DNA, 40 bp, Artificial Sequence
  PCR primer for ORF amplification
ggatccagctagcaaaatgggcaagaagaagagtaagaac

SEQ ID NO: 6839 - DNA, 40 bp, Artificial Sequence
  PCR primer for ORF amplification
ggatccagctagcaaaatgtctaatccagatgatttagat

SEQ ID NO: 6840 - DNA, 40 bp, Artificial Sequence
  PCR primer for ORF amplification
ggatccagctagcaaaatgtcttctatctacaaagccctc

SEQ ID NO: 6841 - DNA, 40 bp, Artificial Sequence
  PCR primer for ORF amplification
ggatccagctagcaaaatgtctttagttgtccaagaacaa

SEQ ID NO: 6842 - DNA, 40 bp, Artificial Sequence
  PCR primer for ORF amplification
ggatccagctagcaaaatgaatacagcaaacactttggac

SEQ ID NO: 6843 - DNA, 40 bp, Artificial Sequence
  PCR primer for ORF amplification
ggatccagctagcaaaatgacatcactgaatatcatggga

SEQ ID NO: 6844 - DNA, 40 bp, Artificial Sequence
  PCR primer for ORF amplification
ggatccagctagcaaaatgcaaaggttttcactagtcact

SEQ ID NO: 6845 - DNA, 40 bp, Artificial Sequence
  PCR primer for ORF amplification
ggatccagctagcaaaatggaggacagtaaaaagaaagga

SEQ ID NO: 6846 - DNA, 40 bp, Artificial Sequence
  PCR primer for ORF amplification
ggatccagctagcaaaatggattctgcaagcaaagaggaa

SEQ ID NO: 6847 - DNA, 40 bp, Artificial Sequence
  PCR primer for ORF amplification
ggatccagctagcaaaatggcatgcaattttcagtttcca

SEQ ID NO: 6848 - DNA, 40 bp, Artificial Sequence
  PCR primer for ORF amplification
ggatccagctagcaaaatggtattaacgaggcaagtacta

SEQ ID NO: 6849 - DNA, 40 bp, Artificial Sequence
  PCR primer for ORF amplification
ggatccagctagcaaaatgtcatattacaacaggtatagg

SEQ ID NO: 6850 - DNA, 40 bp, Artificial Sequence
  PCR primer for ORF amplification
ggatccagctagcaaaatgtccgcagaaccattattaccc

SEQ ID NO: 6851 - DNA, 40 bp, Artificial Sequence
  PCR primer for ORF amplification
ggatccagctagcaaaatgttgaaggatttggttagagaa

SEQ ID NO: 6852 - DNA, 40 bp, Artificial Sequence
  PCR primer for ORF amplification
ggatccagctagcaaaatgtatgaagtaatacagaaaagg

SEQ ID NO: 6853 - DNA, 40 bp, Artificial Sequence
  PCR primer for ORF amplification
ggatccagctagcaaaatgaaggcttctagtaaagctatt

SEQ ID NO: 6854 - DNA, 40 bp, Artificial Sequence
  PCR primer for ORF amplification
ggatccagctagcaaaatgcatatgcaactcaggaaaaga

SEQ ID NO: 6855 - DNA, 40 bp, Artificial Sequence
  PCR primer for ORF amplification
ggatccagctagcaaaatgctggtagatttgaatgtaccg

SEQ ID NO: 6856 - DNA, 40 bp, Artificial Sequence
  PCR primer for ORF amplification
ggatccagctagcaaaatggaaagcacatcaggagaacgt

SEQ ID NO: 6857 - DNA, 40 bp, Artificial Sequence
  PCR primer for ORF amplification
ggatccagctagcaaaatggaggaacaggagataggcgtt

SEQ ID NO: 6858 - DNA, 40 bp, Artificial Sequence
  PCR primer for ORF amplification
ggatccagctagcaaaatggcacaagaaatcactcaccca

SEQ ID NO: 6859 - DNA, 40 bp, Artificial Sequence
  PCR primer for ORF amplification
ggatccagctagcaaaatggcatctgtgaacaattaccag

SEQ ID NO: 6860 - DNA, 40 bp, Artificial Sequence
  PCR primer for ORF amplification
ggatccagctagcaaaatggcgtcccaggttaacgcctta

SEQ ID NO: 6861 - DNA, 40 bp, Artificial Sequence
  PCR primer for ORF amplification
ggatccagctagcaaaatgtccaatgatgagataaaccag

SEQ ID NO: 6862 - DNA, 40 bp, Artificial Sequence
  PCR primer for ORF amplification
ggatccagctagcaaaatgaaattcgacaatgacagtgag

SEQ ID NO: 6863 - DNA, 40 bp, Artificial Sequence
  PCR primer for ORF amplification
ggatccagctagcaaaatgaacacgaatcagtccaatccg

SEQ ID NO: 6864 - DNA, 40 bp, Artificial Sequence
  PCR primer for ORF amplification
ggatccagctagcaaaatgaaggctactttactgttgaag

SEQ ID NO: 6865 - DNA, 40 bp, Artificial Sequence
  PCR primer for ORF amplification
ggatccagctagcaaaatgaatgacattaaacaattactt

SEQ ID NO: 6866 - DNA, 40 bp, Artificial Sequence
  PCR primer for ORF amplification
ggatccagctagcaaaatgactttaatggtacctttcaaa

SEQ ID NO: 6867 - DNA, 40 bp, Artificial Sequence
  PCR primer for ORF amplification
ggatccagctagcaaaatgcatttcaaagatttaggattg

SEQ ID NO: 6868 - DNA, 40 bp, Artificial Sequence
  PCR primer for ORF amplification
ggatccagctagcaaaatggacattaacatagacgatatt

SEQ ID NO: 6869 - DNA, 40 bp, Artificial Sequence
  PCR primer for ORF amplification
ggatccagctagcaaaatggataattttgaaagtactgct

SEQ ID NO: 6870 - DNA, 40 bp, Artificial Sequence
  PCR primer for ORF amplification
ggatccagctagcaaaatggcaaaaccgcgtggaagaaaa

SEQ ID NO: 6871 - DNA, 40 bp, Artificial Sequence
  PCR primer for ORF amplification
ggatccagctagcaaaatgtcaggtaacggtgctcaaggt

SEQ ID NO: 6872 - DNA, 40 bp, Artificial Sequence
  PCR primer for ORF amplification
ggatccagctagcaaaatgtcggtaagcgaacaagatcct

SEQ ID NO: 6873 - DNA, 40 bp, Artificial Sequence
  PCR primer for ORF amplification
ggatccagctagcaaaatgtctgctgaaattgaagaagct

SEQ ID NO: 6874 - DNA, 40 bp, Artificial Sequence
  PCR primer for ORF amplification
ggatccagctagcaaaatggactttactgcgaagataaag

SEQ ID NO: 6875 - DNA, 40 bp, Artificial Sequence
  PCR primer for ORF amplification
ggatccagctagcaaaatgaacggttactggaaacctgcg

SEQ ID NO: 6876 - DNA, 40 bp, Artificial Sequence
  PCR primer for ORF amplification
ggatccagctagcaaaatgaacgtgacaccgttggatgaa

SEQ ID NO: 6877 - DNA, 40 bp, Artificial Sequence
  PCR primer for ORF amplification
ggatccagctagcaaaatgaccattgatctagcttctatc

SEQ ID NO: 6878 - DNA, 40 bp, Artificial Sequence
  PCR primer for ORF amplification
ggatccagctagcaaaatgagcaacgctaatccttatgag

SEQ ID NO: 6879 - DNA, 40 bp, Artificial Sequence
  PCR primer for ORF amplification
ggatccagctagcaaaatgagtagtcgcaaaagcaccgct

SEQ ID NO: 6880 - DNA, 40 bp, Artificial Sequence
  PCR primer for ORF amplification
ggatccagctagcaaaatgagtttgagaacgccgaagaga

SEQ ID NO: 6881 - DNA, 40 bp, Artificial Sequence
  PCR primer for ORF amplification
ggatccagctagcaaaatgcctgtttatgaacacttattg

SEQ ID NO: 6882 - DNA, 40 bp, Artificial Sequence
  PCR primer for ORF amplification
ggatccagctagcaaaatgctgaagttgtcaagaagtgcc

SEQ ID NO: 6883 - DNA, 40 bp, Artificial Sequence
  PCR primer for ORF amplification
ggatccagctagcaaaatggacctcctaaaattcagttct

SEQ ID NO: 6884 - DNA, 40 bp, Artificial Sequence
  PCR primer for ORF amplification
ggatccagctagcaaaatggctacgttcaacccacaaaac

SEQ ID NO: 6885 - DNA, 40 bp, Artificial Sequence
  PCR primer for ORF amplification
ggatccagctagcaaaatggctctcggtaatgagataaac

SEQ ID NO: 6886 - DNA, 40 bp, Artificial Sequence
  PCR primer for ORF amplification
ggatccagctagcaaaatgggggaaagcttggatagatgt

SEQ ID NO: 6887 - DNA, 40 bp, Artificial Sequence
  PCR primer for ORF amplification
ggatccagctagcaaaatgtcactcagagcagtcccagga

SEQ ID NO: 6888 - DNA, 40 bp, Artificial Sequence
  PCR primer for ORF amplification
ggatccagctagcaaaatgtccgcctcagctcaacatagc

SEQ ID NO: 6889 - DNA, 40 bp, Artificial Sequence
  PCR primer for ORF amplification
ggatccagctagcaaaatgttaatgcaaataaaaatggac

SEQ ID NO: 6890 - DNA, 40 bp, Artificial Sequence
  PCR primer for ORF amplification
ggatccagctagcaaaatgatgagtgaccaagaaaacgag

SEQ ID NO: 6891 - DNA, 40 bp, Artificial Sequence
  PCR primer for ORF amplification
ggatccagctagcaaaatgtctgttgaaccagttgttgtc

SEQ ID NO: 6892 - DNA, 40 bp, Artificial Sequence
  PCR primer for ORF amplification
ggatccagctagcaaaatgaaactaaaaagggagtatgat

SEQ ID NO: 6893 - DNA, 40 bp, Artificial Sequence
  PCR primer for ORF amplification
ggatccagctagcaaaatgaagctgatcccaattattttg

SEQ ID NO: 6894 - DNA, 40 bp, Artificial Sequence
  PCR primer for ORF amplification
ggatccagctagcaaaatgaataggcagagcggtgtgaat

SEQ ID NO: 6895 - DNA, 40 bp, Artificial Sequence
  PCR primer for ORF amplification
ggatccagctagcaaaatggacgacattgaaacagccaag

SEQ ID NO: 6896 - DNA, 40 bp, Artificial Sequence
  PCR primer for ORF amplification
ggatccagctagcaaaatggactctcttgaagctagatta

SEQ ID NO: 6897 - DNA, 40 bp, Artificial Sequence
  PCR primer for ORF amplification
ggatccagctagcaaaatggattactttaatatcaagcag

SEQ ID NO: 6898 - DNA, 40 bp, Artificial Sequence
  PCR primer for ORF amplification
ggatccagctagcaaaatggcaagagatatcacatttttg

SEQ ID NO: 6899 - DNA, 40 bp, Artificial Sequence
  PCR primer for ORF amplification
ggatccagctagcaaaatgactggagaagactttaagatc

SEQ ID NO: 6900 - DNA, 40 bp, Artificial Sequence
  PCR primer for ORF amplification
ggatccagctagcaaaatgcctatcaaagaaactgataaa

SEQ ID NO: 6901 - DNA, 40 bp, Artificial Sequence
  PCR primer for ORF amplification
ggatccagctagcaaaatggatttggtgaaccatctaacc

SEQ ID NO: 6902 - DNA, 40 bp, Artificial Sequence
  PCR primer for ORF amplification
ggatccagctagcaaaatggctttccaaaaagacgctaag

SEQ ID NO: 6903 - DNA, 40 bp, Artificial Sequence
  PCR primer for ORF amplification
ggatccagctagcaaaatgggtattgaagacattagcgcc

SEQ ID NO: 6904 - DNA, 40 bp, Artificial Sequence
  PCR primer for ORF amplification
ggatccagctagcaaaatggtcgtcatagctaatgcgcac

SEQ ID NO: 6905 - DNA, 40 bp, Artificial Sequence
  PCR primer for ORF amplification
ggatccagctagcaaaatgtcaggtcctccacctccttac

SEQ ID NO: 6906 - DNA, 40 bp, Artificial Sequence
  PCR primer for ORF amplification
ggatccagctagcaaaatgtcgcatcaaatggcgccatgg

SEQ ID NO: 6907 - DNA, 40 bp, Artificial Sequence
  PCR primer for ORF amplification
ggatccagctagcaaaatgtcggagttacagtcacaacct

SEQ ID NO: 6908 - DNA, 40 bp, Artificial Sequence
  PCR primer for ORF amplification
ggatccagctagcaaaatgtctggaagctatcaacattta

SEQ ID NO: 6909 - DNA, 40 bp, Artificial Sequence
  PCR primer for ORF amplification
ggatccagctagcaaaatgtcagaattcaaggttaaaact

SEQ ID NO: 6910 - DNA, 40 bp, Artificial Sequence
  PCR primer for ORF amplification
ggatccagctagcaaaatgaaagtatttataactggtgct

SEQ ID NO: 6911 - DNA, 40 bp, Artificial Sequence
  PCR primer for ORF amplification
ggatccagctagcaaaatgagcggtgaattagcaaattac

SEQ ID NO: 6912 - DNA, 40 bp, Artificial Sequence
  PCR primer for ORF amplification
ggatccagctagcaaaatgatgaataaagtagatcaaatc

SEQ ID NO: 6913 - DNA, 40 bp, Artificial Sequence
  PCR primer for ORF amplification
ggatccagctagcaaaatggtcgcaatctcaatgatttgg

SEQ ID NO: 6914 - DNA, 40 bp, Artificial Sequence
  PCR primer for ORF amplification
ggatccagctagcaaaatgtcaaccaacgcaaaagagtct

SEQ ID NO: 6915 - DNA, 40 bp, Artificial Sequence
  PCR primer for ORF amplification
ggatccagctagcaaaatgtcgacgtcagtcccagtcaag

SEQ ID NO: 6916 - DNA, 40 bp, Artificial Sequence
  PCR primer for ORF amplification
ggatccagctagcaaaatgtcgcctcaataccatttttat

SEQ ID NO: 6917 - DNA, 40 bp, Artificial Sequence
  PCR primer for ORF amplification
ggatccagctagcaaaatgtctagaattagtatattagct

SEQ ID NO: 6918 - DNA, 40 bp, Artificial Sequence
  PCR primer for ORF amplification
ggatccagctagcaaaatgaaactttctaaattatcgatc

SEQ ID NO: 6919 - DNA, 40 bp, Artificial Sequence
  PCR primer for ORF amplification
ggatccagctagcaaaatgaagattcaggcgggccaattg

SEQ ID NO: 6920 - DNA, 40 bp, Artificial Sequence
  PCR primer for ORF amplification
ggatccagctagcaaaatgaaggttgttaaggaatttagt

SEQ ID NO: 6921 - DNA, 40 bp, Artificial Sequence
  PCR primer for ORF amplification
ggatccagctagcaaaatgacggatatagggagaaccaag

SEQ ID NO: 6922 - DNA, 40 bp, Artificial Sequence
  PCR primer for ORF amplification
ggatccagctagcaaaatggactgcaagatattggtgtta

SEQ ID NO: 6923 - DNA, 40 bp, Artificial Sequence
  PCR primer for ORF amplification
ggatccagctagcaaaatggccaatagaggagaaccggat

SEQ ID NO: 6924 - DNA, 40 bp, Artificial Sequence
  PCR primer for ORF amplification
ggatccagctagcaaaatgtccacaagcattacagtaaga

SEQ ID NO: 6925 - DNA, 40 bp, Artificial Sequence
  PCR primer for ORF amplification
ggatccagctagcaaaatgtccagtaaagctaccaaaagt

SEQ ID NO: 6926 - DNA, 40 bp, Artificial Sequence
  PCR primer for ORF amplification
ggatccagctagcaaaatgtctaccttttctgcttctgat

SEQ ID NO: 6927 - DNA, 40 bp, Artificial Sequence
  PCR primer for ORF amplification
ggatccagctagcaaaatgtccgactccgactccgactcc

SEQ ID NO: 6928 - DNA, 40 bp, Artificial Sequence
  PCR primer for ORF amplification
ggatccagctagcaaaatgaaacgctttaatggtatgtat

SEQ ID NO: 6929 - DNA, 40 bp, Artificial Sequence
  PCR primer for ORF amplification
ggatccagctagcaaaatgaattataatctatccaagtat

SEQ ID NO: 6930 - DNA, 40 bp, Artificial Sequence
  PCR primer for ORF amplification
ggatccagctagcaaaatgataagaatatgtcccattgtt

SEQ ID NO: 6931 - DNA, 40 bp, Artificial Sequence
  PCR primer for ORF amplification
ggatccagctagcaaaatgcctcataccgataagaaacaa

SEQ ID NO: 6932 - DNA, 40 bp, Artificial Sequence
  PCR primer for ORF amplification
ggatccagctagcaaaatgcgtttgtttgaaaatagtaaa

SEQ ID NO: 6933 - DNA, 40 bp, Artificial Sequence
  PCR primer for ORF amplification
ggatccagctagcaaaatgctttatttgatcggacttggt

SEQ ID NO: 6934 - DNA, 40 bp, Artificial Sequence
  PCR primer for ORF amplification
ggatccagctagcaaaatggaaaagtacaccaattggaga

SEQ ID NO: 6935 - DNA, 40 bp, Artificial Sequence
  PCR primer for ORF amplification
ggatccagctagcaaaatggagtccaataaacaaccacgt

SEQ ID NO: 6936 - DNA, 40 bp, Artificial Sequence
  PCR primer for ORF amplification
ggatccagctagcaaaatggttaataattcacagcatcct

SEQ ID NO: 6937 - DNA, 40 bp, Artificial Sequence
  PCR primer for ORF amplification
ggatccagctagcaaaatgtcaccgtgttatggacaaaac

SEQ ID NO: 6938 - DNA, 40 bp, Artificial Sequence
  PCR primer for ORF amplification
ggatccagctagcaaaatgtcgtattactttaaaaatctg

SEQ ID NO: 6939 - DNA, 40 bp, Artificial Sequence
  PCR primer for ORF amplification
ggatccagctagcaaaatgggtaaatcgtatgtccatata

SEQ ID NO: 6940 - DNA, 40 bp, Artificial Sequence
  PCR primer for ORF amplification
ggatccagctagcaaaatggtatgtttttaatttcgtttc

SEQ ID NO: 6941 - DNA, 40 bp, Artificial Sequence
  PCR primer for ORF amplification
ggatccagctagcaaaatgtctgaatttaagatgtatgct

SEQ ID NO: 6942 - DNA, 40 bp, Artificial Sequence
  PCR primer for ORF amplification
ggatccagctagcaaaatgaaaattttcaatacaatacaa

SEQ ID NO: 6943 - DNA, 40 bp, Artificial Sequence
  PCR primer for ORF amplification
ggatccagctagcaaaatgaaactgaaagttactggagca

SEQ ID NO: 6944 - DNA, 40 bp, Artificial Sequence
  PCR primer for ORF amplification
ggatccagctagcaaaatgctacaccataagttcgtatac

SEQ ID NO: 6945 - DNA, 40 bp, Artificial Sequence
  PCR primer for ORF amplification
ggatccagctagcaaaatggatgcttttgagaatatgtct

SEQ ID NO: 6946 - DNA, 40 bp, Artificial Sequence
  PCR primer for ORF amplification
ggatccagctagcaaaatgtccagtaatatagaacctcag

SEQ ID NO: 6947 - DNA, 40 bp, Artificial Sequence
  PCR primer for ORF amplification
ggatccagctagcaaaatgtcctacaaaaagtttgtgtac

SEQ ID NO: 6948 - DNA, 40 bp, Artificial Sequence
  PCR primer for ORF amplification
ggatccagctagcaaaatgttgaatagttcaagaaaatat

SEQ ID NO: 6949 - DNA, 40 bp, Artificial Sequence
  PCR primer for ORF amplification
ggatccagctagcaaaatgacctatccgaaaagaatacct

SEQ ID NO: 6950 - DNA, 40 bp, Artificial Sequence
  PCR primer for ORF amplification
ggatccagctagcaaaatgacctcaggatactataccgtc

SEQ ID NO: 6951 - DNA, 40 bp, Artificial Sequence
  PCR primer for ORF amplification
ggatccagctagcaaaatgactgttataaagacagaacca

SEQ ID NO: 6952 - DNA, 40 bp, Artificial Sequence
  PCR primer for ORF amplification
ggatccagctagcaaaatgagggaaaaaagaacaatttca

SEQ ID NO: 6953 - DNA, 40 bp, Artificial Sequence
  PCR primer for ORF amplification
ggatccagctagcaaaatgataaagttgcatgaagtgcct

SEQ ID NO: 6954 - DNA, 40 bp, Artificial Sequence
  PCR primer for ORF amplification
ggatccagctagcaaaatggttaaggtctggaatatagta

SEQ ID NO: 6955 - DNA, 40 bp, Artificial Sequence
  PCR primer for ORF amplification
ggatccagctagcaaaatgttttccagattatccagatct

SEQ ID NO: 6956 - DNA, 40 bp, Artificial Sequence
  PCR primer for ORF amplification
ggatccagctagcaaaatgactgttactgacacttttaaa

SEQ ID NO: 6957 - DNA, 40 bp, Artificial Sequence
  PCR primer for ORF amplification
ggatccagctagcaaaatgagtgtgataggtaggttcttg

SEQ ID NO: 6958 - DNA, 40 bp, Artificial Sequence
  PCR primer for ORF amplification
ggatccagctagcaaaatgagttctatagataatgacagc

SEQ ID NO: 6959 - DNA, 40 bp, Artificial Sequence
  PCR primer for ORF amplification
ggatccagctagcaaaatgccagaagtagagacaaagatt

SEQ ID NO: 6960 - DNA, 40 bp, Artificial Sequence
  PCR primer for ORF amplification
ggatccagctagcaaaatggacgaaaaagtcgaacttatt

SEQ ID NO: 6961 - DNA, 40 bp, Artificial Sequence
  PCR primer for ORF amplification
ggatccagctagcaaaatgggtatgtcagcaccgtgattt

SEQ ID NO: 6962 - DNA, 40 bp, Artificial Sequence
  PCR primer for ORF amplification
ggatccagctagcaaaatgtccacaactgattcggggttc

SEQ ID NO: 6963 - DNA, 40 bp, Artificial Sequence
  PCR primer for ORF amplification
ggatccagctagcaaaatgtctgttatcttagtatctgct

SEQ ID NO: 6964 - DNA, 40 bp, Artificial Sequence
  PCR primer for ORF amplification
ggatccagctagcaaaatgaagatgttgaggcgtacaaag

SEQ ID NO: 6965 - DNA, 40 bp, Artificial Sequence
  PCR primer for ORF amplification
ggatccagctagcaaaatgaatacttcagaactgtcaata

SEQ ID NO: 6966 - DNA, 40 bp, Artificial Sequence
  PCR primer for ORF amplification
ggatccagctagcaaaatgacaaaagatattagaacaggc

SEQ ID NO: 6967 - DNA, 40 bp, Artificial Sequence
  PCR primer for ORF amplification
ggatccagctagcaaaatgactatggacggaaaaaacaaa

SEQ ID NO: 6968 - DNA, 40 bp, Artificial Sequence
  PCR primer for ORF amplification
ggatccagctagcaaaatgactgcccaacaagtatgtgta

SEQ ID NO: 6969 - DNA, 40 bp, Artificial Sequence
  PCR primer for ORF amplification
ggatccagctagcaaaatgactgtaaaagagtatactaaa

SEQ ID NO: 6970 - DNA, 40 bp, Artificial Sequence
  PCR primer for ORF amplification
ggatccagctagcaaaatgatttctgactacgatgctctt

SEQ ID NO: 6971 - DNA, 40 bp, Artificial Sequence
  PCR primer for ORF amplification
ggatccagctagcaaaatgcaacaagcaactgggaacgaa

SEQ ID NO: 6972 - DNA, 40 bp, Artificial Sequence
  PCR primer for ORF amplification
ggatccagctagcaaaatgccattatttgatcttatttct

SEQ ID NO: 6973 - DNA, 40 bp, Artificial Sequence
  PCR primer for ORF amplification
ggatccagctagcaaaatggtcaccattgtatttgatcat

SEQ ID NO: 6974 - DNA, 40 bp, Artificial Sequence
  PCR primer for ORF amplification
ggatccagctagcaaaatgtccacttctcattgcagattt

SEQ ID NO: 6975 - DNA, 40 bp, Artificial Sequence
  PCR primer for ORF amplification
ggatccagctagcaaaatgtcgcagaaaatacagcagcat

SEQ ID NO: 6976 - DNA, 40 bp, Artificial Sequence
  PCR primer for ORF amplification
ggatccagctagcaaaatgcttgtatgttacaataatctt

SEQ ID NO: 6977 - DNA, 40 bp, Artificial Sequence
  PCR primer for ORF amplification
ggatccagctagcaaaatggccaaagacattgagatatcc

SEQ ID NO: 6978 - DNA, 40 bp, Artificial Sequence
  PCR primer for ORF amplification
ggatccagctagcaaaatggttgaggaaaattccagagtt

SEQ ID NO: 6979 - DNA, 40 bp, Artificial Sequence
  PCR primer for ORF amplification
ggatccagctagcaaaatgtccggtaacggtgctcaaggt

SEQ ID NO: 6980 - DNA, 40 bp, Artificial Sequence
  PCR primer for ORF amplification
ggatccagctagcaaaatgtcctctgtccaatccaagatc

SEQ ID NO: 6981 - DNA, 40 bp, Artificial Sequence
  PCR primer for ORF amplification
ggatccagctagcaaaatgtcggagtttaatattacagaa

SEQ ID NO: 6982 - DNA, 40 bp, Artificial Sequence
  PCR primer for ORF amplification
ggatccagctagcaaaatgtcttcgaacgattcgaacgat

SEQ ID NO: 6983 - DNA, 40 bp, Artificial Sequence
  PCR primer for ORF amplification
ggatccagctagcaaaatgaatcaaatctggtctacaggt

SEQ ID NO: 6984 - DNA, 40 bp, Artificial Sequence
  PCR primer for ORF amplification
ggatccagctagcaaaatgaattataactgcgaaatacaa

SEQ ID NO: 6985 - DNA, 40 bp, Artificial Sequence
  PCR primer for ORF amplification
ggatccagctagcaaaatgacctcaattgaagatctgata

SEQ ID NO: 6986 - DNA, 40 bp, Artificial Sequence
  PCR primer for ORF amplification
ggatccagctagcaaaatgagttcagtagagagaataaaa

SEQ ID NO: 6987 - DNA, 40 bp, Artificial Sequence
  PCR primer for ORF amplification
ggatccagctagcaaaatgatgaaaaaaaaaccaaagtgc

SEQ ID NO: 6988 - DNA, 40 bp, Artificial Sequence
  PCR primer for ORF amplification
ggatccagctagcaaaatgcagttgagcaaggctgctgag

SEQ ID NO: 6989 - DNA, 40 bp, Artificial Sequence
  PCR primer for ORF amplification
ggatccagctagcaaaatgctgtggcatcctgatggttac

SEQ ID NO: 6990 - DNA, 40 bp, Artificial Sequence
  PCR primer for ORF amplification
ggatccagctagcaaaatggaacgactacagagattgatg

SEQ ID NO: 6991 - DNA, 40 bp, Artificial Sequence
  PCR primer for ORF amplification
ggatccagctagcaaaatgtcaattacgaagactgaactg

SEQ ID NO: 6992 - DNA, 40 bp, Artificial Sequence
  PCR primer for ORF amplification
ggatccagctagcaaaatgtccgacgaaattgtttggcaa

SEQ ID NO: 6993 - DNA, 40 bp, Artificial Sequence
  PCR primer for ORF amplification
ggatccagctagcaaaatgaccggcatggaatcaggagag

SEQ ID NO: 6994 - DNA, 40 bp, Artificial Sequence
  PCR primer for ORF amplification
ggatccagctagcaaaatgactagtaaattaaaacgggtt

SEQ ID NO: 6995 - DNA, 40 bp, Artificial Sequence
  PCR primer for ORF amplification
ggatccagctagcaaaatgactagtttggacgatacaata

SEQ ID NO: 6996 - DNA, 40 bp, Artificial Sequence
  PCR primer for ORF amplification
ggatccagctagcaaaatgactgagcaagcaactaagcca

SEQ ID NO: 6997 - DNA, 40 bp, Artificial Sequence
  PCR primer for ORF amplification
ggatccagctagcaaaatgagtagcgacgctaagcaacaa

SEQ ID NO: 6998 - DNA, 40 bp, Artificial Sequence
  PCR primer for ORF amplification
ggatccagctagcaaaatggtaccccccacggtagaagca

SEQ ID NO: 6999 - DNA, 40 bp, Artificial Sequence
  PCR primer for ORF amplification
ggatccagctagcaaaatggttcagcaactaagccttttt

SEQ ID NO: 7000 - DNA, 40 bp, Artificial Sequence
  PCR primer for ORF amplification
ggatccagctagcaaaatgtcatcagactcaaacgcaaag

SEQ ID NO: 7001 - DNA, 40 bp, Artificial Sequence
  PCR primer for ORF amplification
ggatccagctagcaaaatgtctgaagaatttccatctcct

SEQ ID NO: 7002 - DNA, 40 bp, Artificial Sequence
  PCR primer for ORF amplification
ggatccagctagcaaaatgttcaagaggcaattatcgact

SEQ ID NO: 7003 - DNA, 40 bp, Artificial Sequence
  PCR primer for ORF amplification
ggatccagctagcaaaatgttgatttcttcacggatcgtt

SEQ ID NO: 7004 - DNA, 40 bp, Artificial Sequence
  PCR primer for ORF amplification
ggatccagctagcaaaatgaagagcttttttctttatctt

SEQ ID NO: 7005 - DNA, 40 bp, Artificial Sequence
  PCR primer for ORF amplification
ggatccagctagcaaaatgatggacttagataagattata

SEQ ID NO: 7006 - DNA, 40 bp, Artificial Sequence
  PCR primer for ORF amplification
ggatccagctagcaaaatgcaacttgtgccgctagaattg

SEQ ID NO: 7007 - DNA, 40 bp, Artificial Sequence
  PCR primer for ORF amplification
ggatccagctagcaaaatggtacgcaagaataaaataaat

SEQ ID NO: 7008 - DNA, 40 bp, Artificial Sequence
  PCR primer for ORF amplification
ggatccagctagcaaaatgtcaaactacgaagccttgctg

SEQ ID NO: 7009 - DNA, 40 bp, Artificial Sequence
  PCR primer for ORF amplification
ggatccagctagcaaaatgggtgaaaaacgtaaccgtaat

SEQ ID NO: 7010 - DNA, 40 bp, Artificial Sequence; identical to SEQ ID NO: 6167
  PCR primer for ORF amplification

SEQ ID NO: 7011 - DNA, 40 bp, Artificial Sequence
  PCR primer for ORF amplification
ggatccagctagcaaaatgaaaatcttccatactgtcgaa

SEQ ID NO: 7012 - DNA, 40 bp, Artificial Sequence
  PCR primer for ORF amplification
ggatccagctagcaaaatgaacttccacacggcaagaata

SEQ ID NO: 7013 - DNA, 40 bp, Artificial Sequence
  PCR primer for ORF amplification
ggatccagctagcaaaatgattttcaaaaggttcgttaat

SEQ ID NO: 7014 - DNA, 40 bp, Artificial Sequence
  PCR primer for ORF amplification
ggatccagctagcaaaatgcagggaaataaatcaactata

SEQ ID NO: 7015 - DNA, 40 bp, Artificial Sequence
  PCR primer for ORF amplification
ggatccagctagcaaaatgcctcttcaactttttggcagg

SEQ ID NO: 7016 - DNA, 40 bp, Artificial Sequence
  PCR primer for ORF amplification
ggatccagctagcaaaatgctgagatcgttattgcaaagc

SEQ ID NO: 7017 - DNA, 40 bp, Artificial Sequence
  PCR primer for ORF amplification
ggatccagctagcaaaatggatagtaaggaagtactggta

SEQ ID NO: 7018 - DNA, 40 bp, Artificial Sequence
  PCR primer for ORF amplification
ggatccagctagcaaaatggcaagtatgtattagtgctag

SEQ ID NO: 7019 - DNA, 40 bp, Artificial Sequence
  PCR primer for ORF amplification
ggatccagctagcaaaatggccagttcgtcacataaccct

SEQ ID NO: 7020 - DNA, 40 bp, Artificial Sequence
  PCR primer for ORF amplification
ggatccagctagcaaaatggcgagtgtaccaagtctatgc

SEQ ID NO: 7021 - DNA, 40 bp, Artificial Sequence
  PCR primer for ORF amplification
ggatccagctagcaaaatgtcaaagtttgttatcacctgc

SEQ ID NO: 7022 - DNA, 40 bp, Artificial Sequence
  PCR primer for ORF amplification
ggatccagctagcaaaatgtcagaagaccagcgtgtaatt

SEQ ID NO: 7023 - DNA, 40 bp, Artificial Sequence
  PCR primer for ORF amplification
ggatccagctagcaaaatgtctcacacagaaacacagact

SEQ ID NO: 7024 - DNA, 40 bp, Artificial Sequence
  PCR primer for ORF amplification
ggatccagctagcaaaatgtctgccgttttcaacaacgct

SEQ ID NO: 7025 - DNA, 40 bp, Artificial Sequence
  PCR primer for ORF amplification
ggatccagctagcaaaatgttctggaaaaaggatcccacc

SEQ ID NO: 7026 - DNA, 40 bp, Artificial Sequence
  PCR primer for ORF amplification
ggatccagctagcaaaatgttttcaaatctatctaaacgt

SEQ ID NO: 7027 - DNA, 40 bp, Artificial Sequence
  PCR primer for ORF amplification
ggatccagctagcaaaatgaatagatcacctggtgagttc

SEQ ID NO: 7028 - DNA, 40 bp, Artificial Sequence
  PCR primer for ORF amplification
ggatccagctagcaaaatgaatttattacgaatgaatgct

SEQ ID NO: 7029 - DNA, 40 bp, Artificial Sequence
  PCR primer for ORF amplification
ggatccagctagcaaaatgacaaccagcatactcgatact

SEQ ID NO: 7030 - DNA, 40 bp, Artificial Sequence
  PCR primer for ORF amplification
ggatccagctagcaaaatgacatctatagataatagacct

SEQ ID NO: 7031 - DNA, 40 bp, Artificial Sequence
  PCR primer for ORF amplification
ggatccagctagcaaaatgagtacaaatacggaaatcata

SEQ ID NO: 7032 - DNA, 40 bp, Artificial Sequence
  PCR primer for ORF amplification
ggatccagctagcaaaatgatctctgaaaaggctgctacc

SEQ ID NO: 7033 - DNA, 40 bp, Artificial Sequence
  PCR primer for ORF amplification
ggatccagctagcaaaatgattagatctacactaagtagt

SEQ ID NO: 7034 - DNA, 40 bp, Artificial Sequence
  PCR primer for ORF amplification
ggatccagctagcaaaatgccgtccaataatagcagtttt

SEQ ID NO: 7035 - DNA, 40 bp, Artificial Sequence
  PCR primer for ORF amplification
ggatccagctagcaaaatgcctatcaccataaaaagccgc

SEQ ID NO: 7036 - DNA, 40 bp, Artificial Sequence
  PCR primer for ORF amplification
ggatccagctagcaaaatgcgtttaatcagtaaagttttg

SEQ ID NO: 7037 - DNA, 40 bp, Artificial Sequence
  PCR primer for ORF amplification
ggatccagctagcaaaatggaattcttttatgaagaacaa

SEQ ID NO: 7038 - DNA, 40 bp, Artificial Sequence
  PCR primer for ORF amplification
ggatccagctagcaaaatgggtaagagcagcaaagataaa

SEQ ID NO: 7039 - DNA, 40 bp, Artificial Sequence
  PCR primer for ORF amplification
ggatccagctagcaaaatggtaagtgattggaaaaatttt

SEQ ID NO: 7040 - DNA, 40 bp, Artificial Sequence
  PCR primer for ORF amplification
ggatccagctagcaaaatgtcgtcaaataataggaagaaa

SEQ ID NO: 7041 - DNA, 40 bp, Artificial Sequence
  PCR primer for ORF amplification
ggatccagctagcaaaatgtcttacagaggacctattgga

SEQ ID NO: 7042 - DNA, 40 bp, Artificial Sequence
  PCR primer for ORF amplification
ggatccagctagcaaaatgactgcaagcacaccatccaat

SEQ ID NO: 7043 - DNA, 40 bp, Artificial Sequence
  PCR primer for ORF amplification
ggatccagctagcaaaatgagtgatatcttgaacgtaagt

SEQ ID NO: 7044 - DNA, 40 bp, Artificial Sequence
  PCR primer for ORF amplification
ggatccagctagcaaaatgctacgtataactgtcaaaact

SEQ ID NO: 7045 - DNA, 40 bp, Artificial Sequence
  PCR primer for ORF amplification
ggatccagctagcaaaatggaaaaagcttccttgaacatt

SEQ ID NO: 7046 - DNA, 40 bp, Artificial Sequence
  PCR primer for ORF amplification
ggatccagctagcaaaatggcggttcaacaaagaaagaag

SEQ ID NO: 7047 - DNA, 40 bp, Artificial Sequence
  PCR primer for ORF amplification
ggatccagctagcaaaatggtatctagaggccccgacgaa

SEQ ID NO: 7048 - DNA, 40 bp, Artificial Sequence
  PCR primer for ORF amplification
ggatccagctagcaaaatggtcgatcaccagtggacgcca

SEQ ID NO: 7049 - DNA, 40 bp, Artificial Sequence
  PCR primer for ORF amplification
ggatccagctagcaaaatgtctgtgtctgctgctcctgct

SEQ ID NO: 7050 - DNA, 40 bp, Artificial Sequence
  PCR primer for ORF amplification
ggatccagctagcaaaatgttgtcaagaattgtatcaaac

SEQ ID NO: 7051 - DNA, 40 bp, Artificial Sequence
  PCR primer for ORF amplification
ggatccagctagcaaaatgaatataatgaaaagacaatta

SEQ ID NO: 7052 - DNA, 40 bp, Artificial Sequence
  PCR primer for ORF amplification
ggatccagctagcaaaatgactgctcaacaaggtgtacca

SEQ ID NO: 7053 - DNA, 40 bp, Artificial Sequence
  PCR primer for ORF amplification
ggatccagctagcaaaatgagaatacaactaaatacaatt

SEQ ID NO: 7054 - DNA, 40 bp, Artificial Sequence
  PCR primer for ORF amplification
ggatccagctagcaaaatgcctcgtctcttggccacgcag

SEQ ID NO: 7055 - DNA, 40 bp, Artificial Sequence
  PCR primer for ORF amplification
ggatccagctagcaaaatgcctgctacgttaaagaattct

SEQ ID NO: 7056 - DNA, 40 bp, Artificial Sequence
  PCR primer for ORF amplification
ggatccagctagcaaaatgcctgctactttacatgattct

SEQ ID NO: 7057 - DNA, 40 bp, Artificial Sequence
  PCR primer for ORF amplification
ggatccagctagcaaaatggataattgtaatgcctgggac

SEQ ID NO: 7058 - DNA, 40 bp, Artificial Sequence
  PCR primer for ORF amplification
ggatccagctagcaaaatgggaggcattcgtgaaaagaaa

SEQ ID NO: 7059 - DNA, 40 bp, Artificial Sequence
  PCR primer for ORF amplification
ggatccagctagcaaaatgggccgtacaacttctgaggga

SEQ ID NO: 7060 - DNA, 40 bp, Artificial Sequence
  PCR primer for ORF amplification
ggatccagctagcaaaatggttcctgctgaatctaatgct

SEQ ID NO: 7061 - DNA, 40 bp, Artificial Sequence
  PCR primer for ORF amplification
ggatccagctagcaaaatggtttcattgactacaatagag

SEQ ID NO: 7062 - DNA, 40 bp, Artificial Sequence
  PCR primer for ORF amplification
ggatccagctagcaaaatgtcaaaagaagacatagaagga

SEQ ID NO: 7063 - DNA, 40 bp, Artificial Sequence
  PCR primer for ORF amplification
ggatccagctagcaaaatgtcatttcaccaacagttcttt

SEQ ID NO: 7064 - DNA, 40 bp, Artificial Sequence
  PCR primer for ORF amplification
ggatccagctagcaaaatgtcgatagtagagacatgcata

SEQ ID NO: 7065 - DNA, 40 bp, Artificial Sequence
  PCR primer for ORF amplification
ggatccagctagcaaaatgtgcattttaatggccacaagg

SEQ ID NO: 7066 - DNA, 40 bp, Artificial Sequence
  PCR primer for ORF amplification
ggatccagctagcaaaatgttaattggtgtaagtggtacg

SEQ ID NO: 7067 - DNA, 40 bp, Artificial Sequence
  PCR primer for ORF amplification
ggatccagctagcaaaatgttgttaagatctagatttttg

SEQ ID NO: 7068 - DNA, 40 bp, Artificial Sequence
  PCR primer for ORF amplification
ggatccagctagcaaaatgtttagtaaatacctcgtaact

SEQ ID NO: 7069 - DNA, 40 bp, Artificial Sequence
  PCR primer for ORF amplification
ggatccagctagcaaaatgaagtttttgggtgtaatactg

SEQ ID NO: 7070 - DNA, 40 bp, Artificial Sequence
  PCR primer for ORF amplification
ggatccagctagcaaaatgaataaacttgttgatgcccac

SEQ ID NO: 7071 - DNA, 40 bp, Artificial Sequence
  PCR primer for ORF amplification
ggatccagctagcaaaatgatgcgtcgcacgctattacat

SEQ ID NO: 7072 - DNA, 40 bp, Artificial Sequence
  PCR primer for ORF amplification
ggatccagctagcaaaatgccactggtgctttttacggga

SEQ ID NO: 7073 - DNA, 40 bp, Artificial Sequence
  PCR primer for ORF amplification
ggatccagctagcaaaatgcgtttctctactacactcgct

SEQ ID NO: 7074 - DNA, 40 bp, Artificial Sequence
  PCR primer for ORF amplification
ggatccagctagcaaaatgctgagtagcagtagcaataga

SEQ ID NO: 7075 - DNA, 40 bp, Artificial Sequence
  PCR primer for ORF amplification
ggatccagctagcaaaatggctccgtatccatacaaagtg

SEQ ID NO: 7076 - DNA, 40 bp, Artificial Sequence
  PCR primer for ORF amplification
ggatccagctagcaaaatgggaaaaggtaaaaataagatg

SEQ ID NO: 7077 - DNA, 40 bp, Artificial Sequence
  PCR primer for ORF amplification
ggatccagctagcaaaatgacagccagtttaactaccaag

SEQ ID NO: 7078 - DNA, 40 bp, Artificial Sequence
  PCR primer for ORF amplification
ggatccagctagcaaaatgactgaaggaaagaggctgcaa

SEQ ID NO: 7079 - DNA, 40 bp, Artificial Sequence
  PCR primer for ORF amplification
ggatccagctagcaaaatgatgcggttaatacgtacattg

SEQ ID NO: 7080 - DNA, 40 bp, Artificial Sequence
  PCR primer for ORF amplification
ggatccagctagcaaaatgccatctaccactaatactgct

SEQ ID NO: 7081 - DNA, 40 bp, Artificial Sequence
  PCR primer for ORF amplification
ggatccagctagcaaaatgcctcgaatatctacatcattg

SEQ ID NO: 7082 - DNA, 40 bp, Artificial Sequence
  PCR primer for ORF amplification
ggatccagctagcaaaatggaacaactgtgtaagaggtac

SEQ ID NO: 7083 - DNA, 40 bp, Artificial Sequence
  PCR primer for ORF amplification
ggatccagctagcaaaatggtagaaaactcgtcgagtaat

SEQ ID NO: 7084 - DNA, 40 bp, Artificial Sequence
  PCR primer for ORF amplification
ggatccagctagcaaaatgtcttataatccgtacgcatat

SEQ ID NO: 7085 - DNA, 40 bp, Artificial Sequence
  PCR primer for ORF amplification
ggatccagctagcaaaatgttcaaagaggaggactcgtta

SEQ ID NO: 7086 - DNA, 40 bp, Artificial Sequence
  PCR primer for ORF amplification
ggatccagctagcaaaatgagtgcccaaaaagtatgttcc

SEQ ID NO: 7087 - DNA, 40 bp, Artificial Sequence
  PCR primer for ORF amplification
ggatccagctagcaaaatgaaatcctcagagccagcgcca

SEQ ID NO: 7088 - DNA, 40 bp, Artificial Sequence
  PCR primer for ORF amplification
ggatccagctagcaaaatgactacgacggtacccaagata

SEQ ID NO: 7089 - DNA, 40 bp, Artificial Sequence
  PCR primer for ORF amplification
ggatccagctagcaaaatgagtatgtaatagaatgtattg

SEQ ID NO: 7090 - DNA, 40 bp, Artificial Sequence
  PCR primer for ORF amplification
ggatccagctagcaaaatgctacaattctcaacatttcta

SEQ ID NO: 7091 - DNA, 40 bp, Artificial Sequence
  PCR primer for ORF amplification
ggatccagctagcaaaatggatgttttattgtcgcttcct

SEQ ID NO: 7092 - DNA, 40 bp, Artificial Sequence
  PCR primer for ORF amplification
ggatccagctagcaaaatgggaaggacatttattcatgct

SEQ ID NO: 7093 - DNA, 40 bp, Artificial Sequence
  PCR primer for ORF amplification
ggatccagctagcaaaatgttccagtttgttactcctgtg

SEQ ID NO: 7094 - DNA, 40 bp, Artificial Sequence
  PCR primer for ORF amplification
ggatccagctagcaaaatgagtatcaccactactagaaga

SEQ ID NO: 7095 - DNA, 40 bp, Artificial Sequence
  PCR primer for ORF amplification
ggatccagctagcaaaatgagtgaaaaagtaaatagtgac

SEQ ID NO: 7096 - DNA, 40 bp, Artificial Sequence
  PCR primer for ORF amplification
ggatccagctagcaaaatgctgaaagaggagtataatttg

SEQ ID NO: 7097 - DNA, 40 bp, Artificial Sequence
  PCR primer for ORF amplification
ggatccagctagcaaaatggaggagtacgattattcagac

SEQ ID NO: 7098 - DNA, 40 bp, Artificial Sequence
  PCR primer for ORF amplification
ggatccagctagcaaaatggcagctaattctgtagggaaa

SEQ ID NO: 7099 - DNA, 40 bp, Artificial Sequence
  PCR primer for ORF amplification
ggatccagctagcaaaatggcatttagtgattttgctgcc

SEQ ID NO: 7100 - DNA, 40 bp, Artificial Sequence
  PCR primer for ORF amplification
ggatccagctagcaaaatggcttttttgaatattttcaag

SEQ ID NO: 7101 - DNA, 40 bp, Artificial Sequence
  PCR primer for ORF amplification
ggatccagctagcaaaatgggaatatttcgttggaactat

SEQ ID NO: 7102 - DNA, 40 bp, Artificial Sequence
  PCR primer for ORF amplification
ggatccagctagcaaaatggtgtctacacataacagagat

SEQ ID NO: 7103 - DNA, 40 bp, Artificial Sequence
  PCR primer for ORF amplification
ggatccagctagcaaaatggttaagaaaaactttatcccg

SEQ ID NO: 7104 - DNA, 40 bp, Artificial Sequence
  PCR primer for ORF amplification
ggatccagctagcaaaatgtcatctacggacatctggata

SEQ ID NO: 7105 - DNA, 40 bp, Artificial Sequence
  PCR primer for ORF amplification
ggatccagctagcaaaatgttaaagaggttagccaatcgt

SEQ ID NO: 7106 - DNA, 40 bp, Artificial Sequence
  PCR primer for ORF amplification
ggatccagctagcaaaatgaaaaccattattatttcagat

SEQ ID NO: 7107 - DNA, 40 bp, Artificial Sequence
  PCR primer for ORF amplification
ggatccagctagcaaaatgaaacgagttactggagttttc

SEQ ID NO: 7108 - DNA, 40 bp, Artificial Sequence
  PCR primer for ORF amplification
ggatccagctagcaaaatgaatttttccctttcaaagcaa

SEQ ID NO: 7109 - DNA, 40 bp, Artificial Sequence
  PCR primer for ORF amplification
ggatccagctagcaaaatgaccagtacattacatacgaca

SEQ ID NO: 7110 - DNA, 40 bp, Artificial Sequence
  PCR primer for ORF amplification
ggatccagctagcaaaatgagcagcacgaggaagttcaaa

SEQ ID NO: 7111 - DNA, 40 bp, Artificial Sequence
  PCR primer for ORF amplification
ggatccagctagcaaaatgagtggaatgatagaaaatggg

SEQ ID NO: 7112 - DNA, 40 bp, Artificial Sequence
  PCR primer for ORF amplification
ggatccagctagcaaaatgctgttcagctggccttatcca

SEQ ID NO: 7113 - DNA, 40 bp, Artificial Sequence
  PCR primer for ORF amplification
ggatccagctagcaaaatggaggacagtagcaatacaatc

SEQ ID NO: 7114 - DNA, 40 bp, Artificial Sequence
  PCR primer for ORF amplification
ggatccagctagcaaaatggatcaagattttgacagttta

SEQ ID NO: 7115 - DNA, 40 bp, Artificial Sequence
  PCR primer for ORF amplification
ggatccagctagcaaaatggcaaaagacggcttcgagtta

SEQ ID NO: 7116 - DNA, 40 bp, Artificial Sequence
  PCR primer for ORF amplification
ggatccagctagcaaaatgtatgtttaacagtgatactaa

SEQ ID NO: 7117 - DNA, 40 bp, Artificial Sequence
  PCR primer for ORF amplification
ggatccagctagcaaaatgtcaactttattagaaaggact

SEQ ID NO: 7118 - DNA, 40 bp, Artificial Sequence
  PCR primer for ORF amplification
ggatccagctagcaaaatgtcgtgctcaaacggcatctgg

SEQ ID NO: 7119 - DNA, 40 bp, Artificial Sequence
  PCR primer for ORF amplification
ggatccagctagcaaaatgacagtaatcaccattgccaag

SEQ ID NO: 7120 - DNA, 40 bp, Artificial Sequence
  PCR primer for ORF amplification
ggatccagctagcaaaatgagtgaagaaggtcctcaagtt

SEQ ID NO: 7121 - DNA, 40 bp, Artificial Sequence
  PCR primer for ORF amplification
ggatccagctagcaaaatgggaaaggctgcgaaaaagaag

SEQ ID NO: 7122 - DNA, 40 bp, Artificial Sequence
  PCR primer for ORF amplification
ggatccagctagcaaaatggggaaaggtgcggccaagtat

SEQ ID NO: 7123 - DNA, 40 bp, Artificial Sequence
  PCR primer for ORF amplification
ggatccagctagcaaaatgtctacaaacagtattaagttg

SEQ ID NO: 7124 - DNA, 40 bp, Artificial Sequence
  PCR primer for ORF amplification
ggatccagctagcaaaatgtcttccaacgcccaagtcaaa

SEQ ID NO: 7125 - DNA, 40 bp, Artificial Sequence
  PCR primer for ORF amplification
ggatccagctagcaaaatgtggagactaaccagaaaaatc

SEQ ID NO: 7126 - DNA, 40 bp, Artificial Sequence
  PCR primer for ORF amplification
ggatccagctagcaaaatgtggttgaaatccttgctgctc

SEQ ID NO: 7127 - DNA, 40 bp, Artificial Sequence
  PCR primer for ORF amplification
ggatccagctagcaaaatgttatttcttaatattattaag

SEQ ID NO: 7128 - DNA, 40 bp, Artificial Sequence
  PCR primer for ORF amplification
ggatccagctagcaaaatgaaagtaccattggggttatgg

SEQ ID NO: 7129 - DNA, 40 bp, Artificial Sequence
  PCR primer for ORF amplification
ggatccagctagcaaaatgacgataaaaagaaatttggtg

SEQ ID NO: 7130 - DNA, 40 bp, Artificial Sequence
  PCR primer for ORF amplification
ggatccagctagcaaaatgactattctagaggagcttaat

SEQ ID NO: 7131 - DNA, 40 bp, Artificial Sequence
  PCR primer for ORF amplification
ggatccagctagcaaaatgagcgaggagtgtattgaaaat

SEQ ID NO: 7132 - DNA, 40 bp, Artificial Sequence
  PCR primer for ORF amplification
ggatccagctagcaaaatgatggggtttgaatggggtttt

SEQ ID NO: 7133 - DNA, 40 bp, Artificial Sequence
  PCR primer for ORF amplification
ggatccagctagcaaaatgctaaaatccgtacagggactg

SEQ ID NO: 7134 - DNA, 40 bp, Artificial Sequence
  PCR primer for ORF amplification
ggatccagctagcaaaatggttcacaacaaagttactatc

SEQ ID NO: 7135 - DNA, 40 bp, Artificial Sequence
  PCR primer for ORF amplification
ggatccagctagcaaaatgtggaagagatcgttccactcc

SEQ ID NO: 7136 - DNA, 40 bp, Artificial Sequence
  PCR primer for ORF amplification
ggatccagctagcaaaatgccttccagattcactaagact

SEQ ID NO: 7137 - DNA, 40 bp, Artificial Sequence
  PCR primer for ORF amplification
ggatccagctagcaaaatgaagtttacgttagaagaccaa

SEQ ID NO: 7138 - DNA, 40 bp, Artificial Sequence
  PCR primer for ORF amplification
ggatccagctagcaaaatgatacgttcaatatttataccg

SEQ ID NO: 7139 - DNA, 40 bp, Artificial Sequence
  PCR primer for ORF amplification
ggatccagctagcaaaatgattttagtgtacaatcgtatc

SEQ ID NO: 7140 - DNA, 40 bp, Artificial Sequence
  PCR primer for ORF amplification
ggatccagctagcaaaatgccaacaaattccatcaaatta

SEQ ID NO: 7141 - DNA, 40 bp, Artificial Sequence
  PCR primer for ORF amplification
ggatccagctagcaaaatggacagtgaagcaagtgacatt

SEQ ID NO: 7142 - DNA, 40 bp, Artificial Sequence
  PCR primer for ORF amplification
ggatccagctagcaaaatgggtgatataagaacttttgtt

SEQ ID NO: 7143 - DNA, 40 bp, Artificial Sequence
  PCR primer for ORF amplification
ggatccagctagcaaaatgtcgaagcctggtcgtactatt

SEQ ID NO: 7144 - DNA, 40 bp, Artificial Sequence
  PCR primer for ORF amplification
ggatccagctagcaaaatgtctacctttgaaactttaatt

SEQ ID NO: 7145 - DNA, 40 bp, Artificial Sequence
  PCR primer for ORF amplification
ggatccagctagcaaaatgtctgaccaacccgagactcct

SEQ ID NO: 7146 - DNA, 40 bp, Artificial Sequence
  PCR primer for ORF amplification
ggatccagctagcaaaatgttgggaaaagaagaagaacag

SEQ ID NO: 7147 - DNA, 40 bp, Artificial Sequence
  PCR primer for ORF amplification
ggatccagctagcaaaatgggtatgtctactataaaataa

SEQ ID NO: 7148 - DNA, 40 bp, Artificial Sequence
  PCR primer for ORF amplification
ggatccagctagcaaaatgacaacaaccgtacctaaagtg

SEQ ID NO: 7149 - DNA, 40 bp, Artificial Sequence
  PCR primer for ORF amplification
ggatccagctagcaaaatgactatcgctaaagattacaga

SEQ ID NO: 7150 - DNA, 40 bp, Artificial Sequence
  PCR primer for ORF amplification
ggatccagctagcaaaatgactcgtcccccattggttcgt

SEQ ID NO: 7151 - DNA, 40 bp, Artificial Sequence
  PCR primer for ORF amplification
ggatccagctagcaaaatgagtatccccgctgacattgca

SEQ ID NO: 7152 - DNA, 40 bp, Artificial Sequence
  PCR primer for ORF amplification
ggatccagctagcaaaatgatttgcataacgtgcatgcgg

SEQ ID NO: 7153 - DNA, 40 bp, Artificial Sequence
  PCR primer for ORF amplification
ggatccagctagcaaaatgccagagcaagaactacttata

SEQ ID NO: 7154 - DNA, 40 bp, Artificial Sequence
  PCR primer for ORF amplification
ggatccagctagcaaaatgcttatggatgagtatgaggaa

SEQ ID NO: 7155 - DNA, 40 bp, Artificial Sequence
  PCR primer for ORF amplification
ggatccagctagcaaaatgcttcgctttactggtgctcgc

SEQ ID NO: 7156 - DNA, 40 bp, Artificial Sequence
  PCR primer for ORF amplification
ggatccagctagcaaaatggacagaggaaggtgcgccaat

SEQ ID NO: 7157 - DNA, 40 bp, Artificial Sequence
  PCR primer for ORF amplification
ggatccagctagcaaaatggttgaaattgtgggccacaga

SEQ ID NO: 7158 - DNA, 40 bp, Artificial Sequence
  PCR primer for ORF amplification
ggatccagctagcaaaatggttgacgctaggggtagtacg

SEQ ID NO: 7159 - DNA, 40 bp, Artificial Sequence
  PCR primer for ORF amplification
ggatccagctagcaaaatgttgttgttagcattaagtgat

SEQ ID NO: 7160 - DNA, 40 bp, Artificial Sequence
  PCR primer for ORF amplification
ggatccagctagcaaaatgaaaccgacacaggattcacaa

SEQ ID NO: 7161 - DNA, 40 bp, Artificial Sequence
  PCR primer for ORF amplification
ggatccagctagcaaaatgaaagcggaaaggcaaacagga

SEQ ID NO: 7162 - DNA, 40 bp, Artificial Sequence
  PCR primer for ORF amplification
ggatccagctagcaaaatgcctttgaacaagtcgaacata

SEQ ID NO: 7163 - DNA, 40 bp, Artificial Sequence
  PCR primer for ORF amplification
ggatccagctagcaaaatggaaatgactgattttgaacta

SEQ ID NO: 7164 - DNA, 40 bp, Artificial Sequence
  PCR primer for ORF amplification
ggatccagctagcaaaatggatcctctcagctcagtacag

SEQ ID NO: 7165 - DNA, 40 bp, Artificial Sequence
  PCR primer for ORF amplification
ggatccagctagcaaaatggcgatcaagaaaagaaataaa

SEQ ID NO: 7166 - DNA, 40 bp, Artificial Sequence
  PCR primer for ORF amplification
ggatccagctagcaaaatgtccattgtagcactaaagaac

SEQ ID NO: 7167 - DNA, 40 bp, Artificial Sequence
  PCR primer for ORF amplification
ggatccagctagcaaaatgtctatggagcctcctgtgggg

SEQ ID NO: 7168 - DNA, 40 bp, Artificial Sequence
  PCR primer for ORF amplification
ggatccagctagcaaaatgtctcaaaaaaagaaggcttcc

SEQ ID NO: 7169 - DNA, 40 bp, Artificial Sequence
  PCR primer for ORF amplification
ggatccagctagcaaaatgtcttcaactcaagacagtaaa

SEQ ID NO: 7170 - DNA, 40 bp, Artificial Sequence
  PCR primer for ORF amplification
ggatccagctagcaaaatgttttgtacctgggatagctgg

SEQ ID NO: 7171 - DNA, 40 bp, Artificial Sequence
  PCR primer for ORF amplification
ggatccagctagcaaaatgaataaagaagagcaagaagac

SEQ ID NO: 7172 - DNA, 40 bp, Artificial Sequence
  PCR primer for ORF amplification
ggatccagctagcaaaatgacggtaaacttagatccggat

SEQ ID NO: 7173 - DNA, 40 bp, Artificial Sequence
  PCR primer for ORF amplification
ggatccagctagcaaaatgcctagcacgtttgaatcccag

SEQ ID NO: 7174 - DNA, 40 bp, Artificial Sequence
  PCR primer for ORF amplification
ggatccagctagcaaaatggctaagttcttgaaagctggt

SEQ ID NO: 7175 - DNA, 40 bp, Artificial Sequence
  PCR primer for ORF amplification
ggatccagctagcaaaatgtccaaaactttatctttgcaa

SEQ ID NO: 7176 - DNA, 40 bp, Artificial Sequence
  PCR primer for ORF amplification
ggatccagctagcaaaatgtcggggagcttctggacatct

SEQ ID NO: 7177 - DNA, 40 bp, Artificial Sequence
  PCR primer for ORF amplification
ggatccagctagcaaaatgtctgctccacaagccaagatt

SEQ ID NO: 7178 - DNA, 40 bp, Artificial Sequence
  PCR primer for ORF amplification
ggatccagctagcaaaatgaagcgcattccaatcaaagaa

SEQ ID NO: 7179 - DNA, 40 bp, Artificial Sequence
  PCR primer for ORF amplification
ggatccagctagcaaaatgcgtataggtatggaagagctt

SEQ ID NO: 7180 - DNA, 40 bp, Artificial Sequence
  PCR primer for ORF amplification
ggatccagctagcaaaatggatagagacactaaattagct

SEQ ID NO: 7181 - DNA, 40 bp, Artificial Sequence
  PCR primer for ORF amplification
ggatccagctagcaaaatgtcatctgacaactctaaacaa

SEQ ID NO: 7182 - DNA, 40 bp, Artificial Sequence
  PCR primer for ORF amplification
ggatccagctagcaaaatgtcagctgtcccaagtgttcaa

SEQ ID NO: 7183 - DNA, 40 bp, Artificial Sequence
  PCR primer for ORF amplification
ggatccagctagcaaaatgaaatttaatttttctacaatt

SEQ ID NO: 7184 - DNA, 40 bp, Artificial Sequence
  PCR primer for ORF amplification
ggatccagctagcaaaatgagttttacaggttcattagcg

SEQ ID NO: 7185 - DNA, 40 bp, Artificial Sequence
  PCR primer for ORF amplification
ggatccagctagcaaaatgatgccgaatgttgctccaaac

SEQ ID NO: 7186 - DNA, 40 bp, Artificial Sequence
  PCR primer for ORF amplification
ggatccagctagcaaaatgattgaagagaatttgaaacag

SEQ ID NO: 7187 - DNA, 40 bp, Artificial Sequence
  PCR primer for ORF amplification
ggatccagctagcaaaatgcaatataaaaagccattagtc

SEQ ID NO: 7188 - DNA, 40 bp, Artificial Sequence
  PCR primer for ORF amplification
ggatccagctagcaaaatgctgccatcattaaggaaggga

SEQ ID NO: 7189 - DNA, 40 bp, Artificial Sequence
  PCR primer for ORF amplification
ggatccagctagcaaaatggcacgtcttcctctaaagcag

SEQ ID NO: 7190 - DNA, 40 bp, Artificial Sequence
  PCR primer for ORF amplification
ggatccagctagcaaaatgtcaggatctcttacgctactt

SEQ ID NO: 7191 - DNA, 40 bp, Artificial Sequence
  PCR primer for ORF amplification
ggatccagctagcaaaatgtccttcttcaacttcaagtat

SEQ ID NO: 7192 - DNA, 40 bp, Artificial Sequence
  PCR primer for ORF amplification
ggatccagctagcaaaatgtctactaactttgaaaaacat

SEQ ID NO: 7193 - DNA, 40 bp, Artificial Sequence
  PCR primer for ORF amplification
ggatccagctagcaaaatgaaaaatgataataaagctaat

SEQ ID NO: 7194 - DNA, 40 bp, Artificial Sequence
  PCR primer for ORF amplification
ggatccagctagcaaaatgaaattcacatcagtgctagca

SEQ ID NO: 7195 - DNA, 40 bp, Artificial Sequence
  PCR primer for ORF amplification
ggatccagctagcaaaatgaattcagagtctcgagaagat

SEQ ID NO: 7196 - DNA, 40 bp, Artificial Sequence
  PCR primer for ORF amplification
ggatccagctagcaaaatgattgttcccacttatggagac

SEQ ID NO: 7197 - DNA, 40 bp, Artificial Sequence
  PCR primer for ORF amplification
ggatccagctagcaaaatggaagataagcggaaaagacga

SEQ ID NO: 7198 - DNA, 40 bp, Artificial Sequence
  PCR primer for ORF amplification
ggatccagctagcaaaatggcagaagtactgaccgtcctc

SEQ ID NO: 7199 - DNA, 40 bp, Artificial Sequence
  PCR primer for ORF amplification
ggatccagctagcaaaatgtcacaagtaaaaagagccaat

SEQ ID NO: 7200 - DNA, 40 bp, Artificial Sequence
  PCR primer for ORF amplification
ggatccagctagcaaaatgtccactgatagtacacgctat

SEQ ID NO: 7201 - DNA, 40 bp, Artificial Sequence
  PCR primer for ORF amplification
ggatccagctagcaaaatgtcgtttaatgccttcgccagc

SEQ ID NO: 7202 - DNA, 40 bp, Artificial Sequence
  PCR primer for ORF amplification
ggatccagctagcaaaatgtctgctacctctactgctact

SEQ ID NO: 7203 - DNA, 40 bp, Artificial Sequence
  PCR primer for ORF amplification
ggatccagctagcaaaatgtccactgaattaactgttcaa

SEQ ID NO: 7204 - DNA, 40 bp, Artificial Sequence
  PCR primer for ORF amplification
ggatccagctagcaaaatgagctccagtgaagacgaagac

SEQ ID NO: 7205 - DNA, 40 bp, Artificial Sequence
  PCR primer for ORF amplification
ggatccagctagcaaaatgagtgagaccaatggtggcaat

SEQ ID NO: 7206 - DNA, 40 bp, Artificial Sequence
  PCR primer for ORF amplification
ggatccagctagcaaaatgcatagaacggcaatatttcta

SEQ ID NO: 7207 - DNA, 40 bp, Artificial Sequence
  PCR primer for ORF amplification
ggatccagctagcaaaatggcatcatcagtcccagggccc

SEQ ID NO: 7208 - DNA, 40 bp, Artificial Sequence
  PCR primer for ORF amplification
ggatccagctagcaaaatggctattcaaaaggttagtaac

SEQ ID NO: 7209 - DNA, 40 bp, Artificial Sequence
  PCR primer for ORF amplification
ggatccagctagcaaaatgggccctgaaactctacatatt

SEQ ID NO: 7210 - DNA, 40 bp, Artificial Sequence
  PCR primer for ORF amplification
ggatccagctagcaaaatggttaaaggtagtgtgcattta

SEQ ID NO: 7211 - DNA, 40 bp, Artificial Sequence
  PCR primer for ORF amplification
ggatccagctagcaaaatgtcaattgcacaagataggggt

SEQ ID NO: 7212 - DNA, 40 bp, Artificial Sequence
  PCR primer for ORF amplification
ggatccagctagcaaaatgtcattcagaccaggtagcaga

SEQ ID NO: 7213 - DNA, 40 bp, Artificial Sequence
  PCR primer for ORF amplification
ggatccagctagcaaaatgtcttcactggttactcttaat

SEQ ID NO: 7214 - DNA, 40 bp, Artificial Sequence
  PCR primer for ORF amplification
ggatccagctagcaaaatgtcttcagacacttcattatca

SEQ ID NO: 7215 - DNA, 40 bp, Artificial Sequence
  PCR primer for ORF amplification
ggatccagctagcaaaatggcaggtgtttccgttaggtac

SEQ ID NO: 7216 - DNA, 40 bp, Artificial Sequence
  PCR primer for ORF amplification
ggatccagctagcaaaatgtcagcgtatgtatataccttg

SEQ ID NO: 7217 - DNA, 40 bp, Artificial Sequence
  PCR primer for ORF amplification
ggatccagctagcaaaatgactgagatactaccacatgta

SEQ ID NO: 7218 - DNA, 40 bp, Artificial Sequence
  PCR primer for ORF amplification
ggatccagctagcaaaatgagccaacagaatatactacat

SEQ ID NO: 7219 - DNA, 40 bp, Artificial Sequence
  PCR primer for ORF amplification
ggatccagctagcaaaatgagtaaaaacagggaccctcta

SEQ ID NO: 7220 - DNA, 40 bp, Artificial Sequence
  PCR primer for ORF amplification
ggatccagctagcaaaatgatagcaggtgcgactgctccg

SEQ ID NO: 7221 - DNA, 40 bp, Artificial Sequence
  PCR primer for ORF amplification
ggatccagctagcaaaatgcctgcccctcaagatccaagg

SEQ ID NO: 7222 - DNA, 40 bp, Artificial Sequence
  PCR primer for ORF amplification
ggatccagctagcaaaatgcctgttgttcattgttcgtcc

SEQ ID NO: 7223 - DNA, 40 bp, Artificial Sequence
  PCR primer for ORF amplification
ggatccagctagcaaaatggaaaaaaaacatgtcactgtg

SEQ ID NO: 7224 - DNA, 40 bp, Artificial Sequence
  PCR primer for ORF amplification
ggatccagctagcaaaatggagagaatcatacagcagact

SEQ ID NO: 7225 - DNA, 40 bp, Artificial Sequence
  PCR primer for ORF amplification
ggatccagctagcaaaatggcatccaccgatttctccaag

SEQ ID NO: 7226 - DNA, 40 bp, Artificial Sequence
  PCR primer for ORF amplification
ggatccagctagcaaaatgtcgagactagcgcataataaa

SEQ ID NO: 7227 - DNA, 40 bp, Artificial Sequence
  PCR primer for ORF amplification
ggatccagctagcaaaatgtcgaggtgtattcgccagtcc

SEQ ID NO: 7228 - DNA, 40 bp, Artificial Sequence
  PCR primer for ORF amplification
ggatccagctagcaaaatgttaactctagagtctgcatta

SEQ ID NO: 7229 - DNA, 40 bp, Artificial Sequence
  PCR primer for ORF amplification
ggatccagctagcaaaatgaaattttctaaagtctcacta

SEQ ID NO: 7230 - DNA, 40 bp, Artificial Sequence
  PCR primer for ORF amplification
ggatccagctagcaaaatgaccaccgtgtccatcaataag

SEQ ID NO: 7231 - DNA, 40 bp, Artificial Sequence
  PCR primer for ORF amplification
ggatccagctagcaaaatgagtgaagaatttcctacgccg

SEQ ID NO: 7232 - DNA, 40 bp, Artificial Sequence
  PCR primer for ORF amplification
ggatccagctagcaaaatgggctctatgaataaggaacag

SEQ ID NO: 7233 - DNA, 40 bp, Artificial Sequence
  PCR primer for ORF amplification
ggatccagctagcaaaatggtaagttcattcagtgttccc

SEQ ID NO: 7234 - DNA, 40 bp, Artificial Sequence
  PCR primer for ORF amplification
ggatccagctagcaaaatgtgcagtaggatactcttgtcc

SEQ ID NO: 7235 - DNA, 40 bp, Artificial Sequence
  PCR primer for ORF amplification
ggatccagctagcaaaatgttaagatctaccgtttcaaaa

SEQ ID NO: 7236 - DNA, 40 bp, Artificial Sequence
  PCR primer for ORF amplification
ggatccagctagcaaaatgacgccttctaatatggatgat

SEQ ID NO: 7237 - DNA, 40 bp, Artificial Sequence
  PCR primer for ORF amplification
ggatccagctagcaaaatgagttcaccagcgaacctattc

SEQ ID NO: 7238 - DNA, 40 bp, Artificial Sequence
  PCR primer for ORF amplification
ggatccagctagcaaaatggcgtctatcaatctgattaag

SEQ ID NO: 7239 - DNA, 40 bp, Artificial Sequence
  PCR primer for ORF amplification
ggatccagctagcaaaatggctagtaacgctgcaagggtt

SEQ ID NO: 7240 - DNA, 40 bp, Artificial Sequence
  PCR primer for ORF amplification
ggatccagctagcaaaatgggtattgatcacacttccaag

SEQ ID NO: 7241 - DNA, 40 bp, Artificial Sequence
  PCR primer for ORF amplification
ggatccagctagcaaaatgttagacccacgaatattgcca

SEQ ID NO: 7242 - DNA, 40 bp, Artificial Sequence
  PCR primer for ORF amplification
ggatccagctagcaaaatgggtcgtatgcacagtgccgta

SEQ ID NO: 7243 - DNA, 40 bp, Artificial Sequence
  PCR primer for ORF amplification
ggatccagctagcaaaatgtcagaccctgtagagttattg

SEQ ID NO: 7244 - DNA, 40 bp, Artificial Sequence
  PCR primer for ORF amplification
ggatccagctagcaaaatgaggtctattaaatgtgtgata

SEQ ID NO: 7245 - DNA, 40 bp, Artificial Sequence
  PCR primer for ORF amplification
ggatccagctagcaaaatgctgatgccaaagtcagttgca

SEQ ID NO: 7246 - DNA, 40 bp, Artificial Sequence
  PCR primer for ORF amplification
ggatccagctagcaaaatggttagagttgctattaacggt

SEQ ID NO: 7247 - DNA, 40 bp, Artificial Sequence
  PCR primer for ORF amplification
ggatccagctagcaaaatgaacgatacgctatcaagcttt

SEQ ID NO: 7248 - DNA, 40 bp, Artificial Sequence
  PCR primer for ORF amplification
ggatccagctagcaaaatgaagtggtgtagcacatacatt

SEQ ID NO: 7249 - DNA, 40 bp, Artificial Sequence
  PCR primer for ORF amplification
ggatccagctagcaaaatgagcggatacacgggaaataat

SEQ ID NO: 7250 - DNA, 40 bp, Artificial Sequence
  PCR primer for ORF amplification
ggatccagctagcaaaatgagtgagtaaatacctactaaa

SEQ ID NO: 7251 - DNA, 40 bp, Artificial Sequence
  PCR primer for ORF amplification
ggatccagctagcaaaatgatcagaattgctattaacggt

SEQ ID NO: 7252 - DNA, 40 bp, Artificial Sequence
  PCR primer for ORF amplification
ggatccagctagcaaaatgggtgtcatcaagaagaaaaga

SEQ ID NO: 7253 - DNA, 40 bp, Artificial Sequence
  PCR primer for ORF amplification
ggatccagctagcaaaatgtctactcaatccggtatagtc

SEQ ID NO: 7254 - DNA, 40 bp, Artificial Sequence
  PCR primer for ORF amplification
ggatccagctagcaaaatgccaagtacgtattagactata

SEQ ID NO: 7255 - DNA, 40 bp, Artificial Sequence
  PCR primer for ORF amplification
ggatccagctagcaaaatgaaagtgaatatggagtacaca

SEQ ID NO: 7256 - DNA, 40 bp, Artificial Sequence
  PCR primer for ORF amplification
ggatccagctagcaaaatgagttgtgtgtatgcgtttggg

SEQ ID NO: 7257 - DNA, 40 bp, Artificial Sequence
  PCR primer for ORF amplification
ggatccagctagcaaaatgagttttctttccaaactttcc

SEQ ID NO: 7258 - DNA, 40 bp, Artificial Sequence
  PCR primer for ORF amplification
ggatccagctagcaaaatggaaacaggacctcattacaac

SEQ ID NO: 7259 - DNA, 40 bp, Artificial Sequence
  PCR primer for ORF amplification
ggatccagctagcaaaatggctaaccaggtaagtagtaaa

SEQ ID NO: 7260 - DNA, 40 bp, Artificial Sequence
  PCR primer for ORF amplification
ggatccagctagcaaaatggctccgtcaatgattccgttc

SEQ ID NO: 7261 - DNA, 40 bp, Artificial Sequence
  PCR primer for ORF amplification
ggatccagctagcaaaatgggtatgttgaactgaagcaat

SEQ ID NO: 7262 - DNA, 40 bp, Artificial Sequence
  PCR primer for ORF amplification
ggatccagctagcaaaatgggtattacagtaataggttct

SEQ ID NO: 7263 - DNA, 40 bp, Artificial Sequence
  PCR primer for ORF amplification
ggatccagctagcaaaatgtcagaaccttcagagaaaaaa

SEQ ID NO: 7264 - DNA, 40 bp, Artificial Sequence
  PCR primer for ORF amplification
ggatccagctagcaaaatgaaatgtactataccagaacag

SEQ ID NO: 7265 - DNA, 40 bp, Artificial Sequence
  PCR primer for ORF amplification
ggatccagctagcaaaatgacaaaatcaagaaagcagaag

SEQ ID NO: 7266 - DNA, 40 bp, Artificial Sequence
  PCR primer for ORF amplification
ggatccagctagcaaaatgagagcgttgagattcctgatt

SEQ ID NO: 7267 - DNA, 40 bp, Artificial Sequence
  PCR primer for ORF amplification
ggatccagctagcaaaatggaaaaggacgcattggaggtt

SEQ ID NO: 7268 - DNA, 40 bp, Artificial Sequence
  PCR primer for ORF amplification
ggatccagctagcaaaatggccagcaagactttgagggtt

SEQ ID NO: 7269 - DNA, 40 bp, Artificial Sequence
  PCR primer for ORF amplification
ggatccagctagcaaaatgtgtgaagagaatgttcatgtt

SEQ ID NO: 7270 - DNA, 40 bp, Artificial Sequence
  PCR primer for ORF amplification
ggatccagctagcaaaatgttgtcaagagtagctaaacgt

SEQ ID NO: 7271 - DNA, 40 bp, Artificial Sequence
  PCR primer for ORF amplification
ggatccagctagcaaaatgaataatggagacaataaaacg

SEQ ID NO: 7272 - DNA, 40 bp, Artificial Sequence
  PCR primer for ORF amplification
ggatccagctagcaaaatgatgtcagtcaatagatttact

SEQ ID NO: 7273 - DNA, 40 bp, Artificial Sequence
  PCR primer for ORF amplification
ggatccagctagcaaaatgcactcacaccattcacactcc

SEQ ID NO: 7274 - DNA, 40 bp, Artificial Sequence
  PCR primer for ORF amplification
ggatccagctagcaaaatggaggccaagatagatgagctg

SEQ ID NO: 7275 - DNA, 40 bp, Artificial Sequence
  PCR primer for ORF amplification
ggatccagctagcaaaatggcagctgcaccatggtatatt

SEQ ID NO: 7276 - DNA, 40 bp, Artificial Sequence
  PCR primer for ORF amplification
ggatccagctagcaaaatggcattccaagatccaacttac

SEQ ID NO: 7277 - DNA, 40 bp, Artificial Sequence
  PCR primer for ORF amplification
ggatccagctagcaaaatgggtatcgatcacacttccaag

SEQ ID NO: 7278 - DNA, 40 bp, Artificial Sequence
  PCR primer for ORF amplification
ggatccagctagcaaaatggttaatgaaaaagtgaatcca

SEQ ID NO: 7279 - DNA, 40 bp, Artificial Sequence
  PCR primer for ORF amplification
ggatccagctagcaaaatgtcaaatattgtgggtattgaa

SEQ ID NO: 7280 - DNA, 40 bp, Artificial Sequence
  PCR primer for ORF amplification
ggatccagctagcaaaatgtctgaaccagctcaaaagaaa

SEQ ID NO: 7281 - DNA, 40 bp, Artificial Sequence
  PCR primer for ORF amplification
ggatccagctagcaaaatgtgtgcaaagaagctcaaatac

SEQ ID NO: 7282 - DNA, 40 bp, Artificial Sequence
  PCR primer for ORF amplification
ggatccagctagcaaaatgttgaggttatctttactgaga

SEQ ID NO: 7283 - DNA, 40 bp, Artificial Sequence
  PCR primer for ORF amplification
ggatccagctagcaaaatgaatgacaggctttcgttgaca

SEQ ID NO: 7284 - DNA, 40 bp, Artificial Sequence
  PCR primer for ORF amplification
ggatccagctagcaaaatggaggtacatgaagagcaggtc

SEQ ID NO: 7285 - DNA, 40 bp, Artificial Sequence
  PCR primer for ORF amplification
ggatccagctagcaaaatggccaggaaattgaagggtaag

SEQ ID NO: 7286 - DNA, 40 bp, Artificial Sequence
  PCR primer for ORF amplification
ggatccagctagcaaaatgggttcaataagtagatacctt

SEQ ID NO: 7287 - DNA, 40 bp, Artificial Sequence
  PCR primer for ORF amplification
ggatccagctagcaaaatgtcatggaatctactatttgtg

SEQ ID NO: 7288 - DNA, 40 bp, Artificial Sequence
  PCR primer for ORF amplification
ggatccagctagcaaaatgaaaatttccgcagctttaata

SEQ ID NO: 7289 - DNA, 40 bp, Artificial Sequence
  PCR primer for ORF amplification
ggatccagctagcaaaatgaacaggattaagaatacattt

SEQ ID NO: 7290 - DNA, 40 bp, Artificial Sequence
  PCR primer for ORF amplification
ggatccagctagcaaaatgaagaatgataataagttgcaa

SEQ ID NO: 7291 - DNA, 40 bp, Artificial Sequence
  PCR primer for ORF amplification
ggatccagctagcaaaatgagtcagtcttacgaagcagga

SEQ ID NO: 7292 - DNA, 40 bp, Artificial Sequence
  PCR primer for ORF amplification
ggatccagctagcaaaatgatggacaagcataagtatcgt

SEQ ID NO: 7293 - DNA, 40 bp, Artificial Sequence
  PCR primer for ORF amplification
ggatccagctagcaaaatgcattcaagaaagtcgaagagt

SEQ ID NO: 7294 - DNA, 40 bp, Artificial Sequence
  PCR primer for ORF amplification
ggatccagctagcaaaatgccgaccaagtcaacttttagt

SEQ ID NO: 7295 - DNA, 40 bp, Artificial Sequence
  PCR primer for ORF amplification
ggatccagctagcaaaatgtctgaattgaaaacaggtcat

SEQ ID NO: 7296 - DNA, 40 bp, Artificial Sequence
  PCR primer for ORF amplification
ggatccagctagcaaaatgttagcagaattgtctcataga

SEQ ID NO: 7297 - DNA, 40 bp, Artificial Sequence
  PCR primer for ORF amplification
ggatccagctagcaaaatgaaattatcaactgtcctatta

SEQ ID NO: 7298 - DNA, 40 bp, Artificial Sequence
  PCR primer for ORF amplification
ggatccagctagcaaaatgaatagcgtaaaaagagtaaag

SEQ ID NO: 7299 - DNA, 40 bp, Artificial Sequence
  PCR primer for ORF amplification
ggatccagctagcaaaatgaatgataaactccaagaagag

SEQ ID NO: 7300 - DNA, 40 bp, Artificial Sequence
  PCR primer for ORF amplification
ggatccagctagcaaaatgactttgagtaattgcgactct

SEQ ID NO: 7301 - DNA, 40 bp, Artificial Sequence
  PCR primer for ORF amplification
ggatccagctagcaaaatgattgcttcagaaatttttgaa

SEQ ID NO: 7302 - DNA, 40 bp, Artificial Sequence
  PCR primer for ORF amplification
ggatccagctagcaaaatgccatcaaatttgaatatagtg

SEQ ID NO: 7303 - DNA, 40 bp, Artificial Sequence
  PCR primer for ORF amplification
ggatccagctagcaaaatggataagaattcagttaacaaa

SEQ ID NO: 7304 - DNA, 40 bp, Artificial Sequence
  PCR primer for ORF amplification
ggatccagctagcaaaatggatgcaatatctgatccaacg

SEQ ID NO: 7305 - DNA, 40 bp, Artificial Sequence
  PCR primer for ORF amplification
ggatccagctagcaaaatggcaagatctttaagtcaatca

SEQ ID NO: 7306 - DNA, 40 bp, Artificial Sequence
  PCR primer for ORF amplification
ggatccagctagcaaaatgtcaaccacagcatccacgcct

SEQ ID NO: 7307 - DNA, 40 bp, Artificial Sequence
  PCR primer for ORF amplification
ggatccagctagcaaaatgtcaatacgtccagcaacacat

SEQ ID NO: 7308 - DNA, 40 bp, Artificial Sequence
  PCR primer for ORF amplification
ggatccagctagcaaaatgtctctacaacacgagaaagtt

SEQ ID NO: 7309 - DNA, 40 bp, Artificial Sequence
  PCR primer for ORF amplification
ggatccagctagcaaaatgcacagaacttactctttaaga

SEQ ID NO: 7310 - DNA, 40 bp, Artificial Sequence
  PCR primer for ORF amplification
ggatccagctagcaaaatgaatgaagatctattctacgat

SEQ ID NO: 7311 - DNA, 40 bp, Artificial Sequence
  PCR primer for ORF amplification
ggatccagctagcaaaatgacatcttggagggataaatcc

SEQ ID NO: 7312 - DNA, 40 bp, Artificial Sequence
  PCR primer for ORF amplification
ggatccagctagcaaaatgaggatggaaaaaacaacagac

SEQ ID NO: 7313 - DNA, 40 bp, Artificial Sequence
  PCR primer for ORF amplification
ggatccagctagcaaaatgccattacctccgtcaacattg

SEQ ID NO: 7314 - DNA, 40 bp, Artificial Sequence
  PCR primer for ORF amplification
ggatccagctagcaaaatggcgggaagtacatccagtttg

SEQ ID NO: 7315 - DNA, 40 bp, Artificial Sequence
  PCR primer for ORF amplification
ggatccagctagcaaaatgggaaccataacagtggtgatt

SEQ ID NO: 7316 - DNA, 40 bp, Artificial Sequence
  PCR primer for ORF amplification
ggatccagctagcaaaatgtcttcttcttcacagtatgta

SEQ ID NO: 7317 - DNA, 40 bp, Artificial Sequence
  PCR primer for ORF amplification
ggatccagctagcaaaatgtctacagacaagatcacattt

SEQ ID NO: 7318 - DNA, 40 bp, Artificial Sequence
  PCR primer for ORF amplification
ggatccagctagcaaaatgaaatatacgcaatacccgaac

SEQ ID NO: 7319 - DNA, 40 bp, Artificial Sequence
  PCR primer for ORF amplification
ggatccagctagcaaaatgaacataaaggatagaacttca

SEQ ID NO: 7320 - DNA, 40 bp, Artificial Sequence
  PCR primer for ORF amplification
ggatccagctagcaaaatgaccgcaccattggtagtattg

SEQ ID NO: 7321 - DNA, 40 bp, Artificial Sequence
  PCR primer for ORF amplification
ggatccagctagcaaaatgactgttagtaaaatacccata

SEQ ID NO: 7322 - DNA, 40 bp, Artificial Sequence
  PCR primer for ORF amplification
ggatccagctagcaaaatgatattaagtcagaggaggatg

SEQ ID NO: 7323 - DNA, 40 bp, Artificial Sequence
  PCR primer for ORF amplification
ggatccagctagcaaaatgattgatcgtaccgagttatcg

SEQ ID NO: 7324 - DNA, 40 bp, Artificial Sequence
  PCR primer for ORF amplification
ggatccagctagcaaaatggacgaaaacaaaataatcgac

SEQ ID NO: 7325 - DNA, 40 bp, Artificial Sequence
  PCR primer for ORF amplification
ggatccagctagcaaaatgtcgacaagtacagagaagagg

SEQ ID NO: 7326 - DNA, 40 bp, Artificial Sequence
  PCR primer for ORF amplification
ggatccagctagcaaaatggtcgctagaggtagaacagac

SEQ ID NO: 7327 - DNA, 40 bp, Artificial Sequence; identical to SEQ ID NO: 7309
  PCR primer for ORF amplification

SEQ ID NO: 7328 - DNA, 40 bp, Artificial Sequence
  PCR primer for ORF amplification
ggatccagctagcaaaatgaaaagaggagaaagccaggcg

SEQ ID NO: 7329 - DNA, 40 bp, Artificial Sequence
  PCR primer for ORF amplification
ggatccagctagcaaaatgagactgccagaaatctccatt

SEQ ID NO: 7330 - DNA, 40 bp, Artificial Sequence
  PCR primer for ORF amplification
ggatccagctagcaaaatgagtgacgtggtcagtaaagat

SEQ ID NO: 7331 - DNA, 40 bp, Artificial Sequence
  PCR primer for ORF amplification
ggatccagctagcaaaatgagtttagaggctacagattcc

SEQ ID NO: 7332 - DNA, 40 bp, Artificial Sequence
  PCR primer for ORF amplification
ggatccagctagcaaaatgcaatacaaaaaatcattagtt

SEQ ID NO: 7333 - DNA, 40 bp, Artificial Sequence
  PCR primer for ORF amplification
ggatccagctagcaaaatgcagatagtacaaattgagcag

SEQ ID NO: 7334 - DNA, 40 bp, Artificial Sequence
  PCR primer for ORF amplification
ggatccagctagcaaaatggcaggcccaaggaatgtgcgt

SEQ ID NO: 7335 - DNA, 40 bp, Artificial Sequence
  PCR primer for ORF amplification
ggatccagctagcaaaatggcagtaaaacataaatccgag

SEQ ID NO: 7336 - DNA, 40 bp, Artificial Sequence
  PCR primer for ORF amplification
ggatccagctagcaaaatgtcaaataataaggctggcggt

SEQ ID NO: 7337 - DNA, 40 bp, Artificial Sequence
  PCR primer for ORF amplification
ggatccagctagcaaaatgtctgaacaggagtctgatgaa

SEQ ID NO: 7338 - DNA, 40 bp, Artificial Sequence
  PCR primer for ORF amplification
ggatccagctagcaaaatgtctgttccaatccctggtatt

SEQ ID NO: 7339 - DNA, 40 bp, Artificial Sequence
  PCR primer for ORF amplification
ggatccagctagcaaaatgaaggtcgagaaatcatctaaa

SEQ ID NO: 7340 - DNA, 40 bp, Artificial Sequence
  PCR primer for ORF amplification
ggatccagctagcaaaatgaatgaaaacgagtacgataat

SEQ ID NO: 7341 - DNA, 40 bp, Artificial Sequence
  PCR primer for ORF amplification
ggatccagctagcaaaatgataaaacatatagtttcgcca

SEQ ID NO: 7342 - DNA, 40 bp, Artificial Sequence
  PCR primer for ORF amplification
ggatccagctagcaaaatgatgatactgggtaaagccggg

SEQ ID NO: 7343 - DNA, 40 bp, Artificial Sequence
  PCR primer for ORF amplification
ggatccagctagcaaaatgcaatatagttcgaggttccta

SEQ ID NO: 7344 - DNA, 40 bp, Artificial Sequence
  PCR primer for ORF amplification
ggatccagctagcaaaatgcatacagctgaatttttggaa

SEQ ID NO: 7345 - DNA, 40 bp, Artificial Sequence
  PCR primer for ORF amplification
ggatccagctagcaaaatgctacacttacaaccacaaaac

SEQ ID NO: 7346 - DNA, 40 bp, Artificial Sequence
  PCR primer for ORF amplification
ggatccagctagcaaaatggaagaaaataaacttagtgga

SEQ ID NO: 7347 - DNA, 40 bp, Artificial Sequence
  PCR primer for ORF amplification
ggatccagctagcaaaatggattctgagttgaaagggcag

SEQ ID NO: 7348 - DNA, 40 bp, Artificial Sequence
  PCR primer for ORF amplification
ggatccagctagcaaaatggttttagttaagcaggtaaga

SEQ ID NO: 7349 - DNA, 40 bp, Artificial Sequence
  PCR primer for ORF amplification
ggatccagctagcaaaatgtcaaatagtaacggtgataat

SEQ ID NO: 7350 - DNA, 40 bp, Artificial Sequence
  PCR primer for ORF amplification
ggatccagctagcaaaatgtcagttttcgtttcaggtgct

SEQ ID NO: 7351 - DNA, 40 bp, Artificial Sequence
  PCR primer for ORF amplification
ggatccagctagcaaaatgtccggattcgcaaaactcaag

SEQ ID NO: 7352 - DNA, 40 bp, Artificial Sequence
  PCR primer for ORF amplification
ggatccagctagcaaaatgtggaactcactaaaagcattc

SEQ ID NO: 7353 - DNA, 40 bp, Artificial Sequence
  PCR primer for ORF amplification
ggatccagctagcaaaatgtcttttctacaaaatttgtat

SEQ ID NO: 7354 - DNA, 40 bp, Artificial Sequence
  PCR primer for ORF amplification
ggatccagctagcaaaatgaaaatgcccagtattattcag

SEQ ID NO: 7355 - DNA, 40 bp, Artificial Sequence
  PCR primer for ORF amplification
ggatccagctagcaaaatgaagttttttagtttggcagat

SEQ ID NO: 7356 - DNA, 40 bp, Artificial Sequence
  PCR primer for ORF amplification
ggatccagctagcaaaatgagcgaagataaagctaaatta

SEQ ID NO: 7357 - DNA, 40 bp, Artificial Sequence
  PCR primer for ORF amplification
ggatccagctagcaaaatgagtaatgcaaacaatagtgct

SEQ ID NO: 7358 - DNA, 40 bp, Artificial Sequence
  PCR primer for ORF amplification
ggatccagctagcaaaatggtcaaagtcgcaattcttggc

SEQ ID NO: 7359 - DNA, 40 bp, Artificial Sequence
  PCR primer for ORF amplification
ggatccagctagcaaaatgtctgagccaaacacaccatta

SEQ ID NO: 7360 - DNA, 40 bp, Artificial Sequence
  PCR primer for ORF amplification
ggatccagctagcaaaatgaagataaaaattgacattata

SEQ ID NO: 7361 - DNA, 40 bp, Artificial Sequence
  PCR primer for ORF amplification
ggatccagctagcaaaatgacattggcagagttgcttgga

SEQ ID NO: 7362 - DNA, 40 bp, Artificial Sequence
  PCR primer for ORF amplification
ggatccagctagcaaaatgagtgcgggtatcggagaatca

SEQ ID NO: 7363 - DNA, 40 bp, Artificial Sequence
  PCR primer for ORF amplification
ggatccagctagcaaaatgatagtagattatgaaaaggac

SEQ ID NO: 7364 - DNA, 40 bp, Artificial Sequence
  PCR primer for ORF amplification
ggatccagctagcaaaatgattagaaccgtaaaacccaag

SEQ ID NO: 7365 - DNA, 40 bp, Artificial Sequence
  PCR primer for ORF amplification
ggatccagctagcaaaatgcattgcccaatttgccaccat

SEQ ID NO: 7366 - DNA, 40 bp, Artificial Sequence
  PCR primer for ORF amplification
ggatccagctagcaaaatggaaaaaaatacggcaccattt

SEQ ID NO: 7367 - DNA, 40 bp, Artificial Sequence
  PCR primer for ORF amplification
ggatccagctagcaaaatggccgatttcttattgagacca

SEQ ID NO: 7368 - DNA, 40 bp, Artificial Sequence
  PCR primer for ORF amplification
ggatccagctagcaaaatgtctaatacagttctagtttct

SEQ ID NO: 7369 - DNA, 40 bp, Artificial Sequence
  PCR primer for ORF amplification
ggatccagctagcaaaatgtctgattatgttgaactattg

SEQ ID NO: 7370 - DNA, 40 bp, Artificial Sequence
  PCR primer for ORF amplification
ggatccagctagcaaaatgtcttcttcagtagcctcaacc

SEQ ID NO: 7371 - DNA, 40 bp, Artificial Sequence
  PCR primer for ORF amplification
ggatccagctagcaaaatgtttaaatcattggctgctgtc

SEQ ID NO: 7372 - DNA, 40 bp, Artificial Sequence
  PCR primer for ORF amplification
ggatccagctagcaaaatgaacactaccacatctactgtt

SEQ ID NO: 7373 - DNA, 40 bp, Artificial Sequence
  PCR primer for ORF amplification
ggatccagctagcaaaatgaccatagataactacgacaac

SEQ ID NO: 7374 - DNA, 40 bp, Artificial Sequence
  PCR primer for ORF amplification
ggatccagctagcaaaatgagttacggcttaacaggtacc

SEQ ID NO: 7375 - DNA, 40 bp, Artificial Sequence
  PCR primer for ORF amplification
ggatccagctagcaaaatgatgactagggagagcatagat

SEQ ID NO: 7376 - DNA, 40 bp, Artificial Sequence
  PCR primer for ORF amplification
ggatccagctagcaaaatgccaccaaaaaagggaaaacag

SEQ ID NO: 7377 - DNA, 40 bp, Artificial Sequence
  PCR primer for ORF amplification
ggatccagctagcaaaatggaagcacataaccaatttttg

SEQ ID NO: 7378 - DNA, 40 bp, Artificial Sequence
  PCR primer for ORF amplification
ggatccagctagcaaaatggaaggcgtgtatttcaatatt

SEQ ID NO: 7379 - DNA, 40 bp, Artificial Sequence
  PCR primer for ORF amplification
ggatccagctagcaaaatggtgactggtgaagaaaatgtg

SEQ ID NO: 7380 - DNA, 40 bp, Artificial Sequence
  PCR primer for ORF amplification
ggatccagctagcaaaatgtacaactttttagaatttttc

SEQ ID NO: 7381 - DNA, 40 bp, Artificial Sequence
  PCR primer for ORF amplification
ggatccagctagcaaaatgtctactttacaacgtcgtaga

SEQ ID NO: 7382 - DNA, 40 bp, Artificial Sequence
  PCR primer for ORF amplification
ggatccagctagcaaaatgtctgtcgccgatttgaaaaac

SEQ ID NO: 7383 - DNA, 40 bp, Artificial Sequence
  PCR primer for ORF amplification
ggatccagctagcaaaatgttacgcaacatcatcaggttc

SEQ ID NO: 7384 - DNA, 40 bp, Artificial Sequence
  PCR primer for ORF amplification
ggatccagctagcaaaatgaacacagattcacacaacctt

SEQ ID NO: 7385 - DNA, 40 bp, Artificial Sequence
  PCR primer for ORF amplification
ggatccagctagcaaaatgaaggcgtcgcacatttgctct

SEQ ID NO: 7386 - DNA, 40 bp, Artificial Sequence
  PCR primer for ORF amplification
ggatccagctagcaaaatgacccttgatgatgacgactat

SEQ ID NO: 7387 - DNA, 40 bp, Artificial Sequence
  PCR primer for ORF amplification
ggatccagctagcaaaatgaccgaacctcaaggtcctttg

SEQ ID NO: 7388 - DNA, 40 bp, Artificial Sequence
  PCR primer for ORF amplification
ggatccagctagcaaaatgatgtctgatttaacaccaata

SEQ ID NO: 7389 - DNA, 40 bp, Artificial Sequence
  PCR primer for ORF amplification
ggatccagctagcaaaatgcagaagagcatattgctgact

SEQ ID NO: 7390 - DNA, 40 bp, Artificial Sequence
  PCR primer for ORF amplification
ggatccagctagcaaaatggaggacggtaaacaggccatc

SEQ ID NO: 7391 - DNA, 40 bp, Artificial Sequence
  PCR primer for ORF amplification
ggatccagctagcaaaatggatgaaatgcattcttcagac

SEQ ID NO: 7392 - DNA, 40 bp, Artificial Sequence
  PCR primer for ORF amplification
ggatccagctagcaaaatgtcagcatcaaaagaagaaatt

SEQ ID NO: 7393 - DNA, 40 bp, Artificial Sequence
  PCR primer for ORF amplification
ggatccagctagcaaaatgtcaggtgtaagctctgttatg

SEQ ID NO: 7394 - DNA, 40 bp, Artificial Sequence
  PCR primer for ORF amplification
ggatccagctagcaaaatggctagaggaccgtatgtttga

SEQ ID NO: 7395 - DNA, 40 bp, Artificial Sequence
  PCR primer for ORF amplification
ggatccagctagcaaaatgaacaggaaagtagctatcgta

SEQ ID NO: 7396 - DNA, 40 bp, Artificial Sequence
  PCR primer for ORF amplification
ggatccagctagcaaaatgaagatattctccacactctta

SEQ ID NO: 7397 - DNA, 40 bp, Artificial Sequence
  PCR primer for ORF amplification
ggatccagctagcaaaatgaaggctatcaaattaacaggt

SEQ ID NO: 7398 - DNA, 40 bp, Artificial Sequence
  PCR primer for ORF amplification
ggatccagctagcaaaatgaattcactcgttactcaatat

SEQ ID NO: 7399 - DNA, 40 bp, Artificial Sequence
  PCR primer for ORF amplification
ggatccagctagcaaaatgacaactttattacagctcttg

SEQ ID NO: 7400 - DNA, 40 bp, Artificial Sequence
  PCR primer for ORF amplification
ggatccagctagcaaaatgactactgataccactgttttc

SEQ ID NO: 7401 - DNA, 40 bp, Artificial Sequence
  PCR primer for ORF amplification
ggatccagctagcaaaatgacttttatgcaacagcttcaa

SEQ ID NO: 7402 - DNA, 40 bp, Artificial Sequence
  PCR primer for ORF amplification
ggatccagctagcaaaatgcccttcgctcagattgttatt

SEQ ID NO: 7403 - DNA, 40 bp, Artificial Sequence
  PCR primer for ORF amplification
ggatccagctagcaaaatggatatgaaagtagaaaaatta

SEQ ID NO: 7404 - DNA, 40 bp, Artificial Sequence
  PCR primer for ORF amplification
ggatccagctagcaaaatggttcaatatgtggtagaatgg

SEQ ID NO: 7405 - DNA, 40 bp, Artificial Sequence
  PCR primer for ORF amplification
ggatccagctagcaaaatggtttctgtggagtttttacag

SEQ ID NO: 7406 - DNA, 40 bp, Artificial Sequence
  PCR primer for ORF amplification
ggatccagctagcaaaatgtctcaaccagtcgttgttatt

SEQ ID NO: 7407 - DNA, 40 bp, Artificial Sequence
  PCR primer for ORF amplification
ggatccagctagcaaaatgactactgaaaaaaccgttgtt

SEQ ID NO: 7408 - DNA, 40 bp, Artificial Sequence
  PCR primer for ORF amplification
ggatccagctagcaaaatgagcaagacagccgtgaaagat

SEQ ID NO: 7409 - DNA, 40 bp, Artificial Sequence
  PCR primer for ORF amplification
ggatccagctagcaaaatgccaactctagtaaatggacca

SEQ ID NO: 7410 - DNA, 40 bp, Artificial Sequence
  PCR primer for ORF amplification
ggatccagctagcaaaatggcaaggcaagggaacttctac

SEQ ID NO: 7411 - DNA, 40 bp, Artificial Sequence
  PCR primer for ORF amplification
ggatccagctagcaaaatgtcacaatacaaaactggttta

SEQ ID NO: 7412 - DNA, 40 bp, Artificial Sequence
  PCR primer for ORF amplification
ggatccagctagcaaaatgtctatcccagaaactcaaaaa

SEQ ID NO: 7413 - DNA, 40 bp, Artificial Sequence
  PCR primer for ORF amplification
ggatccagctagcaaaatgtctattccagaaactcaaaaa

SEQ ID NO: 7414 - DNA, 40 bp, Artificial Sequence
  PCR primer for ORF amplification
ggatccagctagcaaaatgaacgtaacatcgaatgcaact

SEQ ID NO: 7415 - DNA, 40 bp, Artificial Sequence
  PCR primer for ORF amplification
ggatccagctagcaaaatgagtgcttccaaaatggccatg

SEQ ID NO: 7416 - DNA, 40 bp, Artificial Sequence
  PCR primer for ORF amplification
ggatccagctagcaaaatgcaaccatttgatagtgggcat

SEQ ID NO: 7417 - DNA, 40 bp, Artificial Sequence
  PCR primer for ORF amplification
ggatccagctagcaaaatgcccaagttggaacaatttgaa

SEQ ID NO: 7418 - DNA, 40 bp, Artificial Sequence
  PCR primer for ORF amplification
ggatccagctagcaaaatgtcaaagatagattcagtttta

SEQ ID NO: 7419 - DNA, 40 bp, Artificial Sequence
  PCR primer for ORF amplification
ggatccagctagcaaaatgtccccattgaacgtcggtata

SEQ ID NO: 7420 - DNA, 40 bp, Artificial Sequence
  PCR primer for ORF amplification
ggatccagctagcaaaatgtcgcagtacatcggtaaaact

SEQ ID NO: 7421 - DNA, 40 bp, Artificial Sequence
  PCR primer for ORF amplification
ggatccagctagcaaaatgaatatagactgtttgtgtcgt

SEQ ID NO: 7422 - DNA, 40 bp, Artificial Sequence
  PCR primer for ORF amplification
ggatccagctagcaaaatgaattggctgtttttggtctcg

SEQ ID NO: 7423 - DNA, 40 bp, Artificial Sequence
  PCR primer for ORF amplification
ggatccagctagcaaaatgaccgtttccaacattgggggg

SEQ ID NO: 7424 - DNA, 40 bp, Artificial Sequence
  PCR primer for ORF amplification
ggatccagctagcaaaatgagtaagaaaccaattgttttg

SEQ ID NO: 7425 - DNA, 40 bp, Artificial Sequence
  PCR primer for ORF amplification
ggatccagctagcaaaatggatcaaaaggcgtcatatttt

SEQ ID NO: 7426 - DNA, 40 bp, Artificial Sequence
  PCR primer for ORF amplification
ggatccagctagcaaaatgggtcttttttcaagaaaacgg

SEQ ID NO: 7427 - DNA, 40 bp, Artificial Sequence
  PCR primer for ORF amplification
ggatccagctagcaaaatggtcgtgaataacccaaataac

SEQ ID NO: 7428 - DNA, 40 bp, Artificial Sequence
  PCR primer for ORF amplification
ggatccagctagcaaaatgtctcaactgccaacagatttt

SEQ ID NO: 7429 - DNA, 40 bp, Artificial Sequence
  PCR primer for ORF amplification
ggatccagctagcaaaatggctagaggaccgtatgttgat

SEQ ID NO: 7430 - DNA, 40 bp, Artificial Sequence
  PCR primer for ORF amplification
ggatccagctagcaaaatgaactctctggcaaataataat

SEQ ID NO: 7431 - DNA, 40 bp, Artificial Sequence
  PCR primer for ORF amplification
ggatccagctagcaaaatgaagcaggagccacatagacaa

SEQ ID NO: 7432 - DNA, 40 bp, Artificial Sequence
  PCR primer for ORF amplification
ggatccagctagcaaaatgacacctacaaaccaatctagt

SEQ ID NO: 7433 - DNA, 40 bp, Artificial Sequence
  PCR primer for ORF amplification
ggatccagctagcaaaatgagtgttgatttgtttccaaat

SEQ ID NO: 7434 - DNA, 40 bp, Artificial Sequence
  PCR primer for ORF amplification
ggatccagctagcaaaatgcagaggtttgtcagtaagttt

SEQ ID NO: 7435 - DNA, 40 bp, Artificial Sequence
  PCR primer for ORF amplification
ggatccagctagcaaaatgccttcgcaagtcattcctgaa

SEQ ID NO: 7436 - DNA, 40 bp, Artificial Sequence
  PCR primer for ORF amplification
ggatccagctagcaaaatgttcaagagatttagcaaaaag

SEQ ID NO: 7437 - DNA, 40 bp, Artificial Sequence
  PCR primer for ORF amplification
ggatccagctagcaaaatgagtaaggataataggttagca

SEQ ID NO: 7438 - DNA, 40 bp, Artificial Sequence
  PCR primer for ORF amplification
ggatccagctagcaaaatgattggcaaacggtttttccaa

SEQ ID NO: 7439 - DNA, 40 bp, Artificial Sequence
  PCR primer for ORF amplification
ggatccagctagcaaaatggaatcaagtttacaaaaattg

SEQ ID NO: 7440 - DNA, 40 bp, Artificial Sequence
  PCR primer for ORF amplification
ggatccagctagcaaaatggcttcagaaaaagaaattagg

SEQ ID NO: 7441 - DNA, 40 bp, Artificial Sequence
  PCR primer for ORF amplification
ggatccagctagcaaaatggtcaaggagacaaaactttat

SEQ ID NO: 7442 - DNA, 40 bp, Artificial Sequence
  PCR primer for ORF amplification
ggatccagctagcaaaatgtcagattggaaagtggaccca

SEQ ID NO: 7443 - DNA, 40 bp, Artificial Sequence
  PCR primer for ORF amplification
ggatccagctagcaaaatgacgctgcaaagaattagtaaa

SEQ ID NO: 7444 - DNA, 40 bp, Artificial Sequence
  PCR primer for ORF amplification
ggatccagctagcaaaatgactacaaataatgacttctat

SEQ ID NO: 7445 - DNA, 40 bp, Artificial Sequence
  PCR primer for ORF amplification
ggatccagctagcaaaatgattcaatttaaaagtccaggt

SEQ ID NO: 7446 - DNA, 40 bp, Artificial Sequence
  PCR primer for ORF amplification
ggatccagctagcaaaatgccaaagagaattgtatacaat

SEQ ID NO: 7447 - DNA, 40 bp, Artificial Sequence
  PCR primer for ORF amplification
ggatccagctagcaaaatggaaagcagaaataccgtgctt

SEQ ID NO: 7448 - DNA, 40 bp, Artificial Sequence
  PCR primer for ORF amplification
ggatccagctagcaaaatgggttcccaagatttagctagt

SEQ ID NO: 7449 - DNA, 40 bp, Artificial Sequence
  PCR primer for ORF amplification
ggatccagctagcaaaatggtcgatacgcataaactagca

SEQ ID NO: 7450 - DNA, 40 bp, Artificial Sequence
  PCR primer for ORF amplification
ggatccagctagcaaaatgtcattaccacaatggtgtcca

SEQ ID NO: 7451 - DNA, 40 bp, Artificial Sequence
  PCR primer for ORF amplification
ggatccagctagcaaaatgtccaagttagaaaccgtttac

SEQ ID NO: 7452 - DNA, 40 bp, Artificial Sequence
  PCR primer for ORF amplification
ggatccagctagcaaaatgtcgacagcacagaaagctaag

SEQ ID NO: 7453 - DNA, 40 bp, Artificial Sequence
  PCR primer for ORF amplification
ggatccagctagcaaaatgtttgaagggtttggtccaaat

SEQ ID NO: 7454 - DNA, 40 bp, Artificial Sequence
  PCR primer for ORF amplification
ggatccagctagcaaaatgaaggtatgtaatatcacccaa

SEQ ID NO: 7455 - DNA, 40 bp, Artificial Sequence
  PCR primer for ORF amplification
ggatccagctagcaaaatgaagttccaagttgttttatct

SEQ ID NO: 7456 - DNA, 40 bp, Artificial Sequence
  PCR primer for ORF amplification
ggatccagctagcaaaatgatgaataacaacggcaaccaa

SEQ ID NO: 7457 - DNA, 40 bp, Artificial Sequence
  PCR primer for ORF amplification
ggatccagctagcaaaatggactatggctacttttttccc

SEQ ID NO: 7458 - DNA, 40 bp, Artificial Sequence
  PCR primer for ORF amplification
ggatccagctagcaaaatggatttaaccgtggaacctaat

SEQ ID NO: 7459 - DNA, 40 bp, Artificial Sequence
  PCR primer for ORF amplification
ggatccagctagcaaaatggggtttctttcggatcatccg

SEQ ID NO: 7460 - DNA, 40 bp, Artificial Sequence
  PCR primer for ORF amplification
ggatccagctagcaaaatggtacccgctgctgaaaaccta

SEQ ID NO: 7461 - DNA, 40 bp, Artificial Sequence
  PCR primer for ORF amplification
ggatccagctagcaaaatggtaccgaaccttcgttttaat

SEQ ID NO: 7462 - DNA, 40 bp, Artificial Sequence
  PCR primer for ORF amplification
ggatccagctagcaaaatgtcattgtgggtagataaatac

SEQ ID NO: 7463 - DNA, 40 bp, Artificial Sequence
  PCR primer for ORF amplification
ggatccagctagcaaaatgaatactgtaccatttacatct

SEQ ID NO: 7464 - DNA, 40 bp, Artificial Sequence
  PCR primer for ORF amplification
ggatccagctagcaaaatgactgccagcacatcagttgcg

SEQ ID NO: 7465 - DNA, 40 bp, Artificial Sequence
  PCR primer for ORF amplification
ggatccagctagcaaaatggatacggtaaacaattatagg

SEQ ID NO: 7466 - DNA, 40 bp, Artificial Sequence
  PCR primer for ORF amplification
ggatccagctagcaaaatggtactttgcaaattactgaca

SEQ ID NO: 7467 - DNA, 40 bp, Artificial Sequence
  PCR primer for ORF amplification
ggatccagctagcaaaatgtctactggaagcagtgataga

SEQ ID NO: 7468 - DNA, 40 bp, Artificial Sequence
  PCR primer for ORF amplification
ggatccagctagcaaaatgactgacttaactacacaagaa

SEQ ID NO: 7469 - DNA, 40 bp, Artificial Sequence
  PCR primer for ORF amplification
ggatccagctagcaaaatggtatgtgcacttcaaatgttc

SEQ ID NO: 7470 - DNA, 40 bp, Artificial Sequence
  PCR primer for ORF amplification
ggatccagctagcaaaatggttacagtatgttgttgcttt

SEQ ID NO: 7471 - DNA, 40 bp, Artificial Sequence
  PCR primer for ORF amplification
ggatccagctagcaaaatgtcagtatcttacaagggaaca

SEQ ID NO: 7472 - DNA, 40 bp, Artificial Sequence
  PCR primer for ORF amplification
ggatccagctagcaaaatgtccaaaagaaacactccaccg

SEQ ID NO: 7473 - DNA, 40 bp, Artificial Sequence
  PCR primer for ORF amplification
ggatccagctagcaaaatgtctagaatactagttatcggg

SEQ ID NO: 7474 - DNA, 40 bp, Artificial Sequence
  PCR primer for ORF amplification
ggatccagctagcaaaatgttaaaagttcctttgagtgat

SEQ ID NO: 7475 - DNA, 40 bp, Artificial Sequence
  PCR primer for ORF amplification
ggatccagctagcaaaatgtctcaaaatagtaaccctgca

SEQ ID NO: 7476 - DNA, 40 bp, Artificial Sequence
  PCR primer for ORF amplification
ggatccagctagcaaaatgacgcgagatagcccagattct

SEQ ID NO: 7477 - DNA, 40 bp, Artificial Sequence
  PCR primer for ORF amplification
ggatccagctagcaaaatgagcccaagtccatcagtgtcg

SEQ ID NO: 7478 - DNA, 40 bp, Artificial Sequence
  PCR primer for ORF amplification
ggatccagctagcaaaatgaggttagctgtggttgtgacc

SEQ ID NO: 7479 - DNA, 40 bp, Artificial Sequence
  PCR primer for ORF amplification
ggatccagctagcaaaatggaaaagaaggtaatatgtcaa

SEQ ID NO: 7480 - DNA, 40 bp, Artificial Sequence
  PCR primer for ORF amplification
ggatccagctagcaaaatggcattggaaagagaattattg

SEQ ID NO: 7481 - DNA, 40 bp, Artificial Sequence
  PCR primer for ORF amplification
ggatccagctagcaaaatgggcgatcataatctgccggat

SEQ ID NO: 7482 - DNA, 40 bp, Artificial Sequence
  PCR primer for ORF amplification
ggatccagctagcaaaatggttcgtgccttcaaaattaaa

SEQ ID NO: 7483 - DNA, 40 bp, Artificial Sequence
  PCR primer for ORF amplification
ggatccagctagcaaaatgtctgaacttaatgcattatta

SEQ ID NO: 7484 - DNA, 40 bp, Artificial Sequence
  PCR primer for ORF amplification
ggatccagctagcaaaatgtctgtttctaccgcctctaca

SEQ ID NO: 7485 - DNA, 40 bp, Artificial Sequence
  PCR primer for ORF amplification
ggatccagctagcaaaatgtgcagattcttgattttcaaa

SEQ ID NO: 7486 - DNA, 40 bp, Artificial Sequence
  PCR primer for ORF amplification
ggatccagctagcaaaatgtatgtgatgcagtgaataatg

SEQ ID NO: 7487 - DNA, 40 bp, Artificial Sequence
  PCR primer for ORF amplification
ggatccagctagcaaaatgagtagtgttggcgattttgaa

SEQ ID NO: 7488 - DNA, 40 bp, Artificial Sequence
  PCR primer for ORF amplification
ggatccagctagcaaaatggatgcaacatcgaggatggag

SEQ ID NO: 7489 - DNA, 40 bp, Artificial Sequence
  PCR primer for ORF amplification
ggatccagctagcaaaatgttgccagaaaagagactattg

SEQ ID NO: 7490 - DNA, 40 bp, Artificial Sequence
  PCR primer for ORF amplification
ggatccagctagcaaaatgagcactaaagttgttaatgtt

SEQ ID NO: 7491 - DNA, 40 bp, Artificial Sequence
  PCR primer for ORF amplification
ggatccagctagcaaaatggccttggtctctagaaggtcg

SEQ ID NO: 7492 - DNA, 40 bp, Artificial Sequence
  PCR primer for ORF amplification
ggatccagctagcaaaatgggtgttgaacaaatcttaaag

SEQ ID NO: 7493 - DNA, 40 bp, Artificial Sequence
  PCR primer for ORF amplification
ggatccagctagcaaaatgtccgaagttatcacaattacc

SEQ ID NO: 7494 - DNA, 40 bp, Artificial Sequence
  PCR primer for ORF amplification
ggatccagctagcaaaatgtcgtttactgctccttcagat

SEQ ID NO: 7495 - DNA, 40 bp, Artificial Sequence
  PCR primer for ORF amplification
ggatccagctagcaaaatgtggtgcatgagaagattgcca

SEQ ID NO: 7496 - DNA, 40 bp, Artificial Sequence
  PCR primer for ORF amplification
ggatccagctagcaaaatgaagctactaaccttcccaggt

SEQ ID NO: 7497 - DNA, 40 bp, Artificial Sequence
  PCR primer for ORF amplification
ggatccagctagcaaaatgcaagcggatatgcatggaaaa

SEQ ID NO: 7498 - DNA, 40 bp, Artificial Sequence
  PCR primer for ORF amplification
ggatccagctagcaaaatgcttaacagaacaattgctaag

SEQ ID NO: 7499 - DNA, 40 bp, Artificial Sequence
  PCR primer for ORF amplification
ggatccagctagcaaaatggatttaagtttcacgactaaa

SEQ ID NO: 7500 - DNA, 40 bp, Artificial Sequence
  PCR primer for ORF amplification
ggatccagctagcaaaatgtcctcacaagaatatacaact

SEQ ID NO: 7501 - DNA, 40 bp, Artificial Sequence
  PCR primer for ORF amplification
ggatccagctagcaaaatgtcgacattgttatctgaggta

SEQ ID NO: 7502 - DNA, 40 bp, Artificial Sequence
  PCR primer for ORF amplification
ggatccagctagcaaaatgtcgagctcctccaaggcttct

SEQ ID NO: 7503 - DNA, 40 bp, Artificial Sequence
  PCR primer for ORF amplification
ggatccagctagcaaaatgtcgatagtctacaataaaaca

SEQ ID NO: 7504 - DNA, 40 bp, Artificial Sequence
  PCR primer for ORF amplification
ggatccagctagcaaaatgtcttatcctgagaaatttgaa

SEQ ID NO: 7505 - DNA, 40 bp, Artificial Sequence
  PCR primer for ORF amplification
ggatccagctagcaaaatgaaaggtttaattttagtcggt

SEQ ID NO: 7506 - DNA, 40 bp, Artificial Sequence
  PCR primer for ORF amplification
ggatccagctagcaaaatgactactgctgttaggctttta

SEQ ID NO: 7507 - DNA, 40 bp, Artificial Sequence
  PCR primer for ORF amplification
ggatccagctagcaaaatgagcactcccaggaaggccgcc

SEQ ID NO: 7508 - DNA, 40 bp, Artificial Sequence
  PCR primer for ORF amplification
ggatccagctagcaaaatgatttctgctaattcattactt

SEQ ID NO: 7509 - DNA, 40 bp, Artificial Sequence
  PCR primer for ORF amplification
ggatccagctagcaaaatgcgctcctccatgtttagatgt

SEQ ID NO: 7510 - DNA, 40 bp, Artificial Sequence
  PCR primer for ORF amplification
ggatccagctagcaaaatgctttacccagaaaaatttcag

SEQ ID NO: 7511 - DNA, 40 bp, Artificial Sequence
  PCR primer for ORF amplification
ggatccagctagcaaaatgttttctggctttagttctttt

SEQ ID NO: 7512 - DNA, 40 bp, Artificial Sequence
  PCR primer for ORF amplification
ggatccagctagcaaaatgagatctttaaataccctttta

SEQ ID NO: 7513 - DNA, 40 bp, Artificial Sequence
  PCR primer for ORF amplification
ggatccagctagcaaaatgtcccgtccacaagttactgtt

SEQ ID NO: 7514 - DNA, 40 bp, Artificial Sequence; identical to SEQ ID NO: 7513
  PCR primer for ORF amplification

SEQ ID NO: 7515 - DNA, 40 bp, Artificial Sequence
  PCR primer for ORF amplification
ggatccagctagcaaaatgatcaataatcctaaggtagac

SEQ ID NO: 7516 - DNA, 40 bp, Artificial Sequence
  PCR primer for ORF amplification
ggatccagctagcaaaatgctggttccacctgctaacttt

SEQ ID NO: 7517 - DNA, 40 bp, Artificial Sequence
  PCR primer for ORF amplification
ggatccagctagcaaaatggagaaaagcgaaagtaattct

SEQ ID NO: 7518 - DNA, 40 bp, Artificial Sequence
  PCR primer for ORF amplification
ggatccagctagcaaaatgggtaactttccagctccaaaa

SEQ ID NO: 7519 - DNA, 40 bp, Artificial Sequence
  PCR primer for ORF amplification
ggatccagctagcaaaatgtctcgcaaatttgatttaaaa

SEQ ID NO: 7520 - DNA, 40 bp, Artificial Sequence
  PCR primer for ORF amplification
ggatccagctagcaaaatgaacggatctcccactcctaag

SEQ ID NO: 7521 - DNA, 40 bp, Artificial Sequence
  PCR primer for ORF amplification
ggatccagctagcaaaatgatgaatgaagaggattctaca

SEQ ID NO: 7522 - DNA, 40 bp, Artificial Sequence
  PCR primer for ORF amplification
ggatccagctagcaaaatgattgggtccgcgtccgactca

SEQ ID NO: 7523 - DNA, 40 bp, Artificial Sequence
  PCR primer for ORF amplification
ggatccagctagcaaaatgctagataacatgcaatttcat

SEQ ID NO: 7524 - DNA, 40 bp, Artificial Sequence
  PCR primer for ORF amplification
ggatccagctagcaaaatggagcaccaacaattgcggaag

SEQ ID NO: 7525 - DNA, 40 bp, Artificial Sequence
  PCR primer for ORF amplification
ggatccagctagcaaaatgggaatgaagtacgtattgcct

SEQ ID NO: 7526 - DNA, 40 bp, Artificial Sequence
  PCR primer for ORF amplification
ggatccagctagcaaaatgggagaggtatacgaaaaaaat

SEQ ID NO: 7527 - DNA, 40 bp, Artificial Sequence
  PCR primer for ORF amplification
ggatccagctagcaaaatggtatacacaacaccgcaacaa

SEQ ID NO: 7528 - DNA, 40 bp, Artificial Sequence
  PCR primer for ORF amplification
ggatccagctagcaaaatgtctccgaagaatataacaagg

SEQ ID NO: 7529 - DNA, 40 bp, Artificial Sequence
  PCR primer for ORF amplification
ggatccagctagcaaaatgtttactcgaaggtttattcca

SEQ ID NO: 7530 - DNA, 40 bp, Artificial Sequence
  PCR primer for ORF amplification
ggatccagctagcaaaatggttaagaaagttaataatccg

SEQ ID NO: 7531 - DNA, 40 bp, Artificial Sequence
  PCR primer for ORF amplification
ggatccagctagcaaaatgaatgatgaaattaatgagcca

SEQ ID NO: 7532 - DNA, 40 bp, Artificial Sequence
  PCR primer for ORF amplification
ggatccagctagcaaaatgatttctattgtattggaattg

SEQ ID NO: 7533 - DNA, 40 bp, Artificial Sequence
  PCR primer for ORF amplification
ggatccagctagcaaaatgcaaactgtgttgaaatatttg

SEQ ID NO: 7534 - DNA, 40 bp, Artificial Sequence
  PCR primer for ORF amplification
ggatccagctagcaaaatgccaagtacgtcgttaatcttc

SEQ ID NO: 7535 - DNA, 40 bp, Artificial Sequence
  PCR primer for ORF amplification
ggatccagctagcaaaatggctggaaatgcaaactcagta

SEQ ID NO: 7536 - DNA, 40 bp, Artificial Sequence
  PCR primer for ORF amplification
ggatccagctagcaaaatggtacaagaaatcgatttaggt

SEQ ID NO: 7537 - DNA, 40 bp, Artificial Sequence
  PCR primer for ORF amplification
ggatccagctagcaaaatgtctgcccctaagaagatcgtc

SEQ ID NO: 7538 - DNA, 40 bp, Artificial Sequence
  PCR primer for ORF amplification
ggatccagctagcaaaatgtctgttacaggaactgagatc

SEQ ID NO: 7539 - DNA, 40 bp, Artificial Sequence
  PCR primer for ORF amplification
ggatccagctagcaaaatgaaattatccgctctattagct

SEQ ID NO: 7540 - DNA, 40 bp, Artificial Sequence
  PCR primer for ORF amplification
ggatccagctagcaaaatgagtgatcttgacgaagaaagt

SEQ ID NO: 7541 - DNA, 40 bp, Artificial Sequence
  PCR primer for ORF amplification
ggatccagctagcaaaatgccacctctacccgtgctcaac

SEQ ID NO: 7542 - DNA, 40 bp, Artificial Sequence
  PCR primer for ORF amplification
ggatccagctagcaaaatggatttggtcttagaagtcgct

SEQ ID NO: 7543 - DNA, 40 bp, Artificial Sequence
  PCR primer for ORF amplification
ggatccagctagcaaaatggctcaaaattttggaaagatt

SEQ ID NO: 7544 - DNA, 40 bp, Artificial Sequence
  PCR primer for ORF amplification
ggatccagctagcaaaatggctggaaagaaaattgctggt

SEQ ID NO: 7545 - DNA, 40 bp, Artificial Sequence
  PCR primer for ORF amplification
ggatccagctagcaaaatgggaaagaaaaatagaaaggga

SEQ ID NO: 7546 - DNA, 40 bp, Artificial Sequence
  PCR primer for ORF amplification
ggatccagctagcaaaatggtattggctaaacaatgggtt

SEQ ID NO: 7547 - DNA, 40 bp, Artificial Sequence
  PCR primer for ORF amplification
ggatccagctagcaaaatgtcagacgagattgtaaccaac

SEQ ID NO: 7548 - DNA, 40 bp, Artificial Sequence
  PCR primer for ORF amplification
ggatccagctagcaaaatgtctttttttaatcgatcaaat

SEQ ID NO: 7549 - DNA, 40 bp, Artificial Sequence
  PCR primer for ORF amplification
ggatccagctagcaaaatgttgcttatgagacgctttgcc

SEQ ID NO: 7550 - DNA, 40 bp, Artificial Sequence
  PCR primer for ORF amplification
ggatccagctagcaaaatgaattacatggcttatgattat

SEQ ID NO: 7551 - DNA, 40 bp, Artificial Sequence
  PCR primer for ORF amplification
ggatccagctagcaaaatgacgtggatactaagtactggt

SEQ ID NO: 7552 - DNA, 40 bp, Artificial Sequence
  PCR primer for ORF amplification
ggatccagctagcaaaatgactgctgaagaatttgatttt

SEQ ID NO: 7553 - DNA, 40 bp, Artificial Sequence
  PCR primer for ORF amplification
ggatccagctagcaaaatgagtgatcgcaatacaagtaac

SEQ ID NO: 7554 - DNA, 40 bp, Artificial Sequence
  PCR primer for ORF amplification
ggatccagctagcaaaatgcaatcgagcttacctcaattt

SEQ ID NO: 7555 - DNA, 40 bp, Artificial Sequence
  PCR primer for ORF amplification
ggatccagctagcaaaatgctgtggaaaaattatgttcta

SEQ ID NO: 7556 - DNA, 40 bp, Artificial Sequence
  PCR primer for ORF amplification
ggatccagctagcaaaatggcggtgttgtgtggtgtatgc

SEQ ID NO: 7557 - DNA, 40 bp, Artificial Sequence
  PCR primer for ORF amplification
ggatccagctagcaaaatggcgtcagtaacagaacaattc

SEQ ID NO: 7558 - DNA, 40 bp, Artificial Sequence
  PCR primer for ORF amplification
ggatccagctagcaaaatgtaccatgttcctgaaatgagg

SEQ ID NO: 7559 - DNA, 40 bp, Artificial Sequence
  PCR primer for ORF amplification
ggatccagctagcaaaatgtctgaaaaatcagctagcaat

SEQ ID NO: 7560 - DNA, 40 bp, Artificial Sequence
  PCR primer for ORF amplification
ggatccagctagcaaaatgttttccagactgccaacatca

SEQ ID NO: 7561 - DNA, 40 bp, Artificial Sequence
  PCR primer for ORF amplification
ggatccagctagcaaaatgatattaatattattaataata

SEQ ID NO: 7562 - DNA, 40 bp, Artificial Sequence
  PCR primer for ORF amplification
ggatccagctagcaaaatgcaacgcaatagtttagtaaat

SEQ ID NO: 7563 - DNA, 40 bp, Artificial Sequence
  PCR primer for ORF amplification
ggatccagctagcaaaatgcacacaatgcatattccatcc

SEQ ID NO: 7564 - DNA, 40 bp, Artificial Sequence
  PCR primer for ORF amplification
ggatccagctagcaaaatgcacataaatgtgagaggaact

SEQ ID NO: 7565 - DNA, 40 bp, Artificial Sequence
  PCR primer for ORF amplification
ggatccagctagcaaaatgccgcgaattactcaagagata

SEQ ID NO: 7566 - DNA, 40 bp, Artificial Sequence
  PCR primer for ORF amplification
ggatccagctagcaaaatgccttcgacacctagctttgtt

SEQ ID NO: 7567 - DNA, 40 bp, Artificial Sequence
  PCR primer for ORF amplification
ggatccagctagcaaaatggcattcaagttatggctactg

SEQ ID NO: 7568 - DNA, 40 bp, Artificial Sequence
  PCR primer for ORF amplification
ggatccagctagcaaaatgtcaatatcatcaaagataaga

SEQ ID NO: 7569 - DNA, 40 bp, Artificial Sequence
  PCR primer for ORF amplification
ggatccagctagcaaaatgtcatcttccgcccccaaatac

SEQ ID NO: 7570 - DNA, 40 bp, Artificial Sequence
  PCR primer for ORF amplification
ggatccagctagcaaaatgttacgaagatctattcatacc

SEQ ID NO: 7571 - DNA, 40 bp, Artificial Sequence
  PCR primer for ORF amplification
ggatccagctagcaaaatgaaggtatgatttatgatacta

SEQ ID NO: 7572 - DNA, 40 bp, Artificial Sequence
  PCR primer for ORF amplification
ggatccagctagcaaaatgaaactggatagtatagacatt

SEQ ID NO: 7573 - DNA, 40 bp, Artificial Sequence
  PCR primer for ORF amplification
ggatccagctagcaaaatgaaagccggaattgagcttata

SEQ ID NO: 7574 - DNA, 40 bp, Artificial Sequence
  PCR primer for ORF amplification
ggatccagctagcaaaatgaactcatggaacctgagttct

SEQ ID NO: 7575 - DNA, 40 bp, Artificial Sequence
  PCR primer for ORF amplification
ggatccagctagcaaaatgaaggctgtcgtcattgaagac

SEQ ID NO: 7576 - DNA, 40 bp, Artificial Sequence
  PCR primer for ORF amplification
ggatccagctagcaaaatgaatcctaaatcctctacacct

SEQ ID NO: 7577 - DNA, 40 bp, Artificial Sequence
  PCR primer for ORF amplification
ggatccagctagcaaaatgccaggccagataatcagcatt

SEQ ID NO: 7578 - DNA, 40 bp, Artificial Sequence
  PCR primer for ORF amplification
ggatccagctagcaaaatggaattggacgaatgtttagaa

SEQ ID NO: 7579 - DNA, 40 bp, Artificial Sequence
  PCR primer for ORF amplification
ggatccagctagcaaaatggcaagagcgttgagggatata

SEQ ID NO: 7580 - DNA, 40 bp, Artificial Sequence
  PCR primer for ORF amplification
ggatccagctagcaaaatggctagaaccataacttttgat

SEQ ID NO: 7581 - DNA, 40 bp, Artificial Sequence
  PCR primer for ORF amplification
ggatccagctagcaaaatgggtattatcgacaaaatcaaa

SEQ ID NO: 7582 - DNA, 40 bp, Artificial Sequence
  PCR primer for ORF amplification
ggatccagctagcaaaatgtgtggtaggtttgccttagct

SEQ ID NO: 7583 - DNA, 40 bp, Artificial Sequence
  PCR primer for ORF amplification
ggatccagctagcaaaatgttgtcagcagctagattgcaa

SEQ ID NO: 7584 - DNA, 40 bp, Artificial Sequence
  PCR primer for ORF amplification
ggatccagctagcaaaatgaatcagagcgatagcagcttg

SEQ ID NO: 7585 - DNA, 40 bp, Artificial Sequence
  PCR primer for ORF amplification
ggatccagctagcaaaatggatacagatttagatgtgcct

SEQ ID NO: 7586 - DNA, 40 bp, Artificial Sequence
  PCR primer for ORF amplification
ggatccagctagcaaaatggattttacgtctgatacgacg

SEQ ID NO: 7587 - DNA, 40 bp, Artificial Sequence
  PCR primer for ORF amplification
ggatccagctagcaaaatggttgtattcgaaataactata

SEQ ID NO: 7588 - DNA, 40 bp, Artificial Sequence
  PCR primer for ORF amplification
ggatccagctagcaaaatgtatacaaaactaagatctata

SEQ ID NO: 7589 - DNA, 40 bp, Artificial Sequence
  PCR primer for ORF amplification
ggatccagctagcaaaatgtctactacagttgaaaaaatc

SEQ ID NO: 7590 - DNA, 40 bp, Artificial Sequence
  PCR primer for ORF amplification
ggatccagctagcaaaatgttattccctaaacgtctgatt

SEQ ID NO: 7591 - DNA, 40 bp, Artificial Sequence
  PCR primer for ORF amplification
ggatccagctagcaaaatgttgagaaatactttttttaga

SEQ ID NO: 7592 - DNA, 40 bp, Artificial Sequence
  PCR primer for ORF amplification
ggatccagctagcaaaatgaacaattccataattactgat

SEQ ID NO: 7593 - DNA, 40 bp, Artificial Sequence
  PCR primer for ORF amplification
ggatccagctagcaaaatgaagcaaaaatttgtactaccg

SEQ ID NO: 7594 - DNA, 40 bp, Artificial Sequence
  PCR primer for ORF amplification
ggatccagctagcaaaatgaatattcaaagcaataattct

SEQ ID NO: 7595 - DNA, 40 bp, Artificial Sequence
  PCR primer for ORF amplification
ggatccagctagcaaaatgaatcgtgttggtatagacgta

SEQ ID NO: 7596 - DNA, 40 bp, Artificial Sequence
  PCR primer for ORF amplification
ggatccagctagcaaaatgagcagtgccgcaaatgaggga

SEQ ID NO: 7597 - DNA, 40 bp, Artificial Sequence
  PCR primer for ORF amplification
ggatccagctagcaaaatgagtgaatctccaatgttcgct

SEQ ID NO: 7598 - DNA, 40 bp, Artificial Sequence
  PCR primer for ORF amplification
ggatccagctagcaaaatgctcttaggttactgtggcagc

SEQ ID NO: 7599 - DNA, 40 bp, Artificial Sequence
  PCR primer for ORF amplification
ggatccagctagcaaaatggctgaagcaagcatcgaaaag

SEQ ID NO: 7600 - DNA, 40 bp, Artificial Sequence
  PCR primer for ORF amplification
ggatccagctagcaaaatgtcgaaacagtgggcgagtggt

SEQ ID NO: 7601 - DNA, 40 bp, Artificial Sequence
  PCR primer for ORF amplification
ggatccagctagcaaaatgttcattaaaaacgatcacgcc

SEQ ID NO: 7602 - DNA, 40 bp, Artificial Sequence
  PCR primer for ORF amplification
ggatccagctagcaaaatgactagacctaaaacttttttt

SEQ ID NO: 7603 - DNA, 40 bp, Artificial Sequence
  PCR primer for ORF amplification
ggatccagctagcaaaatgtacaagaactattattcaaac

SEQ ID NO: 7604 - DNA, 40 bp, Artificial Sequence
  PCR primer for ORF amplification
ggatccagctagcaaaatgtggaatcctattttactagat

SEQ ID NO: 7605 - DNA, 40 bp, Artificial Sequence
  PCR primer for ORF amplification
ggatccagctagcaaaatgtttagatctgttgctactaga

SEQ ID NO: 7606 - DNA, 40 bp, Artificial Sequence
  PCR primer for ORF amplification
ggatccagctagcaaaatgtctttaccagctacttttgat

SEQ ID NO: 7607 - DNA, 40 bp, Artificial Sequence
  PCR primer for ORF amplification
ggatccagctagcaaaatgaaatgcagggtatggtcagag

SEQ ID NO: 7608 - DNA, 40 bp, Artificial Sequence
  PCR primer for ORF amplification
ggatccagctagcaaaatgcaaacgatttctggagtctta

SEQ ID NO: 7609 - DNA, 40 bp, Artificial Sequence
  PCR primer for ORF amplification
ggatccagctagcaaaatgctactaaatgtaacgtcttcg

SEQ ID NO: 7610 - DNA, 40 bp, Artificial Sequence
  PCR primer for ORF amplification
ggatccagctagcaaaatgtttagaatagctaaaaacctc

SEQ ID NO: 7611 - DNA, 40 bp, Artificial Sequence
  PCR primer for ORF amplification
ggatccagctagcaaaatgtttatttggcagagaaagagt

SEQ ID NO: 7612 - DNA, 40 bp, Artificial Sequence
  PCR primer for ORF amplification
ggatccagctagcaaaatgaacgtcatagatttaagtgat

SEQ ID NO: 7613 - DNA, 40 bp, Artificial Sequence
  PCR primer for ORF amplification
ggatccagctagcaaaatgaatggcgagagactgcttgct

SEQ ID NO: 7614 - DNA, 40 bp, Artificial Sequence
  PCR primer for ORF amplification
ggatccagctagcaaaatgacacagactgataatcctgtc

SEQ ID NO: 7615 - DNA, 40 bp, Artificial Sequence
  PCR primer for ORF amplification
ggatccagctagcaaaatgactattgatggagacgtacat

SEQ ID NO: 7616 - DNA, 40 bp, Artificial Sequence
  PCR primer for ORF amplification
ggatccagctagcaaaatgatgccagctaacgaagataaa

SEQ ID NO: 7617 - DNA, 40 bp, Artificial Sequence
  PCR primer for ORF amplification
ggatccagctagcaaaatggctgccgtcacattacatcta

SEQ ID NO: 7618 - DNA, 40 bp, Artificial Sequence
  PCR primer for ORF amplification
ggatccagctagcaaaatggctgtcggtggtaataactgg

SEQ ID NO: 7619 - DNA, 40 bp, Artificial Sequence
  PCR primer for ORF amplification
ggatccagctagcaaaatgggttatattttgacaggatat

SEQ ID NO: 7620 - DNA, 40 bp, Artificial Sequence
  PCR primer for ORF amplification
ggatccagctagcaaaatgtcgttgaatatacatatcaag

SEQ ID NO: 7621 - DNA, 40 bp, Artificial Sequence
  PCR primer for ORF amplification
ggatccagctagcaaaatgttttccgctcaaaagccaata

SEQ ID NO: 7622 - DNA, 40 bp, Artificial Sequence
  PCR primer for ORF amplification
ggatccagctagcaaaatgaggatacagtcgctttttgtt

SEQ ID NO: 7623 - DNA, 40 bp, Artificial Sequence
  PCR primer for ORF amplification
ggatccagctagcaaaatggctctatcatggaatattcga

SEQ ID NO: 7624 - DNA, 40 bp, Artificial Sequence
  PCR primer for ORF amplification
ggatccagctagcaaaatgggggaagagattagacttttg

SEQ ID NO: 7625 - DNA, 40 bp, Artificial Sequence
  PCR primer for ORF amplification
ggatccagctagcaaaatgtcactaatggacaattggaag

SEQ ID NO: 7626 - DNA, 40 bp, Artificial Sequence
  PCR primer for ORF amplification
ggatccagctagcaaaatgtctgccaatgatttcaagcct

SEQ ID NO: 7627 - DNA, 40 bp, Artificial Sequence
  PCR primer for ORF amplification
ggatccagctagcaaaatgtttgcaaacgttggatttaga

SEQ ID NO: 7628 - DNA, 40 bp, Artificial Sequence
  PCR primer for ORF amplification
ggatccagctagcaaaatgattttcaatccggtcatatca

SEQ ID NO: 7629 - DNA, 40 bp, Artificial Sequence; identical to SEQ ID NO: 7628
  PCR primer for ORF amplification

SEQ ID NO: 7630 - DNA, 40 bp, Artificial Sequence
  PCR primer for ORF amplification
ggatccagctagcaaaatgaatatggcagaacgtgcagaa

SEQ ID NO: 7631 - DNA, 40 bp, Artificial Sequence
  PCR primer for ORF amplification
ggatccagctagcaaaatgagtttttatcaaccatcccta

SEQ ID NO: 7632 - DNA, 40 bp, Artificial Sequence
  PCR primer for ORF amplification
ggatccagctagcaaaatgatgtctactatctaccgtcat

SEQ ID NO: 7633 - DNA, 40 bp, Artificial Sequence
  PCR primer for ORF amplification
ggatccagctagcaaaatgcccacgatgatcaaaaaggat

SEQ ID NO: 7634 - DNA, 40 bp, Artificial Sequence
  PCR primer for ORF amplification
ggatccagctagcaaaatgctcagatatcatatgcaaggt

SEQ ID NO: 7635 - DNA, 40 bp, Artificial Sequence
  PCR primer for ORF amplification
ggatccagctagcaaaatgcttaaagtgaataacgttttc

SEQ ID NO: 7636 - DNA, 40 bp, Artificial Sequence
  PCR primer for ORF amplification
ggatccagctagcaaaatgtctacggaagagcagaatggt

SEQ ID NO: 7637 - DNA, 40 bp, Artificial Sequence
  PCR primer for ORF amplification
ggatccagctagcaaaatgttgagaacgtcaacattgttc

SEQ ID NO: 7638 - DNA, 40 bp, Artificial Sequence
  PCR primer for ORF amplification
ggatccagctagcaaaatgaaacacaatcgtccaaatggt

SEQ ID NO: 7639 - DNA, 40 bp, Artificial Sequence
  PCR primer for ORF amplification
ggatccagctagcaaaatgaagaaggagttgaaaattctt

SEQ ID NO: 7640 - DNA, 40 bp, Artificial Sequence
  PCR primer for ORF amplification
ggatccagctagcaaaatgaaggacctaaatccagaaatg

SEQ ID NO: 7641 - DNA, 40 bp, Artificial Sequence
  PCR primer for ORF amplification
ggatccagctagcaaaatgacatccgatcctgttaatacg

SEQ ID NO: 7642 - DNA, 40 bp, Artificial Sequence
  PCR primer for ORF amplification
ggatccagctagcaaaatgaccttggcacccctagacgcc

SEQ ID NO: 7643 - DNA, 40 bp, Artificial Sequence
  PCR primer for ORF amplification
ggatccagctagcaaaatgactgacttgtttaaacctcta

SEQ ID NO: 7644 - DNA, 40 bp, Artificial Sequence
  PCR primer for ORF amplification
ggatccagctagcaaaatgagcaacgttactacgccgtgg

SEQ ID NO: 7645 - DNA, 40 bp, Artificial Sequence
  PCR primer for ORF amplification
ggatccagctagcaaaatgcaagttgcaattccagaaacc

SEQ ID NO: 7646 - DNA, 40 bp, Artificial Sequence
  PCR primer for ORF amplification
ggatccagctagcaaaatggctaaaaagagtaactcaaag

SEQ ID NO: 7647 - DNA, 40 bp, Artificial Sequence
  PCR primer for ORF amplification
ggatccagctagcaaaatgtcaacgtttgggaaactgttc

SEQ ID NO: 7648 - DNA, 40 bp, Artificial Sequence
  PCR primer for ORF amplification
ggatccagctagcaaaatgtccgatctcgttaccaagttc

SEQ ID NO: 7649 - DNA, 40 bp, Artificial Sequence
  PCR primer for ORF amplification
ggatccagctagcaaaatgtccgcctcgattccagaaacc

SEQ ID NO: 7650 - DNA, 40 bp, Artificial Sequence
  PCR primer for ORF amplification
ggatccagctagcaaaatgtcgaagggaaaggttttgctg

SEQ ID NO: 7651 - DNA, 40 bp, Artificial Sequence
  PCR primer for ORF amplification
ggatccagctagcaaaatgtcttataaattcggcaaactt

SEQ ID NO: 7652 - DNA, 40 bp, Artificial Sequence
  PCR primer for ORF amplification
ggatccagctagcaaaatgtgcgccaatatccccgaattc

SEQ ID NO: 7653 - DNA, 40 bp, Artificial Sequence
  PCR primer for ORF amplification
ggatccagctagcaaaatgtgtcaagctaccaatggcccg

SEQ ID NO: 7654 - DNA, 40 bp, Artificial Sequence
  PCR primer for ORF amplification
ggatccagctagcaaaatgttgtctttcacaaccaagaat

SEQ ID NO: 7655 - DNA, 40 bp, Artificial Sequence
  PCR primer for ORF amplification
ggatccagctagcaaaatgagcactattagtaccacaacg

SEQ ID NO: 7656 - DNA, 40 bp, Artificial Sequence
  PCR primer for ORF amplification
ggatccagctagcaaaatgattccaaaattatatatacat

SEQ ID NO: 7657 - DNA, 40 bp, Artificial Sequence
  PCR primer for ORF amplification
ggatccagctagcaaaatgcctaaaaaatccattgaagaa

SEQ ID NO: 7658 - DNA, 40 bp, Artificial Sequence
  PCR primer for ORF amplification
ggatccagctagcaaaatgcctcactcagttacaccatcc

SEQ ID NO: 7659 - DNA, 40 bp, Artificial Sequence
  PCR primer for ORF amplification
ggatccagctagcaaaatggatatggaaattgatgaccct

SEQ ID NO: 7660 - DNA, 40 bp, Artificial Sequence
  PCR primer for ORF amplification
ggatccagctagcaaaatgtcattttccttcggctttact

SEQ ID NO: 7661 - DNA, 40 bp, Artificial Sequence
  PCR primer for ORF amplification
ggatccagctagcaaaatgtcgactagaccccaacctgat

SEQ ID NO: 7662 - DNA, 40 bp, Artificial Sequence
  PCR primer for ORF amplification
ggatccagctagcaaaatgtctaaagggagggtcaatcag

SEQ ID NO: 7663 - DNA, 40 bp, Artificial Sequence
  PCR primer for ORF amplification
ggatccagctagcaaaatgacaattaacacaaagaacata

SEQ ID NO: 7664 - DNA, 40 bp, Artificial Sequence
  PCR primer for ORF amplification
ggatccagctagcaaaatgagaccgaacaaaacaagtctg

SEQ ID NO: 7665 - DNA, 40 bp, Artificial Sequence
  PCR primer for ORF amplification
ggatccagctagcaaaatgccagtaaagttaaggtggcct

SEQ ID NO: 7666 - DNA, 40 bp, Artificial Sequence
  PCR primer for ORF amplification
ggatccagctagcaaaatggtggacttgtcaacagctttg

SEQ ID NO: 7667 - DNA, 40 bp, Artificial Sequence
  PCR primer for ORF amplification
ggatccagctagcaaaatgaaagagaatgaacttaaaaat

SEQ ID NO: 7668 - DNA, 40 bp, Artificial Sequence
  PCR primer for ORF amplification
ggatccagctagcaaaatgaaaagtttacaaacactatgt

SEQ ID NO: 7669 - DNA, 40 bp, Artificial Sequence
  PCR primer for ORF amplification
ggatccagctagcaaaatgaaagaaaatgaacttaaaaat

SEQ ID NO: 7670 - DNA, 40 bp, Artificial Sequence
  PCR primer for ORF amplification
ggatccagctagcaaaatgactgcaccacacagaagtact

SEQ ID NO: 7671 - DNA, 40 bp, Artificial Sequence
  PCR primer for ORF amplification
ggatccagctagcaaaatgagtatttttttcaagccgccg

SEQ ID NO: 7672 - DNA, 40 bp, Artificial Sequence
  PCR primer for ORF amplification
ggatccagctagcaaaatgtcgaataagcaggcggttctg

SEQ ID NO: 7673 - DNA, 40 bp, Artificial Sequence
  PCR primer for ORF amplification
ggatccagctagcaaaatgtgcgattctcctgcaacgact

SEQ ID NO: 7674 - DNA, 40 bp, Artificial Sequence
  PCR primer for ORF amplification
ggatccagctagcaaaatgtttagtaacagactaccacct

SEQ ID NO: 7675 - DNA, 40 bp, Artificial Sequence
  PCR primer for ORF amplification
ggatccagctagcaaaatgaattgtatccctagtccaatt

SEQ ID NO: 7676 - DNA, 40 bp, Artificial Sequence
  PCR primer for ORF amplification
ggatccagctagcaaaatgagagaggaaagtaggtctagg

SEQ ID NO: 7677 - DNA, 40 bp, Artificial Sequence
  PCR primer for ORF amplification
ggatccagctagcaaaatgcttcccacattcaaacgttac

SEQ ID NO: 7678 - DNA, 40 bp, Artificial Sequence
  PCR primer for ORF amplification
ggatccagctagcaaaatggaattcgttgcagaaagggct

SEQ ID NO: 7679 - DNA, 40 bp, Artificial Sequence
  PCR primer for ORF amplification
ggatccagctagcaaaatggatggagccaaatttgaaaat

SEQ ID NO: 7680 - DNA, 40 bp, Artificial Sequence
  PCR primer for ORF amplification
ggatccagctagcaaaatggccaagaaagttgccatctgt

SEQ ID NO: 7681 - DNA, 40 bp, Artificial Sequence
  PCR primer for ORF amplification
ggatccagctagcaaaatgtccatcaacctacattccgca

SEQ ID NO: 7682 - DNA, 40 bp, Artificial Sequence
  PCR primer for ORF amplification
ggatccagctagcaaaatgtccgaggcgactttgctatct

SEQ ID NO: 7683 - DNA, 40 bp, Artificial Sequence
  PCR primer for ORF amplification
ggatccagctagcaaaatgtctagcaaatggtttaatgct

SEQ ID NO: 7684 - DNA, 40 bp, Artificial Sequence; identical to SEQ ID NO: 7667
  PCR primer for ORF amplification

SEQ ID NO: 7685 - DNA, 40 bp, Artificial Sequence; identical to SEQ ID NO: 7667
  PCR primer for ORF amplification

SEQ ID NO: 7686 - DNA, 40 bp, Artificial Sequence
  PCR primer for ORF amplification
ggatccagctagcaaaatgaaagagaatgaagtcaaagat

SEQ ID NO: 7687 - DNA, 40 bp, Artificial Sequence
  PCR primer for ORF amplification
ggatccagctagcaaaatgaaaagcgattcagttgaaatc

SEQ ID NO: 7688 - DNA, 40 bp, Artificial Sequence
  PCR primer for ORF amplification
ggatccagctagcaaaatgaattataataactttgaaaat

SEQ ID NO: 7689 - DNA, 40 bp, Artificial Sequence
  PCR primer for ORF amplification
ggatccagctagcaaaatgcagattttcgtcaagactttg

SEQ ID NO: 7690 - DNA, 40 bp, Artificial Sequence
  PCR primer for ORF amplification
ggatccagctagcaaaatgctgctggaaagattgcacaag

SEQ ID NO: 7691 - DNA, 40 bp, Artificial Sequence
  PCR primer for ORF amplification
ggatccagctagcaaaatggatgttacatttctaaccaaa

SEQ ID NO: 7692 - DNA, 40 bp, Artificial Sequence
  PCR primer for ORF amplification
ggatccagctagcaaaatgtcacagttcttcgaagctgct

SEQ ID NO: 7693 - DNA, 40 bp, Artificial Sequence
  PCR primer for ORF amplification
ggatccagctagcaaaatgtcctctcaagcattcacttca

SEQ ID NO: 7694 - DNA, 40 bp, Artificial Sequence
  PCR primer for ORF amplification
ggatccagctagcaaaatgtcttttagggatgtcctagaa

SEQ ID NO: 7695 - DNA, 40 bp, Artificial Sequence
  PCR primer for ORF amplification
ggatccagctagcaaaatgttgaaacgatcatctctaata

SEQ ID NO: 7696 - DNA, 40 bp, Artificial Sequence
  PCR primer for ORF amplification
ggatccagctagcaaaatgaataataacagcagaaacaac

SEQ ID NO: 7697 - DNA, 40 bp, Artificial Sequence
  PCR primer for ORF amplification
ggatccagctagcaaaatgagaaaagaattaaaatacctt

SEQ ID NO: 7698 - DNA, 40 bp, Artificial Sequence
  PCR primer for ORF amplification
ggatccagctagcaaaatgagagctttggcatatttcaag

SEQ ID NO: 7699 - DNA, 40 bp, Artificial Sequence
  PCR primer for ORF amplification
ggatccagctagcaaaatgaggaggactttttctcagtta

SEQ ID NO: 7700 - DNA, 40 bp, Artificial Sequence
  PCR primer for ORF amplification
ggatccagctagcaaaatgcctaaaaagcaaacgaatttc

SEQ ID NO: 7701 - DNA, 40 bp, Artificial Sequence
  PCR primer for ORF amplification
ggatccagctagcaaaatggcaagtaaccagcacatagga

SEQ ID NO: 7702 - DNA, 40 bp, Artificial Sequence
  PCR primer for ORF amplification
ggatccagctagcaaaatggccggtacatttttattcact

SEQ ID NO: 7703 - DNA, 40 bp, Artificial Sequence
  PCR primer for ORF amplification
ggatccagctagcaaaatgggtattaaaggtttgaatgca

SEQ ID NO: 7704 - DNA, 40 bp, Artificial Sequence
  PCR primer for ORF amplification
ggatccagctagcaaaatgtcttccgttactgggttttac

SEQ ID NO: 7705 - DNA, 40 bp, Artificial Sequence; identical to SEQ ID NO: 7667
  PCR primer for ORF amplification

SEQ ID NO: 7706 - DNA, 40 bp, Artificial Sequence; identical to SEQ ID NO: 7686
  PCR primer for ORF amplification

SEQ ID NO: 7707 - DNA, 40 bp, Artificial Sequence
  PCR primer for ORF amplification
ggatccagctagcaaaatgactagtgcaagtattaccaat

SEQ ID NO: 7708 - DNA, 40 bp, Artificial Sequence
  PCR primer for ORF amplification
ggatccagctagcaaaatgagtgaaacagaattgagaaaa

SEQ ID NO: 7709 - DNA, 40 bp, Artificial Sequence
  PCR primer for ORF amplification
ggatccagctagcaaaatgattgtttcatttggtgatgca

SEQ ID NO: 7710 - DNA, 40 bp, Artificial Sequence
  PCR primer for ORF amplification
ggatccagctagcaaaatgcaaaaccctccgttgattcgt

SEQ ID NO: 7711 - DNA, 40 bp, Artificial Sequence
  PCR primer for ORF amplification
ggatccagctagcaaaatggcaggattgaagacatttgat

SEQ ID NO: 7712 - DNA, 40 bp, Artificial Sequence
  PCR primer for ORF amplification
ggatccagctagcaaaatggctgcaagtgagataatgaac

SEQ ID NO: 7713 - DNA, 40 bp, Artificial Sequence
  PCR primer for ORF amplification
ggatccagctagcaaaatggtcgtgacatttttgcaggac

SEQ ID NO: 7714 - DNA, 40 bp, Artificial Sequence
  PCR primer for ORF amplification
ggatccagctagcaaaatgtcaacaaattgtttttccggt

SEQ ID NO: 7715 - DNA, 40 bp, Artificial Sequence
  PCR primer for ORF amplification
ggatccagctagcaaaatgaacaaaacgaattggaaggta

SEQ ID NO: 7716 - DNA, 40 bp, Artificial Sequence
  PCR primer for ORF amplification
ggatccagctagcaaaatggaccagctaagtgacagctat

SEQ ID NO: 7717 - DNA, 40 bp, Artificial Sequence
  PCR primer for ORF amplification
ggatccagctagcaaaatggttacatatgctggaaaactg

SEQ ID NO: 7718 - DNA, 40 bp, Artificial Sequence
  PCR primer for ORF amplification
ggatccagctagcaaaatgtcattttccaattctaaagac

SEQ ID NO: 7719 - DNA, 40 bp, Artificial Sequence
  PCR primer for ORF amplification
ggatccagctagcaaaatgtccaagagcaaaactttctta

SEQ ID NO: 7720 - DNA, 40 bp, Artificial Sequence
  PCR primer for ORF amplification
ggatccagctagcaaaatgtccactgctgtgacttttttt

SEQ ID NO: 7721 - DNA, 40 bp, Artificial Sequence
  PCR primer for ORF amplification
ggatccagctagcaaaatgtcgactaatacttccaagact

SEQ ID NO: 7722 - DNA, 40 bp, Artificial Sequence
  PCR primer for ORF amplification
ggatccagctagcaaaatgaaactaagggcagaagacgtg

SEQ ID NO: 7723 - DNA, 40 bp, Artificial Sequence
  PCR primer for ORF amplification
ggatccagctagcaaaatgaatcaggaagacaacacgggc

SEQ ID NO: 7724 - DNA, 40 bp, Artificial Sequence
  PCR primer for ORF amplification
ggatccagctagcaaaatgactaaatctgtagatacgctg

SEQ ID NO: 7725 - DNA, 40 bp, Artificial Sequence
  PCR primer for ORF amplification
ggatccagctagcaaaatgagctccgttaacgcaaatgga

SEQ ID NO: 7726 - DNA, 40 bp, Artificial Sequence
  PCR primer for ORF amplification
ggatccagctagcaaaatgagtctcagcacaatcatatgt

SEQ ID NO: 7727 - DNA, 40 bp, Artificial Sequence
  PCR primer for ORF amplification
ggatccagctagcaaaatggatacagggagtgcgagcata

SEQ ID NO: 7728 - DNA, 40 bp, Artificial Sequence
  PCR primer for ORF amplification
ggatccagctagcaaaatggcttggtctggtggtaaggat

SEQ ID NO: 7729 - DNA, 40 bp, Artificial Sequence
  PCR primer for ORF amplification
ggatccagctagcaaaatggtttttgatttgaaaagaatt

SEQ ID NO: 7730 - DNA, 40 bp, Artificial Sequence
  PCR primer for ORF amplification
ggatccagctagcaaaatgtcacaagaaacaaaaatgcta

SEQ ID NO: 7731 - DNA, 40 bp, Artificial Sequence
  PCR primer for ORF amplification
ggatccagctagcaaaatgtctgcaaacggcaagatctct

SEQ ID NO: 7732 - DNA, 40 bp, Artificial Sequence
  PCR primer for ORF amplification
ggatccagctagcaaaatgttacgagtttctgaaaatggt

SEQ ID NO: 7733 - DNA, 40 bp, Artificial Sequence
  PCR primer for ORF amplification
ggatccagctagcaaaatgaaggttattagtctgaaaaag

SEQ ID NO: 7734 - DNA, 40 bp, Artificial Sequence
  PCR primer for ORF amplification
ggatccagctagcaaaatgcgtctctctaacctaattgct

SEQ ID NO: 7735 - DNA, 40 bp, Artificial Sequence
  PCR primer for ORF amplification
ggatccagctagcaaaatggtcaacttgaacactatccca

SEQ ID NO: 7736 - DNA, 40 bp, Artificial Sequence
  PCR primer for ORF amplification
ggatccagctagcaaaatgtcatccacagcagtaccacga

SEQ ID NO: 7737 - DNA, 40 bp, Artificial Sequence
  PCR primer for ORF amplification
ggatccagctagcaaaatgtccgccgctactgttggtaaa

SEQ ID NO: 7738 - DNA, 40 bp, Artificial Sequence
  PCR primer for ORF amplification
ggatccagctagcaaaatgactgaattcgaattgcctcca

SEQ ID NO: 7739 - DNA, 40 bp, Artificial Sequence
  PCR primer for ORF amplification
ggatccagctagcaaaatgagcaatgtggctggggaattg

SEQ ID NO: 7740 - DNA, 40 bp, Artificial Sequence
  PCR primer for ORF amplification
ggatccagctagcaaaatgagcactgcaactacaacagtt

SEQ ID NO: 7741 - DNA, 40 bp, Artificial Sequence
  PCR primer for ORF amplification
ggatccagctagcaaaatgagtaacggtgcgtttgatgct

SEQ ID NO: 7742 - DNA, 40 bp, Artificial Sequence
  PCR primer for ORF amplification
ggatccagctagcaaaatgagtgaacttgaagccacaatt

SEQ ID NO: 7743 - DNA, 40 bp, Artificial Sequence
  PCR primer for ORF amplification
ggatccagctagcaaaatggaacagaacaggttcaagaaa

SEQ ID NO: 7744 - DNA, 40 bp, Artificial Sequence
  PCR primer for ORF amplification
ggatccagctagcaaaatggacggtagaaatgaaaaacca

SEQ ID NO: 7745 - DNA, 40 bp, Artificial Sequence
  PCR primer for ORF amplification
ggatccagctagcaaaatggactctattcaagaatcagat

SEQ ID NO: 7746 - DNA, 40 bp, Artificial Sequence
  PCR primer for ORF amplification
ggatccagctagcaaaatgggtgttagtgcaaatttgttc

SEQ ID NO: 7747 - DNA, 40 bp, Artificial Sequence
  PCR primer for ORF amplification
ggatccagctagcaaaatgtccgatatcaacgaaaaactc

SEQ ID NO: 7748 - DNA, 40 bp, Artificial Sequence
  PCR primer for ORF amplification
ggatccagctagcaaaatgtctcacagaaagtacgaagca

SEQ ID NO: 7749 - DNA, 40 bp, Artificial Sequence
  PCR primer for ORF amplification
ggatccagctagcaaaatgtctgcaccaactccattagca

SEQ ID NO: 7750 - DNA, 40 bp, Artificial Sequence
  PCR primer for ORF amplification
ggatccagctagcaaaatgggtatgtttttattatatcgc

SEQ ID NO: 7751 - DNA, 40 bp, Artificial Sequence
  PCR primer for ORF amplification
ggatccagctagcaaaatgaattgcacacttacagataat

SEQ ID NO: 7752 - DNA, 40 bp, Artificial Sequence
  PCR primer for ORF amplification
ggatccagctagcaaaatggcaaattcgccgaaaaagcca

SEQ ID NO: 7753 - DNA, 40 bp, Artificial Sequence
  PCR primer for ORF amplification
ggatccagctagcaaaatgcgtttttcaaatttcctaact

SEQ ID NO: 7754 - DNA, 40 bp, Artificial Sequence
  PCR primer for ORF amplification
ggatccagctagcaaaatggctagttattctttagttgaa

SEQ ID NO: 7755 - DNA, 40 bp, Artificial Sequence
  PCR primer for ORF amplification
ggatccagctagcaaaatgtcaagctcaatacctagagtt

SEQ ID NO: 7756 - DNA, 40 bp, Artificial Sequence
  PCR primer for ORF amplification
ggatccagctagcaaaatgtctctactaggcgccaggtcc

SEQ ID NO: 7757 - DNA, 40 bp, Artificial Sequence
  PCR primer for ORF amplification
ggatccagctagcaaaatgggcatagttttgaaaagagca

SEQ ID NO: 7758 - DNA, 40 bp, Artificial Sequence
  PCR primer for ORF amplification
ggatccagctagcaaaatgttaggactgaaagggtgtcta

SEQ ID NO: 7759 - DNA, 40 bp, Artificial Sequence
  PCR primer for ORF amplification
ggatccagctagcaaaatggaaaataccacgaatcgtaat

SEQ ID NO: 7760 - DNA, 40 bp, Artificial Sequence
  PCR primer for ORF amplification
ggatccagctagcaaaatggtaaaggagacggagtattat

SEQ ID NO: 7761 - DNA, 40 bp, Artificial Sequence
  PCR primer for ORF amplification
ggatccagctagcaaaatggtttcattgttcaaaagaggt

SEQ ID NO: 7762 - DNA, 40 bp, Artificial Sequence
  PCR primer for ORF amplification
ggatccagctagcaaaatgtctgctgctgctgatagatta

SEQ ID NO: 7763 - DNA, 40 bp, Artificial Sequence
  PCR primer for ORF amplification
ggatccagctagcaaaatgagatttcacgatagtatactt

SEQ ID NO: 7764 - DNA, 40 bp, Artificial Sequence
  PCR primer for ORF amplification
ggatccagctagcaaaatgcctctgtcacaaaaacaaata

SEQ ID NO: 7765 - DNA, 40 bp, Artificial Sequence
  PCR primer for ORF amplification
ggatccagctagcaaaatggcagacacaccctctgtggca

SEQ ID NO: 7766 - DNA, 40 bp, Artificial Sequence
  PCR primer for ORF amplification
ggatccagctagcaaaatggccttatttaacgtagaaggt

SEQ ID NO: 7767 - DNA, 40 bp, Artificial Sequence
  PCR primer for ORF amplification
ggatccagctagcaaaatggctactgcgttatatactgca

SEQ ID NO: 7768 - DNA, 40 bp, Artificial Sequence
  PCR primer for ORF amplification
ggatccagctagcaaaatgtccaactttaagaattttact

SEQ ID NO: 7769 - DNA, 40 bp, Artificial Sequence
  PCR primer for ORF amplification
ggatccagctagcaaaatgtctgatatgcttccattggct

SEQ ID NO: 7770 - DNA, 40 bp, Artificial Sequence
  PCR primer for ORF amplification
ggatccagctagcaaaatgaataggaatacgactaccaat

SEQ ID NO: 7771 - DNA, 40 bp, Artificial Sequence
  PCR primer for ORF amplification
ggatccagctagcaaaatgacggatattcaactaaatgga

SEQ ID NO: 7772 - DNA, 40 bp, Artificial Sequence
  PCR primer for ORF amplification
ggatccagctagcaaaatgagtagcagtggtgtttatacg

SEQ ID NO: 7773 - DNA, 40 bp, Artificial Sequence
  PCR primer for ORF amplification
ggatccagctagcaaaatgattcaagatccccttgtatat

SEQ ID NO: 7774 - DNA, 40 bp, Artificial Sequence
  PCR primer for ORF amplification
ggatccagctagcaaaatgctttccagaacaatccgtaca

SEQ ID NO: 7775 - DNA, 40 bp, Artificial Sequence
  PCR primer for ORF amplification
ggatccagctagcaaaatggcgaactcattagacagactg

SEQ ID NO: 7776 - DNA, 40 bp, Artificial Sequence
  PCR primer for ORF amplification
ggatccagctagcaaaatggcgaagattatgatcccagct

SEQ ID NO: 7777 - DNA, 40 bp, Artificial Sequence
  PCR primer for ORF amplification
ggatccagctagcaaaatgggactgatattaaggtggaaa

SEQ ID NO: 7778 - DNA, 40 bp, Artificial Sequence
  PCR primer for ORF amplification
ggatccagctagcaaaatgggtcaattgctttcccatccg

SEQ ID NO: 7779 - DNA, 40 bp, Artificial Sequence
  PCR primer for ORF amplification
ggatccagctagcaaaatggtgtcgaaggatcaaacgtcc

SEQ ID NO: 7780 - DNA, 40 bp, Artificial Sequence
  PCR primer for ORF amplification
ggatccagctagcaaaatgtcatcaagaataattgtcggc

SEQ ID NO: 7781 - DNA, 40 bp, Artificial Sequence
  PCR primer for ORF amplification
ggatccagctagcaaaatgtcctgttctcaaaataagact

SEQ ID NO: 7782 - DNA, 40 bp, Artificial Sequence
  PCR primer for ORF amplification
ggatccagctagcaaaatgtctagtgtaccttataattcc

SEQ ID NO: 7783 - DNA, 40 bp, Artificial Sequence
  PCR primer for ORF amplification
ggatccagctagcaaaatgtctctggatcgtgtagattgg

SEQ ID NO: 7784 - DNA, 40 bp, Artificial Sequence
  PCR primer for ORF amplification
ggatccagctagcaaaatgttgcagagacattccttgaag

SEQ ID NO: 7785 - DNA, 40 bp, Artificial Sequence
  PCR primer for ORF amplification
ggatccagctagcaaaatgttggtgctagggtctcttaga

SEQ ID NO: 7786 - DNA, 40 bp, Artificial Sequence
  PCR primer for ORF amplification
ggatccagctagcaaaatgtttaataatcatgaaattgac

SEQ ID NO: 7787 - DNA, 40 bp, Artificial Sequence
  PCR primer for ORF amplification
ggatccagctagcaaaatgaattacctgcgagatagattt

SEQ ID NO: 7788 - DNA, 40 bp, Artificial Sequence
  PCR primer for ORF amplification
ggatccagctagcaaaatgactctacaagaatctgataaa

SEQ ID NO: 7789 - DNA, 40 bp, Artificial Sequence
  PCR primer for ORF amplification
ggatccagctagcaaaatgacttcacaattgaatgaatta

SEQ ID NO: 7790 - DNA, 40 bp, Artificial Sequence
  PCR primer for ORF amplification
ggatccagctagcaaaatgagtcagtttggcacgacagat

SEQ ID NO: 7791 - DNA, 40 bp, Artificial Sequence
  PCR primer for ORF amplification
ggatccagctagcaaaatgataagcccaagggtgaatact

SEQ ID NO: 7792 - DNA, 40 bp, Artificial Sequence
  PCR primer for ORF amplification
ggatccagctagcaaaatgcagagacacgtttttgcgagg

SEQ ID NO: 7793 - DNA, 40 bp, Artificial Sequence
  PCR primer for ORF amplification
ggatccagctagcaaaatgcctccaaagaagcaagtcgaa

SEQ ID NO: 7794 - DNA, 40 bp, Artificial Sequence
  PCR primer for ORF amplification
ggatccagctagcaaaatggattccacagcacttaaggta

SEQ ID NO: 7795 - DNA, 40 bp, Artificial Sequence
  PCR primer for ORF amplification
ggatccagctagcaaaatggctgaaagtaccacgttagaa

SEQ ID NO: 7796 - DNA, 40 bp, Artificial Sequence
  PCR primer for ORF amplification
ggatccagctagcaaaatgtcctctgctgccacggttgac

SEQ ID NO: 7797 - DNA, 40 bp, Artificial Sequence
  PCR primer for ORF amplification
ggatccagctagcaaaatgtggaagattatgcgttcatgg

SEQ ID NO: 7798 - DNA, 40 bp, Artificial Sequence
  PCR primer for ORF amplification
ggatccagctagcaaaatgtggacaaacactttcaaatgg

SEQ ID NO: 7799 - DNA, 40 bp, Artificial Sequence
  PCR primer for ORF amplification
ggatccagctagcaaaatgtctgaaggtattactgatatt

SEQ ID NO: 7800 - DNA, 40 bp, Artificial Sequence; identical to SEQ ID NO: 7799
  PCR primer for ORF amplification

SEQ ID NO: 7801 - DNA, 40 bp, Artificial Sequence
  PCR primer for ORF amplification
ggatccagctagcaaaatgcctgttgaaaaagatttaaaa

SEQ ID NO: 7802 - DNA, 40 bp, Artificial Sequence
  PCR primer for ORF amplification
ggatccagctagcaaaatggagcatgtagattccgatttt

SEQ ID NO: 7803 - DNA, 40 bp, Artificial Sequence
  PCR primer for ORF amplification
ggatccagctagcaaaatggatcccaccaaagcacccgat

SEQ ID NO: 7804 - DNA, 40 bp, Artificial Sequence
  PCR primer for ORF amplification
ggatccagctagcaaaatgtcactttctcttgtatcgtac

SEQ ID NO: 7805 - DNA, 40 bp, Artificial Sequence
  PCR primer for ORF amplification
ggatccagctagcaaaatgtctgctacatcttcaagtggt

SEQ ID NO: 7806 - DNA, 40 bp, Artificial Sequence
  PCR primer for ORF amplification
ggatccagctagcaaaatgtctttggaaagagaggaacca

SEQ ID NO: 7807 - DNA, 40 bp, Artificial Sequence
  PCR primer for ORF amplification
ggatccagctagcaaaatgtgggggttatgcaagaagcat

SEQ ID NO: 7808 - DNA, 40 bp, Artificial Sequence
  PCR primer for ORF amplification
ggatccagctagcaaaatgttgagaactcaagccgccaga

SEQ ID NO: 7809 - DNA, 40 bp, Artificial Sequence
  PCR primer for ORF amplification
ggatccagctagcaaaatgagtagaatcgatgatttacag

SEQ ID NO: 7810 - DNA, 40 bp, Artificial Sequence
  PCR primer for ORF amplification
ggatccagctagcaaaatgaagcattcccaaaaataccgt

SEQ ID NO: 7811 - DNA, 40 bp, Artificial Sequence
  PCR primer for ORF amplification
ggatccagctagcaaaatgaccgtttacacagcatccgtt

SEQ ID NO: 7812 - DNA, 40 bp, Artificial Sequence
  PCR primer for ORF amplification
ggatccagctagcaaaatgactgtcaccataaaagaattg

SEQ ID NO: 7813 - DNA, 40 bp, Artificial Sequence
  PCR primer for ORF amplification
ggatccagctagcaaaatgaggtttaggagttcttcccat

SEQ ID NO: 7814 - DNA, 40 bp, Artificial Sequence
  PCR primer for ORF amplification
ggatccagctagcaaaatgagtactttcaacagttacagc

SEQ ID NO: 7815 - DNA, 40 bp, Artificial Sequence
  PCR primer for ORF amplification
ggatccagctagcaaaatgattacttcaattgacatagca

SEQ ID NO: 7816 - DNA, 40 bp, Artificial Sequence
  PCR primer for ORF amplification
ggatccagctagcaaaatggccaaaacaacaaaaagagcc

SEQ ID NO: 7817 - DNA, 40 bp, Artificial Sequence
  PCR primer for ORF amplification
ggatccagctagcaaaatgtacgagatgtcaggtatagac

SEQ ID NO: 7818 - DNA, 40 bp, Artificial Sequence
  PCR primer for ORF amplification
ggatccagctagcaaaatgttacagagtatagtcctttcc

SEQ ID NO: 7819 - DNA, 40 bp, Artificial Sequence
  PCR primer for ORF amplification
ggatccagctagcaaaatgctgcatcaaaaaatagctcat

SEQ ID NO: 7820 - DNA, 40 bp, Artificial Sequence
  PCR primer for ORF amplification
ggatccagctagcaaaatggactcgattataccggcaggc

SEQ ID NO: 7821 - DNA, 40 bp, Artificial Sequence
  PCR primer for ORF amplification
ggatccagctagcaaaatgggatttatagcaaatatactg

SEQ ID NO: 7822 - DNA, 40 bp, Artificial Sequence
  PCR primer for ORF amplification
ggatccagctagcaaaatggggttcagaaaaatacttgct

SEQ ID NO: 7823 - DNA, 40 bp, Artificial Sequence
  PCR primer for ORF amplification
ggatccagctagcaaaatgggtggttcttccgattcagac

SEQ ID NO: 7824 - DNA, 40 bp, Artificial Sequence
  PCR primer for ORF amplification
ggatccagctagcaaaatgtccaaagtgtttattgccaca

SEQ ID NO: 7825 - DNA, 40 bp, Artificial Sequence
  PCR primer for ORF amplification
ggatccagctagcaaaatgtcgactgaagaacaaaatgga

SEQ ID NO: 7826 - DNA, 40 bp, Artificial Sequence
  PCR primer for ORF amplification
ggatccagctagcaaaatgtcgcctttgagaaagacggtt

SEQ ID NO: 7827 - DNA, 40 bp, Artificial Sequence
  PCR primer for ORF amplification
ggatccagctagcaaaatgtttagagatagaactaattta

SEQ ID NO: 7828 - DNA, 40 bp, Artificial Sequence
  PCR primer for ORF amplification
ggatccagctagcaaaatgaaattaaaattattaaatata

SEQ ID NO: 7829 - DNA, 40 bp, Artificial Sequence
  PCR primer for ORF amplification
ggatccagctagcaaaatggctttggagggattgcggaaa

SEQ ID NO: 7830 - DNA, 40 bp, Artificial Sequence
  PCR primer for ORF amplification
ggatccagctagcaaaatggttagcttaacctttaaaaat

SEQ ID NO: 7831 - DNA, 40 bp, Artificial Sequence
  PCR primer for ORF amplification
ggatccagctagcaaaatgtatgttgatccgatgaacaac

SEQ ID NO: 7832 - DNA, 40 bp, Artificial Sequence
  PCR primer for ORF amplification
ggatccagctagcaaaatgtcagaagaagacgatcattgg

SEQ ID NO: 7833 - DNA, 40 bp, Artificial Sequence
  PCR primer for ORF amplification
ggatccagctagcaaaatgtctcagaacgtttacattgta

SEQ ID NO: 7834 - DNA, 40 bp, Artificial Sequence
  PCR primer for ORF amplification
ggatccagctagcaaaatgactcccgaacaaaaggccaaa

SEQ ID NO: 7835 - DNA, 40 bp, Artificial Sequence
  PCR primer for ORF amplification
ggatccagctagcaaaatgagcttttattcaaacctaccg

SEQ ID NO: 7836 - DNA, 40 bp, Artificial Sequence
  PCR primer for ORF amplification
ggatccagctagcaaaatgcaaaagatcagtaaatactca

SEQ ID NO: 7837 - DNA, 40 bp, Artificial Sequence
  PCR primer for ORF amplification
ggatccagctagcaaaatgcctaaagagaccccttccaaa

SEQ ID NO: 7838 - DNA, 40 bp, Artificial Sequence
  PCR primer for ORF amplification
ggatccagctagcaaaatgctagccgaaaaaacccgttcc

SEQ ID NO: 7839 - DNA, 40 bp, Artificial Sequence
  PCR primer for ORF amplification
ggatccagctagcaaaatgtcgtttgacagagaagaagac

SEQ ID NO: 7840 - DNA, 40 bp, Artificial Sequence
  PCR primer for ORF amplification
ggatccagctagcaaaatgtttaagaaatacaaaaatcaa

SEQ ID NO: 7841 - DNA, 40 bp, Artificial Sequence
  PCR primer for ORF amplification
ggatccagctagcaaaatgacagcctcatcaaatgacgat

SEQ ID NO: 7842 - DNA, 40 bp, Artificial Sequence
  PCR primer for ORF amplification
ggatccagctagcaaaatgagcagtggttcagcaggggca

SEQ ID NO: 7843 - DNA, 40 bp, Artificial Sequence
  PCR primer for ORF amplification
ggatccagctagcaaaatgccatttgtaaaaggttttgag

SEQ ID NO: 7844 - DNA, 40 bp, Artificial Sequence
  PCR primer for ORF amplification
ggatccagctagcaaaatgccatttgttaaggactttaag

SEQ ID NO: 7845 - DNA, 40 bp, Artificial Sequence
  PCR primer for ORF amplification
ggatccagctagcaaaatggacgagaatgaatttgataat

SEQ ID NO: 7846 - DNA, 40 bp, Artificial Sequence
  PCR primer for ORF amplification
ggatccagctagcaaaatggtttcgtgccaaggaacaagg

SEQ ID NO: 7847 - DNA, 40 bp, Artificial Sequence
  PCR primer for ORF amplification
ggatccagctagcaaaatgtctataatcaaaaaaattgtg

SEQ ID NO: 7848 - DNA, 40 bp, Artificial Sequence
  PCR primer for ORF amplification
ggatccagctagcaaaatgtctcaagttcaagaacaacat

SEQ ID NO: 7849 - DNA, 40 bp, Artificial Sequence
  PCR primer for ORF amplification
ggatccagctagcaaaatgtctgacgatttgagaagaaaa

SEQ ID NO: 7850 - DNA, 40 bp, Artificial Sequence
  PCR primer for ORF amplification
ggatccagctagcaaaatgcgaatcaacagtgagctagcg

SEQ ID NO: 7851 - DNA, 40 bp, Artificial Sequence
  PCR primer for ORF amplification
ggatccagctagcaaaatggaaaaccaagagaaaccgctt

SEQ ID NO: 7852 - DNA, 40 bp, Artificial Sequence
  PCR primer for ORF amplification
ggatccagctagcaaaatggatcccacaagagctccggat

SEQ ID NO: 7853 - DNA, 40 bp, Artificial Sequence
  PCR primer for ORF amplification
ggatccagctagcaaaatggcaaaccctttttcgagatgg

SEQ ID NO: 7854 - DNA, 40 bp, Artificial Sequence
  PCR primer for ORF amplification
ggatccagctagcaaaatggttaaaatgagaagaataaca

SEQ ID NO: 7855 - DNA, 40 bp, Artificial Sequence
  PCR primer for ORF amplification
ggatccagctagcaaaatggttgatttggagcaggaattt

SEQ ID NO: 7856 - DNA, 40 bp, Artificial Sequence
  PCR primer for ORF amplification
ggatccagctagcaaaatggttgggcctggtctgggaatt

SEQ ID NO: 7857 - DNA, 40 bp, Artificial Sequence
  PCR primer for ORF amplification
ggatccagctagcaaaatgatgaaaagattacaccccttg

SEQ ID NO: 7858 - DNA, 40 bp, Artificial Sequence
  PCR primer for ORF amplification
ggatccagctagcaaaatgcgtgagaatgcaatgtctaca

SEQ ID NO: 7859 - DNA, 40 bp, Artificial Sequence
  PCR primer for ORF amplification
ggatccagctagcaaaatgtctagtacagtaatatctaga

SEQ ID NO: 7860 - DNA, 40 bp, Artificial Sequence
  PCR primer for ORF amplification
ggatccagctagcaaaatgttcaaactcacctctcgactc

SEQ ID NO: 7861 - DNA, 40 bp, Artificial Sequence
  PCR primer for ORF amplification
ggatccagctagcaaaatgtttcaacagctgtcggcatcc

SEQ ID NO: 7862 - DNA, 40 bp, Artificial Sequence
  PCR primer for ORF amplification
ggatccagctagcaaaatgaatggaatatttgctattgag

SEQ ID NO: 7863 - DNA, 40 bp, Artificial Sequence
  PCR primer for ORF amplification
ggatccagctagcaaaatgacaatagcgccaatggcaaac

SEQ ID NO: 7864 - DNA, 40 bp, Artificial Sequence
  PCR primer for ORF amplification
ggatccagctagcaaaatgactggcgaagaatggggcttg

SEQ ID NO: 7865 - DNA, 40 bp, Artificial Sequence
  PCR primer for ORF amplification
ggatccagctagcaaaatgcttcgcaacttagtcgtcagg

SEQ ID NO: 7866 - DNA, 40 bp, Artificial Sequence
  PCR primer for ORF amplification
ggatccagctagcaaaatggagatttacattagacttaac

SEQ ID NO: 7867 - DNA, 40 bp, Artificial Sequence
  PCR primer for ORF amplification
ggatccagctagcaaaatgtcagaaacagaactgtcgaaa

SEQ ID NO: 7868 - DNA, 40 bp, Artificial Sequence
  PCR primer for ORF amplification
ggatccagctagcaaaatgtccttaccagctacttttgac

SEQ ID NO: 7869 - DNA, 40 bp, Artificial Sequence
  PCR primer for ORF amplification
ggatccagctagcaaaatgaccattattcagacggttact

SEQ ID NO: 7870 - DNA, 40 bp, Artificial Sequence
  PCR primer for ORF amplification
ggatccagctagcaaaatgcctaacaaagtgtttaacgtg

SEQ ID NO: 7871 - DNA, 40 bp, Artificial Sequence
  PCR primer for ORF amplification
ggatccagctagcaaaatggaggaactaggtttaaaaagc

SEQ ID NO: 7872 - DNA, 40 bp, Artificial Sequence
  PCR primer for ORF amplification
ggatccagctagcaaaatgggaagtttgttgagaccggtt

SEQ ID NO: 7873 - DNA, 40 bp, Artificial Sequence
  PCR primer for ORF amplification
ggatccagctagcaaaatgtactttttaaaccaactaata

SEQ ID NO: 7874 - DNA, 40 bp, Artificial Sequence
  PCR primer for ORF amplification
ggatccagctagcaaaatgtcaactatcaaagttattgag

SEQ ID NO: 7875 - DNA, 40 bp, Artificial Sequence
  PCR primer for ORF amplification
ggatccagctagcaaaatgtcagaagatcaaaaaagtgaa

SEQ ID NO: 7876 - DNA, 40 bp, Artificial Sequence
  PCR primer for ORF amplification
ggatccagctagcaaaatgtctagttcaatatttggccca

SEQ ID NO: 7877 - DNA, 40 bp, Artificial Sequence
  PCR primer for ORF amplification
ggatccagctagcaaaatgtctgaaaatcaacgtttagga

SEQ ID NO: 7878 - DNA, 40 bp, Artificial Sequence
  PCR primer for ORF amplification
ggatccagctagcaaaatgtctgtgcaccacaaaaagaag

SEQ ID NO: 7879 - DNA, 40 bp, Artificial Sequence
  PCR primer for ORF amplification
ggatccagctagcaaaatgaacattggtggaggaaaattt

SEQ ID NO: 7880 - DNA, 40 bp, Artificial Sequence
  PCR primer for ORF amplification
ggatccagctagcaaaatgacagctgctgtaacatcctcc

SEQ ID NO: 7881 - DNA, 40 bp, Artificial Sequence
  PCR primer for ORF amplification
ggatccagctagcaaaatgactaaattgcgaattgctgta

SEQ ID NO: 7882 - DNA, 40 bp, Artificial Sequence
  PCR primer for ORF amplification
ggatccagctagcaaaatgagtcagcaaacaccacaggaa

SEQ ID NO: 7883 - DNA, 40 bp, Artificial Sequence
  PCR primer for ORF amplification
ggatccagctagcaaaatggatacggataagttaatctca

SEQ ID NO: 7884 - DNA, 40 bp, Artificial Sequence
  PCR primer for ORF amplification
ggatccagctagcaaaatgtcaacaacaggtccgttagat

SEQ ID NO: 7885 - DNA, 40 bp, Artificial Sequence
  PCR primer for ORF amplification
ggatccagctagcaaaatgtctattaatatttgtagagat

SEQ ID NO: 7886 - DNA, 40 bp, Artificial Sequence
  PCR primer for ORF amplification
ggatccagctagcaaaatgttcagcttgaaagcattattg

SEQ ID NO: 7887 - DNA, 40 bp, Artificial Sequence
  PCR primer for ORF amplification
ggatccagctagcaaaatggaaggtatgaatatgggtagc

SEQ ID NO: 7888 - DNA, 40 bp, Artificial Sequence
  PCR primer for ORF amplification
ggatccagctagcaaaatggatagagtacgctctttgatt

SEQ ID NO: 7889 - DNA, 40 bp, Artificial Sequence
  PCR primer for ORF amplification
ggatccagctagcaaaatggcagctgatagagataatttt

SEQ ID NO: 7890 - DNA, 40 bp, Artificial Sequence
  PCR primer for ORF amplification
ggatccagctagcaaaatggcttccaagaaaattaaagtt

SEQ ID NO: 7891 - DNA, 40 bp, Artificial Sequence
  PCR primer for ORF amplification
ggatccagctagcaaaatgggcgacgaattacacaaccgt

SEQ ID NO: 7892 - DNA, 40 bp, Artificial Sequence
  PCR primer for ORF amplification
ggatccagctagcaaaatgtcgcttggtataccactttcc

SEQ ID NO: 7893 - DNA, 40 bp, Artificial Sequence
  PCR primer for ORF amplification
ggatccagctagcaaaatgagtgctgccactgcgactgct

SEQ ID NO: 7894 - DNA, 40 bp, Artificial Sequence
  PCR primer for ORF amplification
ggatccagctagcaaaatgatatcaataaaaggaaccgga

SEQ ID NO: 7895 - DNA, 40 bp, Artificial Sequence
  PCR primer for ORF amplification
ggatccagctagcaaaatgcaaatagtcagaagttgtaac

SEQ ID NO: 7896 - DNA, 40 bp, Artificial Sequence
  PCR primer for ORF amplification
ggatccagctagcaaaatgcctttgaatattattgggacg

SEQ ID NO: 7897 - DNA, 40 bp, Artificial Sequence
  PCR primer for ORF amplification
ggatccagctagcaaaatggagacatacgagactagcatt

SEQ ID NO: 7898 - DNA, 40 bp, Artificial Sequence
  PCR primer for ORF amplification
ggatccagctagcaaaatggcggttgcgatcaaaaaggag

SEQ ID NO: 7899 - DNA, 40 bp, Artificial Sequence
  PCR primer for ORF amplification
ggatccagctagcaaaatggctaccttgcacttcgttcct

SEQ ID NO: 7900 - DNA, 40 bp, Artificial Sequence
  PCR primer for ORF amplification
ggatccagctagcaaaatgtacttggaatatcttcaaccg

SEQ ID NO: 7901 - DNA, 40 bp, Artificial Sequence
  PCR primer for ORF amplification
ggatccagctagcaaaatgaatcaaacaggaaggaccata

SEQ ID NO: 7902 - DNA, 40 bp, Artificial Sequence
  PCR primer for ORF amplification
ggatccagctagcaaaatgagtgacaaatctcatcagata

SEQ ID NO: 7903 - DNA, 40 bp, Artificial Sequence
  PCR primer for ORF amplification
ggatccagctagcaaaatgagtttagaggatacattagcc

SEQ ID NO: 7904 - DNA, 40 bp, Artificial Sequence
  PCR primer for ORF amplification
ggatccagctagcaaaatgtccaaaatagaagagctacca

SEQ ID NO: 7905 - DNA, 40 bp, Artificial Sequence
  PCR primer for ORF amplification
ggatccagctagcaaaatgtcctttgatagacagttgacc

SEQ ID NO: 7906 - DNA, 40 bp, Artificial Sequence
  PCR primer for ORF amplification
ggatccagctagcaaaatgaccaattcagtaaagactaat

SEQ ID NO: 7907 - DNA, 40 bp, Artificial Sequence
  PCR primer for ORF amplification
ggatccagctagcaaaatgcctttctcttctgagcaattc

SEQ ID NO: 7908 - DNA, 40 bp, Artificial Sequence
  PCR primer for ORF amplification
ggatccagctagcaaaatgggcaatatccttcggaaaggt

SEQ ID NO: 7909 - DNA, 40 bp, Artificial Sequence
  PCR primer for ORF amplification
ggatccagctagcaaaatggtagatggactgaatacctcg

SEQ ID NO: 7910 - DNA, 40 bp, Artificial Sequence
  PCR primer for ORF amplification
ggatccagctagcaaaatggttaaagaaactaagttttac

SEQ ID NO: 7911 - DNA, 40 bp, Artificial Sequence
  PCR primer for ORF amplification
ggatccagctagcaaaatgtccgaagaagtatggaatgga

SEQ ID NO: 7912 - DNA, 40 bp, Artificial Sequence
  PCR primer for ORF amplification
ggatccagctagcaaaatgtctatgatgctaagtaattgg

SEQ ID NO: 7913 - DNA, 40 bp, Artificial Sequence
  PCR primer for ORF amplification
ggatccagctagcaaaatgtttaacatgaatctactttct

SEQ ID NO: 7914 - DNA, 40 bp, Artificial Sequence
  PCR primer for ORF amplification
ggatccagctagcaaaatgagtacagccgatcaagaacaa

SEQ ID NO: 7915 - DNA, 40 bp, Artificial Sequence
  PCR primer for ORF amplification
ggatccagctagcaaaatgctaagtgcaatttccaaagtc

SEQ ID NO: 7916 - DNA, 40 bp, Artificial Sequence
  PCR primer for ORF amplification
ggatccagctagcaaaatggcatctaacgaagttttagtt

SEQ ID NO: 7917 - DNA, 40 bp, Artificial Sequence
  PCR primer for ORF amplification
ggatccagctagcaaaatgtctaccacactactttggttt

SEQ ID NO: 7918 - DNA, 40 bp, Artificial Sequence
  PCR primer for ORF amplification
ggatccagctagcaaaatgttttccatattcaattcacca

SEQ ID NO: 7919 - DNA, 40 bp, Artificial Sequence
  PCR primer for ORF amplification
ggatccagctagcaaaatgacatcagctacggacaaatct

SEQ ID NO: 7920 - DNA, 40 bp, Artificial Sequence
  PCR primer for ORF amplification
ggatccagctagcaaaatgcccagggatccattgattggt

SEQ ID NO: 7921 - DNA, 40 bp, Artificial Sequence
  PCR primer for ORF amplification
ggatccagctagcaaaatgcgtatagcgatgcatctgccg

SEQ ID NO: 7922 - DNA, 40 bp, Artificial Sequence
  PCR primer for ORF amplification
ggatccagctagcaaaatggaagaaaaggaaggtatcaag

SEQ ID NO: 7923 - DNA, 40 bp, Artificial Sequence
  PCR primer for ORF amplification
ggatccagctagcaaaatggactcattatcaaaaaagatt

SEQ ID NO: 7924 - DNA, 40 bp, Artificial Sequence
  PCR primer for ORF amplification
ggatccagctagcaaaatggatgcaactaccccactatta

SEQ ID NO: 7925 - DNA, 40 bp, Artificial Sequence
  PCR primer for ORF amplification
ggatccagctagcaaaatgtcctccgctgcaacaaaagct

SEQ ID NO: 7926 - DNA, 40 bp, Artificial Sequence
  PCR primer for ORF amplification
ggatccagctagcaaaatgtcgttggaagccatcgtcttt

SEQ ID NO: 7927 - DNA, 40 bp, Artificial Sequence
  PCR primer for ORF amplification
ggatccagctagcaaaatgtctgatttgttaccactagct

SEQ ID NO: 7928 - DNA, 40 bp, Artificial Sequence
  PCR primer for ORF amplification
ggatccagctagcaaaatgcaatcttctcttcccctttgc

SEQ ID NO: 7929 - DNA, 40 bp, Artificial Sequence
  PCR primer for ORF amplification
ggatccagctagcaaaatgaaaattgcggtagaaacgaca

SEQ ID NO: 7930 - DNA, 40 bp, Artificial Sequence
  PCR primer for ORF amplification
ggatccagctagcaaaatgacaaagattaaggtagctaac

SEQ ID NO: 7931 - DNA, 40 bp, Artificial Sequence
  PCR primer for ORF amplification
ggatccagctagcaaaatgacttccctgactaatgccgtg

SEQ ID NO: 7932 - DNA, 40 bp, Artificial Sequence
  PCR primer for ORF amplification
ggatccagctagcaaaatggctaaaagacccttaggttta

SEQ ID NO: 7933 - DNA, 40 bp, Artificial Sequence
  PCR primer for ORF amplification
ggatccagctagcaaaatgtcagaattacatgctttgctt

SEQ ID NO: 7934 - DNA, 40 bp, Artificial Sequence
  PCR primer for ORF amplification
ggatccagctagcaaaatgtctcctgcagcagctcaaaca

SEQ ID NO: 7935 - DNA, 40 bp, Artificial Sequence
  PCR primer for ORF amplification
ggatccagctagcaaaatgagagcattcccccgagtactg

SEQ ID NO: 7936 - DNA, 40 bp, Artificial Sequence
  PCR primer for ORF amplification
ggatccagctagcaaaatgcaatacaaaaagactttggtt

SEQ ID NO: 7937 - DNA, 40 bp, Artificial Sequence
  PCR primer for ORF amplification
ggatccagctagcaaaatggacacaaattctaaaaccaaa

SEQ ID NO: 7938 - DNA, 40 bp, Artificial Sequence
  PCR primer for ORF amplification
ggatccagctagcaaaatgggagctggcactcttttaaat

SEQ ID NO: 7939 - DNA, 40 bp, Artificial Sequence
  PCR primer for ORF amplification
ggatccagctagcaaaatgggattatattctcctgaatct

SEQ ID NO: 7940 - DNA, 40 bp, Artificial Sequence
  PCR primer for ORF amplification
ggatccagctagcaaaatgtccacagagactacaaaacca

SEQ ID NO: 7941 - DNA, 40 bp, Artificial Sequence
  PCR primer for ORF amplification
ggatccagctagcaaaatgtggctttcaaagttccagttc

SEQ ID NO: 7942 - DNA, 40 bp, Artificial Sequence
  PCR primer for ORF amplification
ggatccagctagcaaaatgaatccatcagtaccgaaggtt

SEQ ID NO: 7943 - DNA, 40 bp, Artificial Sequence
  PCR primer for ORF amplification
ggatccagctagcaaaatgagttatagtgtcaacacgttt

SEQ ID NO: 7944 - DNA, 40 bp, Artificial Sequence
  PCR primer for ORF amplification
ggatccagctagcaaaatgctttcattcagaagtttgact

SEQ ID NO: 7945 - DNA, 40 bp, Artificial Sequence
  PCR primer for ORF amplification
ggatccagctagcaaaatggctaagactactaaagtaaaa

SEQ ID NO: 7946 - DNA, 40 bp, Artificial Sequence
  PCR primer for ORF amplification
ggatccagctagcaaaatggtaaatttcgatttgggccaa

SEQ ID NO: 7947 - DNA, 40 bp, Artificial Sequence
  PCR primer for ORF amplification
ggatccagctagcaaaatgtatagacgatctgttggagta

SEQ ID NO: 7948 - DNA, 40 bp, Artificial Sequence
  PCR primer for ORF amplification
ggatccagctagcaaaatgtctgaagctcaagaaactcac

SEQ ID NO: 7949 - DNA, 40 bp, Artificial Sequence
  PCR primer for ORF amplification
ggatccagctagcaaaatgtttgtcagggttaaattgaat

SEQ ID NO: 7950 - DNA, 40 bp, Artificial Sequence
  PCR primer for ORF amplification
ggatccagctagcaaaatgaaaaggtccacgttgctgtcg

SEQ ID NO: 7951 - DNA, 40 bp, Artificial Sequence
  PCR primer for ORF amplification
ggatccagctagcaaaatgaacaactcaaagactaaccaa

SEQ ID NO: 7952 - DNA, 40 bp, Artificial Sequence
  PCR primer for ORF amplification
ggatccagctagcaaaatgcttgaatcgagcagtgataag

SEQ ID NO: 7953 - DNA, 40 bp, Artificial Sequence
  PCR primer for ORF amplification
ggatccagctagcaaaatgggtactacgacaagtcatcca

SEQ ID NO: 7954 - DNA, 40 bp, Artificial Sequence
  PCR primer for ORF amplification
ggatccagctagcaaaatgtccggaataattgacgcatct

SEQ ID NO: 7955 - DNA, 40 bp, Artificial Sequence
  PCR primer for ORF amplification
ggatccagctagcaaaatgtccgtgaaaaggtctgtttct

SEQ ID NO: 7956 - DNA, 40 bp, Artificial Sequence
  PCR primer for ORF amplification
ggatccagctagcaaaatgtctcaaggtactttatatgct

SEQ ID NO: 7957 - DNA, 40 bp, Artificial Sequence
  PCR primer for ORF amplification
ggatccagctagcaaaatgaaagcaaagtcgatgaagagc

SEQ ID NO: 7958 - DNA, 40 bp, Artificial Sequence
  PCR primer for ORF amplification
ggatccagctagcaaaatgcctatggttaccgtgaagtat

SEQ ID NO: 7959 - DNA, 40 bp, Artificial Sequence
  PCR primer for ORF amplification
ggatccagctagcaaaatggtatcttctttgcccaaggaa

SEQ ID NO: 7960 - DNA, 40 bp, Artificial Sequence
  PCR primer for ORF amplification
ggatccagctagcaaaatggtgacaagacatagagtgact

SEQ ID NO: 7961 - DNA, 40 bp, Artificial Sequence
  PCR primer for ORF amplification
ggatccagctagcaaaatgtctactaatactgttccctca

SEQ ID NO: 7962 - DNA, 40 bp, Artificial Sequence
  PCR primer for ORF amplification
ggatccagctagcaaaatgtctttatcttcaaagttgtct

SEQ ID NO: 7963 - DNA, 40 bp, Artificial Sequence
  PCR primer for ORF amplification
ggatccagctagcaaaatgaacgaagcagatgttacaaaa

SEQ ID NO: 7964 - DNA, 40 bp, Artificial Sequence
  PCR primer for ORF amplification
ggatccagctagcaaaatgactaagaccatcacagttgct

SEQ ID NO: 7965 - DNA, 40 bp, Artificial Sequence
  PCR primer for ORF amplification
ggatccagctagcaaaatgagagccttagcgtatttcggt

SEQ ID NO: 7966 - DNA, 40 bp, Artificial Sequence
  PCR primer for ORF amplification
ggatccagctagcaaaatgataatatttaatgggaacaaa

SEQ ID NO: 7967 - DNA, 40 bp, Artificial Sequence
  PCR primer for ORF amplification
ggatccagctagcaaaatgctggcaagatatttaaattta

SEQ ID NO: 7968 - DNA, 40 bp, Artificial Sequence
  PCR primer for ORF amplification
ggatccagctagcaaaatggatgaagtcttaccattgttt

SEQ ID NO: 7969 - DNA, 40 bp, Artificial Sequence
  PCR primer for ORF amplification
ggatccagctagcaaaatggctggcgacaaccctgaaaac

SEQ ID NO: 7970 - DNA, 40 bp, Artificial Sequence
  PCR primer for ORF amplification
ggatccagctagcaaaatggctgtatttactcctccatca

SEQ ID NO: 7971 - DNA, 40 bp, Artificial Sequence
  PCR primer for ORF amplification
ggatccagctagcaaaatgtcagaccctatcagaacgaaa

SEQ ID NO: 7972 - DNA, 40 bp, Artificial Sequence
  PCR primer for ORF amplification
ggatccagctagcaaaatgtcccagagaaagcgatactca

SEQ ID NO: 7973 - DNA, 40 bp, Artificial Sequence
  PCR primer for ORF amplification
ggatccagctagcaaaatgtctcaaagactacaaagtatc

SEQ ID NO: 7974 - DNA, 40 bp, Artificial Sequence
  PCR primer for ORF amplification
ggatccagctagcaaaatggaaaacaaactactttgttgg

SEQ ID NO: 7975 - DNA, 40 bp, Artificial Sequence
  PCR primer for ORF amplification
ggatccagctagcaaaatggactatttacatgtatataac

SEQ ID NO: 7976 - DNA, 40 bp, Artificial Sequence
  PCR primer for ORF amplification
ggatccagctagcaaaatgtcaggaacattcaatgatata

SEQ ID NO: 7977 - DNA, 40 bp, Artificial Sequence
  PCR primer for ORF amplification
ggatccagctagcaaaatgtcgacaataaagccaagccct

SEQ ID NO: 7978 - DNA, 40 bp, Artificial Sequence
  PCR primer for ORF amplification
ggatccagctagcaaaatgtctgccactctgttcaataac

SEQ ID NO: 7979 - DNA, 40 bp, Artificial Sequence
  PCR primer for ORF amplification
ggatccagctagcaaaatgtggggcatcttattgaaatcc

SEQ ID NO: 7980 - DNA, 40 bp, Artificial Sequence
  PCR primer for ORF amplification
ggatccagctagcaaaatgtttgatcctctcgatttgtac

SEQ ID NO: 7981 - DNA, 40 bp, Artificial Sequence
  PCR primer for ORF amplification
ggatccagctagcaaaatgaaactgtccgccaccactctt

SEQ ID NO: 7982 - DNA, 40 bp, Artificial Sequence
  PCR primer for ORF amplification
ggatccagctagcaaaatgagtaaaattaaagttgttcat

SEQ ID NO: 7983 - DNA, 40 bp, Artificial Sequence
  PCR primer for ORF amplification
ggatccagctagcaaaatgcataaatttgatctagagctc

SEQ ID NO: 7984 - DNA, 40 bp, Artificial Sequence
  PCR primer for ORF amplification
ggatccagctagcaaaatgcttgctgcttcattcaaacgc

SEQ ID NO: 7985 - DNA, 40 bp, Artificial Sequence
  PCR primer for ORF amplification
ggatccagctagcaaaatggttttatcaaggggagaaaca

SEQ ID NO: 7986 - DNA, 40 bp, Artificial Sequence
  PCR primer for ORF amplification
ggatccagctagcaaaatgtctaagggaaaagtttgtttg

SEQ ID NO: 7987 - DNA, 40 bp, Artificial Sequence
  PCR primer for ORF amplification
ggatccagctagcaaaatgtctatcaaaggtgattccccc

SEQ ID NO: 7988 - DNA, 40 bp, Artificial Sequence
  PCR primer for ORF amplification
ggatccagctagcaaaatgtctcaaccccagatgtcccct

SEQ ID NO: 7989 - DNA, 40 bp, Artificial Sequence
  PCR primer for ORF amplification
ggatccagctagcaaaatgttcaaagttccagtgggatta

SEQ ID NO: 7990 - DNA, 40 bp, Artificial Sequence
  PCR primer for ORF amplification
ggatccagctagcaaaatgacagacgctgaaatagaaaat

SEQ ID NO: 7991 - DNA, 40 bp, Artificial Sequence
  PCR primer for ORF amplification
ggatccagctagcaaaatgacggccgtaactgatatcatc

SEQ ID NO: 7992 - DNA, 40 bp, Artificial Sequence
  PCR primer for ORF amplification
ggatccagctagcaaaatggtccggattcttcccataatt

SEQ ID NO: 7993 - DNA, 40 bp, Artificial Sequence
  PCR primer for ORF amplification
ggatccagctagcaaaatgtcccagctgacggagttcatt

SEQ ID NO: 7994 - DNA, 40 bp, Artificial Sequence
  PCR primer for ORF amplification
ggatccagctagcaaaatgtctgaattactagatagcttt

SEQ ID NO: 7995 - DNA, 40 bp, Artificial Sequence
  PCR primer for ORF amplification
ggatccagctagcaaaatgggatattttgttccggattca

SEQ ID NO: 7996 - DNA, 40 bp, Artificial Sequence
  PCR primer for ORF amplification
ggatccagctagcaaaatgaaagtatgttatcactctaaa

SEQ ID NO: 7997 - DNA, 40 bp, Artificial Sequence
  PCR primer for ORF amplification
ggatccagctagcaaaatgaatcagtgcgcgaaggacata

SEQ ID NO: 7998 - DNA, 40 bp, Artificial Sequence
  PCR primer for ORF amplification
ggatccagctagcaaaatgagaatatcaatattacagctg

SEQ ID NO: 7999 - DNA, 40 bp, Artificial Sequence
  PCR primer for ORF amplification
ggatccagctagcaaaatgagcagtaataaaggaaatggg

SEQ ID NO: 8000 - DNA, 40 bp, Artificial Sequence
  PCR primer for ORF amplification
ggatccagctagcaaaatggcaatcaaaccaagaacgaag

SEQ ID NO: 8001 - DNA, 40 bp, Artificial Sequence
  PCR primer for ORF amplification
ggatccagctagcaaaatggttgatcttatagcgagggat

SEQ ID NO: 8002 - DNA, 40 bp, Artificial Sequence
  PCR primer for ORF amplification
ggatccagctagcaaaatgtcgacaattggagctgttgat

SEQ ID NO: 8003 - DNA, 40 bp, Artificial Sequence
  PCR primer for ORF amplification
ggatccagctagcaaaatgacaaaagcttatactatcgtt

SEQ ID NO: 8004 - DNA, 40 bp, Artificial Sequence
  PCR primer for ORF amplification
ggatccagctagcaaaatgacagacaaaggcaagaacgat

SEQ ID NO: 8005 - DNA, 40 bp, Artificial Sequence
  PCR primer for ORF amplification
ggatccagctagcaaaatgactgaacctgccctgagtagc

SEQ ID NO: 8006 - DNA, 40 bp, Artificial Sequence
  PCR primer for ORF amplification
ggatccagctagcaaaatgccacaatttggtatattatgt

SEQ ID NO: 8007 - DNA, 40 bp, Artificial Sequence
  PCR primer for ORF amplification
ggatccagctagcaaaatggaaaacttatgccctccacct

SEQ ID NO: 8008 - DNA, 40 bp, Artificial Sequence
  PCR primer for ORF amplification
ggatccagctagcaaaatggatgttgatataggatgttat

SEQ ID NO: 8009 - DNA, 40 bp, Artificial Sequence
  PCR primer for ORF amplification
ggatccagctagcaaaatggattctcgagttgcactggta

SEQ ID NO: 8010 - DNA, 40 bp, Artificial Sequence
  PCR primer for ORF amplification
ggatccagctagcaaaatggcaacccaagccctagaggat

SEQ ID NO: 8011 - DNA, 40 bp, Artificial Sequence
  PCR primer for ORF amplification
ggatccagctagcaaaatggcagcacatcagatggactcg

SEQ ID NO: 8012 - DNA, 40 bp, Artificial Sequence
  PCR primer for ORF amplification
ggatccagctagcaaaatggcggaaatacctgatgaaacc

SEQ ID NO: 8013 - DNA, 40 bp, Artificial Sequence
  PCR primer for ORF amplification
ggatccagctagcaaaatgttcccaatgaaagatcactca

SEQ ID NO: 8014 - DNA, 40 bp, Artificial Sequence
  PCR primer for ORF amplification
ggatccagctagcaaaatgtttaaaagatatttatccagt

SEQ ID NO: 8015 - DNA, 40 bp, Artificial Sequence
  PCR primer for ORF amplification
ggatccagctagcaaaatgggattctttattcctcagagt

SEQ ID NO: 8016 - DNA, 40 bp, Artificial Sequence
  PCR primer for ORF amplification
ggatccagctagcaaaatggcaaacccaacaacagggaag

SEQ ID NO: 8017 - DNA, 40 bp, Artificial Sequence
  PCR primer for ORF amplification
ggatccagctagcaaaatggcagccaactctggtctcgac

SEQ ID NO: 8018 - DNA, 40 bp, Artificial Sequence
  PCR primer for ORF amplification
ggatccagctagcaaaatgtccgaagctaccctctcctcc

SEQ ID NO: 8019 - DNA, 40 bp, Artificial Sequence
  PCR primer for ORF amplification
ggatccagctagcaaaatgaaattggatacttctcatatg

SEQ ID NO: 8020 - DNA, 40 bp, Artificial Sequence
  PCR primer for ORF amplification
ggatccagctagcaaaatgacagatcccagaagaagaaca

SEQ ID NO: 8021 - DNA, 40 bp, Artificial Sequence
  PCR primer for ORF amplification
ggatccagctagcaaaatgagtggctctacagaatctaaa

SEQ ID NO: 8022 - DNA, 40 bp, Artificial Sequence
  PCR primer for ORF amplification
ggatccagctagcaaaatgcaaatctgcaaggtatttctt

SEQ ID NO: 8023 - DNA, 40 bp, Artificial Sequence
  PCR primer for ORF amplification
ggatccagctagcaaaatggtagtacattggacaattgtg

SEQ ID NO: 8024 - DNA, 40 bp, Artificial Sequence
  PCR primer for ORF amplification
ggatccagctagcaaaatgtcggaccaggataatacccag

SEQ ID NO: 8025 - DNA, 40 bp, Artificial Sequence
  PCR primer for ORF amplification
ggatccagctagcaaaatgaacatccttttacaggatcca

SEQ ID NO: 8026 - DNA, 40 bp, Artificial Sequence
  PCR primer for ORF amplification
ggatccagctagcaaaatgacaggagaaaaaatacttcat

SEQ ID NO: 8027 - DNA, 40 bp, Artificial Sequence
  PCR primer for ORF amplification
ggatccagctagcaaaatgactgatagtgagaatgaatcc

SEQ ID NO: 8028 - DNA, 40 bp, Artificial Sequence
  PCR primer for ORF amplification
ggatccagctagcaaaatgtaccttggacgacattttttg

SEQ ID NO: 8029 - DNA, 40 bp, Artificial Sequence
  PCR primer for ORF amplification
ggatccagctagcaaaatgtcgcaccaaaaccagcttatt

SEQ ID NO: 8030 - DNA, 40 bp, Artificial Sequence
  PCR primer for ORF amplification
ggatccagctagcaaaatgttgaaagagccctcagttcgc

SEQ ID NO: 8031 - DNA, 40 bp, Artificial Sequence
  PCR primer for ORF amplification
ggatccagctagcaaaatgcatcataactcacagtctttg

SEQ ID NO: 8032 - DNA, 40 bp, Artificial Sequence
  PCR primer for ORF amplification
ggatccagctagcaaaatgcgtaagtgtaaaatttttgtt

SEQ ID NO: 8033 - DNA, 40 bp, Artificial Sequence
  PCR primer for ORF amplification
ggatccagctagcaaaatggagagagagctagggatgtat

SEQ ID NO: 8034 - DNA, 40 bp, Artificial Sequence
  PCR primer for ORF amplification
ggatccagctagcaaaatggccattgaattgggactttcc

SEQ ID NO: 8035 - DNA, 40 bp, Artificial Sequence
  PCR primer for ORF amplification
ggatccagctagcaaaatggctaaaggtttcaagttgaag

SEQ ID NO: 8036 - DNA, 40 bp, Artificial Sequence
  PCR primer for ORF amplification
ggatccagctagcaaaatgggtttcatatcgtcaatactg

SEQ ID NO: 8037 - DNA, 40 bp, Artificial Sequence
  PCR primer for ORF amplification
ggatccagctagcaaaatggttgaaacatttagttttgct

SEQ ID NO: 8038 - DNA, 40 bp, Artificial Sequence
  PCR primer for ORF amplification
ggatccagctagcaaaatgtactcaagaaaatccttatcc

SEQ ID NO: 8039 - DNA, 40 bp, Artificial Sequence
  PCR primer for ORF amplification
ggatccagctagcaaaatgaaggatgctaatgagagtaaa

SEQ ID NO: 8040 - DNA, 40 bp, Artificial Sequence
  PCR primer for ORF amplification
ggatccagctagcaaaatgactgctgctaaaccaaatcca

SEQ ID NO: 8041 - DNA, 40 bp, Artificial Sequence
  PCR primer for ORF amplification
ggatccagctagcaaaatgagcgatgttctatctcaatat

SEQ ID NO: 8042 - DNA, 40 bp, Artificial Sequence
  PCR primer for ORF amplification
ggatccagctagcaaaatgagtatgttatctagaagatta

SEQ ID NO: 8043 - DNA, 40 bp, Artificial Sequence
  PCR primer for ORF amplification
ggatccagctagcaaaatgctaaagggaccgcttaaaggt

SEQ ID NO: 8044 - DNA, 40 bp, Artificial Sequence
  PCR primer for ORF amplification
ggatccagctagcaaaatggaggaactaggtattgtgaca

SEQ ID NO: 8045 - DNA, 40 bp, Artificial Sequence
  PCR primer for ORF amplification
ggatccagctagcaaaatggatttaacaatttcaaacgaa

SEQ ID NO: 8046 - DNA, 40 bp, Artificial Sequence
  PCR primer for ORF amplification
ggatccagctagcaaaatggcaaaaggaggctcgctatac

SEQ ID NO: 8047 - DNA, 40 bp, Artificial Sequence
  PCR primer for ORF amplification
ggatccagctagcaaaatggttaataatatcatgcacgag

SEQ ID NO: 8048 - DNA, 40 bp, Artificial Sequence
  PCR primer for ORF amplification
ggatccagctagcaaaatggcaaataatacgtggaagtta

SEQ ID NO: 8049 - DNA, 40 bp, Artificial Sequence
  PCR primer for ORF amplification
ggatccagctagcaaaatggctaaagatattttgaagaac

SEQ ID NO: 8050 - DNA, 40 bp, Artificial Sequence
  PCR primer for ORF amplification
ggatccagctagcaaaatgggaggagaggttctaaataat

SEQ ID NO: 8051 - DNA, 40 bp, Artificial Sequence
  PCR primer for ORF amplification
ggatccagctagcaaaatggtagacgtggaagagaaaagt

SEQ ID NO: 8052 - DNA, 40 bp, Artificial Sequence
  PCR primer for ORF amplification
ggatccagctagcaaaatgtcagaaccagtgataaagtct

SEQ ID NO: 8053 - DNA, 40 bp, Artificial Sequence
  PCR primer for ORF amplification
ggatccagctagcaaaatgtctgcattgagaaacatcaag

SEQ ID NO: 8054 - DNA, 40 bp, Artificial Sequence
  PCR primer for ORF amplification
ggatccagctagcaaaatgacagttttatacacatctgca

SEQ ID NO: 8055 - DNA, 40 bp, Artificial Sequence
  PCR primer for ORF amplification
ggatccagctagcaaaatgactattaggagcagtatgaaa

SEQ ID NO: 8056 - DNA, 40 bp, Artificial Sequence
  PCR primer for ORF amplification
ggatccagctagcaaaatgccaagaaagtttttgggcaat

SEQ ID NO: 8057 - DNA, 40 bp, Artificial Sequence
  PCR primer for ORF amplification
ggatccagctagcaaaatgcggaccgattggaattttttc

SEQ ID NO: 8058 - DNA, 40 bp, Artificial Sequence
  PCR primer for ORF amplification
ggatccagctagcaaaatggatgatataagcggaaggcaa

SEQ ID NO: 8059 - DNA, 40 bp, Artificial Sequence
  PCR primer for ORF amplification
ggatccagctagcaaaatggcagagaaaatcttggaaaat

SEQ ID NO: 8060 - DNA, 40 bp, Artificial Sequence
  PCR primer for ORF amplification
ggatccagctagcaaaatgggaatacctggcttactgcct

SEQ ID NO: 8061 - DNA, 40 bp, Artificial Sequence
  PCR primer for ORF amplification
ggatccagctagcaaaatgggtttatttgataaagtgaag

SEQ ID NO: 8062 - DNA, 40 bp, Artificial Sequence
  PCR primer for ORF amplification
ggatccagctagcaaaatggtagatagtaatgatgatcaa

SEQ ID NO: 8063 - DNA, 40 bp, Artificial Sequence
  PCR primer for ORF amplification
ggatccagctagcaaaatgtcagctttcggtaacccattc

SEQ ID NO: 8064 - DNA, 40 bp, Artificial Sequence
  PCR primer for ORF amplification
ggatccagctagcaaaatgttgcacatgaattcgttgtgg

SEQ ID NO: 8065 - DNA, 40 bp, Artificial Sequence
  PCR primer for ORF amplification
ggatccagctagcaaaatgaccccacctcattttttttta

SEQ ID NO: 8066 - DNA, 40 bp, Artificial Sequence
  PCR primer for ORF amplification
ggatccagctagcaaaatgcacagatccacttttatcagg

SEQ ID NO: 8067 - DNA, 40 bp, Artificial Sequence
  PCR primer for ORF amplification
ggatccagctagcaaaatgcgacagagagtaggaaggtcc

SEQ ID NO: 8068 - DNA, 40 bp, Artificial Sequence
  PCR primer for ORF amplification
ggatccagctagcaaaatggaacctcaagaagagtttata

SEQ ID NO: 8069 - DNA, 40 bp, Artificial Sequence
  PCR primer for ORF amplification
ggatccagctagcaaaatggcagactttaaatctttaggt

SEQ ID NO: 8070 - DNA, 40 bp, Artificial Sequence
  PCR primer for ORF amplification
ggatccagctagcaaaatggtagtacaaaatagcccagtt

SEQ ID NO: 8071 - DNA, 40 bp, Artificial Sequence
  PCR primer for ORF amplification
ggatccagctagcaaaatgtctgatgcggctccttcattg

SEQ ID NO: 8072 - DNA, 40 bp, Artificial Sequence
  PCR primer for ORF amplification
ggatccagctagcaaaatgacagtgaatgacaaaaaaaga

SEQ ID NO: 8073 - DNA, 40 bp, Artificial Sequence
  PCR primer for ORF amplification
ggatccagctagcaaaatgagcaacgacgaaactgtagag

SEQ ID NO: 8074 - DNA, 40 bp, Artificial Sequence
  PCR primer for ORF amplification
ggatccagctagcaaaatgagctctactttctttacatgc

SEQ ID NO: 8075 - DNA, 40 bp, Artificial Sequence
  PCR primer for ORF amplification
ggatccagctagcaaaatggaattctatttgtcatccgat

SEQ ID NO: 8076 - DNA, 40 bp, Artificial Sequence
  PCR primer for ORF amplification
ggatccagctagcaaaatggacccacataatccaattggt

SEQ ID NO: 8077 - DNA, 40 bp, Artificial Sequence
  PCR primer for ORF amplification
ggatccagctagcaaaatggttgttgatactgagtattac

SEQ ID NO: 8078 - DNA, 40 bp, Artificial Sequence
  PCR primer for ORF amplification
ggatccagctagcaaaatgtacaagttggacaataacgac

SEQ ID NO: 8079 - DNA, 40 bp, Artificial Sequence
  PCR primer for ORF amplification
ggatccagctagcaaaatgtatccaggtagtggacgttac

SEQ ID NO: 8080 - DNA, 40 bp, Artificial Sequence
  PCR primer for ORF amplification
ggatccagctagcaaaatgaagaaatatctgctgtatatg

SEQ ID NO: 8081 - DNA, 40 bp, Artificial Sequence
  PCR primer for ORF amplification
ggatccagctagcaaaatgaatgtaacttctccaaaagat

SEQ ID NO: 8082 - DNA, 40 bp, Artificial Sequence
  PCR primer for ORF amplification
ggatccagctagcaaaatgacaattgaaagcactctagct

SEQ ID NO: 8083 - DNA, 40 bp, Artificial Sequence
  PCR primer for ORF amplification
ggatccagctagcaaaatgattgtggggttgacactttat

SEQ ID NO: 8084 - DNA, 40 bp, Artificial Sequence
  PCR primer for ORF amplification
ggatccagctagcaaaatgcaatctatgaatgtacaaccg

SEQ ID NO: 8085 - DNA, 40 bp, Artificial Sequence
  PCR primer for ORF amplification
ggatccagctagcaaaatggacatgactaaaaaccacacc

SEQ ID NO: 8086 - DNA, 40 bp, Artificial Sequence
  PCR primer for ORF amplification
ggatccagctagcaaaatggcgactgacaccgagaggtgt

SEQ ID NO: 8087 - DNA, 40 bp, Artificial Sequence
  PCR primer for ORF amplification
ggatccagctagcaaaatggtatatgaagcaacacctttt

SEQ ID NO: 8088 - DNA, 40 bp, Artificial Sequence
  PCR primer for ORF amplification
ggatccagctagcaaaatggttaacgttgtattgggctcc

SEQ ID NO: 8089 - DNA, 40 bp, Artificial Sequence
  PCR primer for ORF amplification
ggatccagctagcaaaatgtttgtttcaccaccaccagca

SEQ ID NO: 8090 - DNA, 40 bp, Artificial Sequence
  PCR primer for ORF amplification
ggatccagctagcaaaatgttttctttacctaccctaacc

SEQ ID NO: 8091 - DNA, 40 bp, Artificial Sequence
  PCR primer for ORF amplification
ggatccagctagcaaaatgaagactcagtactctctaata

SEQ ID NO: 8092 - DNA, 40 bp, Artificial Sequence
  PCR primer for ORF amplification
ggatccagctagcaaaatgagagaggaggggagtgaatta

SEQ ID NO: 8093 - DNA, 40 bp, Artificial Sequence
  PCR primer for ORF amplification
ggatccagctagcaaaatgagtaattcacttgaggagcgc

SEQ ID NO: 8094 - DNA, 40 bp, Artificial Sequence
  PCR primer for ORF amplification
ggatccagctagcaaaatgccaaattttcaaaaacctttt

SEQ ID NO: 8095 - DNA, 40 bp, Artificial Sequence
  PCR primer for ORF amplification
ggatccagctagcaaaatggccaccttggaagaattggat

SEQ ID NO: 8096 - DNA, 40 bp, Artificial Sequence
  PCR primer for ORF amplification
ggatccagctagcaaaatgtcaaacaagtttcactgtgac

SEQ ID NO: 8097 - DNA, 40 bp, Artificial Sequence
  PCR primer for ORF amplification
ggatccagctagcaaaatgtctcaacacgcaagctcatct

SEQ ID NO: 8098 - DNA, 40 bp, Artificial Sequence
  PCR primer for ORF amplification
ggatccagctagcaaaatgtctcaatacgcaagctcatcc

SEQ ID NO: 8099 - DNA, 40 bp, Artificial Sequence
  PCR primer for ORF amplification
ggatccagctagcaaaatgtctctgccaggttcgaaatta

SEQ ID NO: 8100 - DNA, 40 bp, Artificial Sequence
  PCR primer for ORF amplification
ggatccagctagcaaaatgtctgctgaaaccgccgccgca

SEQ ID NO: 8101 - DNA, 40 bp, Artificial Sequence
  PCR primer for ORF amplification
ggatccagctagcaaaatgttactgaaaaacttacacagt

SEQ ID NO: 8102 - DNA, 40 bp, Artificial Sequence
  PCR primer for ORF amplification
ggatccagctagcaaaatgaaggaagagctcagcaaagtg

SEQ ID NO: 8103 - DNA, 40 bp, Artificial Sequence
  PCR primer for ORF amplification
ggatccagctagcaaaatgaccactaacgaggaattcatt

SEQ ID NO: 8104 - DNA, 40 bp, Artificial Sequence
  PCR primer for ORF amplification
ggatccagctagcaaaatgcatagacgacagtttttccaa

SEQ ID NO: 8105 - DNA, 40 bp, Artificial Sequence
  PCR primer for ORF amplification
ggatccagctagcaaaatggactacaacaagagatcttcg

SEQ ID NO: 8106 - DNA, 40 bp, Artificial Sequence
  PCR primer for ORF amplification
ggatccagctagcaaaatgggagagaaccacgaccatgag

SEQ ID NO: 8107 - DNA, 40 bp, Artificial Sequence
  PCR primer for ORF amplification
ggatccagctagcaaaatggtggtgaacacgatatatatc

SEQ ID NO: 8108 - DNA, 40 bp, Artificial Sequence
  PCR primer for ORF amplification
ggatccagctagcaaaatgtcagattcagagggaggtcta

SEQ ID NO: 8109 - DNA, 40 bp, Artificial Sequence
  PCR primer for ORF amplification
ggatccagctagcaaaatgtccatgcaacaagtccaacat

SEQ ID NO: 8110 - DNA, 40 bp, Artificial Sequence
  PCR primer for ORF amplification
ggatccagctagcaaaatgtctggttatttttcagggttt

SEQ ID NO: 8111 - DNA, 40 bp, Artificial Sequence
  PCR primer for ORF amplification
ggatccagctagcaaaatgaccgtgctatatgctccttcg

SEQ ID NO: 8112 - DNA, 40 bp, Artificial Sequence
  PCR primer for ORF amplification
ggatccagctagcaaaatgatattactccaagtcatatgc

SEQ ID NO: 8113 - DNA, 40 bp, Artificial Sequence
  PCR primer for ORF amplification
ggatccagctagcaaaatggataccagcaaccacaaccaa

SEQ ID NO: 8114 - DNA, 40 bp, Artificial Sequence
  PCR primer for ORF amplification
ggatccagctagcaaaatggctagaaccaaaagtaggaag

SEQ ID NO: 8115 - DNA, 40 bp, Artificial Sequence
  PCR primer for ORF amplification
ggatccagctagcaaaatggctccaccaaagaaaaccgta

SEQ ID NO: 8116 - DNA, 40 bp, Artificial Sequence
  PCR primer for ORF amplification
ggatccagctagcaaaatgtcaaccaaaccagagaagcca

SEQ ID NO: 8117 - DNA, 40 bp, Artificial Sequence
  PCR primer for ORF amplification
ggatccagctagcaaaatgtcactgaatgacttcctaagt

SEQ ID NO: 8118 - DNA, 40 bp, Artificial Sequence
  PCR primer for ORF amplification
ggatccagctagcaaaatgttagaagcactgtttagagat

SEQ ID NO: 8119 - DNA, 40 bp, Artificial Sequence
  PCR primer for ORF amplification
ggatccagctagcaaaatggctgtctctaaagtttacgct

SEQ ID NO: 8120 - DNA, 40 bp, Artificial Sequence; identical to SEQ ID NO: 8119
  PCR primer for ORF amplification

SEQ ID NO: 8121 - DNA, 40 bp, Artificial Sequence
  PCR primer for ORF amplification
ggatccagctagcaaaatgtccatcacgaaggtacatgct

SEQ ID NO: 8122 - DNA, 40 bp, Artificial Sequence
  PCR primer for ORF amplification
ggatccagctagcaaaatgagcacgggagattttttaact

SEQ ID NO: 8123 - DNA, 40 bp, Artificial Sequence
  PCR primer for ORF amplification
ggatccagctagcaaaatgagtgaagaacaggacccttta

SEQ ID NO: 8124 - DNA, 40 bp, Artificial Sequence
  PCR primer for ORF amplification
ggatccagctagcaaaatgccaaaaaaggtttggaaatca

SEQ ID NO: 8125 - DNA, 40 bp, Artificial Sequence
  PCR primer for ORF amplification
ggatccagctagcaaaatggataacgaggttgaaaaaaat

SEQ ID NO: 8126 - DNA, 40 bp, Artificial Sequence
  PCR primer for ORF amplification
ggatccagctagcaaaatggctctcaataaactaaagaat

SEQ ID NO: 8127 - DNA, 40 bp, Artificial Sequence
  PCR primer for ORF amplification
ggatccagctagcaaaatgggacaaggtgtatcatctgga

SEQ ID NO: 8128 - DNA, 40 bp, Artificial Sequence
  PCR primer for ORF amplification
ggatccagctagcaaaatgggggattctaattccagccaa

SEQ ID NO: 8129 - DNA, 40 bp, Artificial Sequence
  PCR primer for ORF amplification
ggatccagctagcaaaatgtcagctttattaccaagatta

SEQ ID NO: 8130 - DNA, 40 bp, Artificial Sequence
  PCR primer for ORF amplification
ggatccagctagcaaaatgagtagaggcaaactggaagat

SEQ ID NO: 8131 - DNA, 40 bp, Artificial Sequence
  PCR primer for ORF amplification
ggatccagctagcaaaatggaaacaccacccattgtgatt

SEQ ID NO: 8132 - DNA, 40 bp, Artificial Sequence
  PCR primer for ORF amplification
ggatccagctagcaaaatggtatcagctttgaatcccaga

SEQ ID NO: 8133 - DNA, 40 bp, Artificial Sequence
  PCR primer for ORF amplification
ggatccagctagcaaaatgaaacggttcttactcagtcga

SEQ ID NO: 8134 - DNA, 40 bp, Artificial Sequence
  PCR primer for ORF amplification
ggatccagctagcaaaatgaaactcggaagcaaacaggta

SEQ ID NO: 8135 - DNA, 40 bp, Artificial Sequence
  PCR primer for ORF amplification
ggatccagctagcaaaatggacttactgggcgatatagtg

SEQ ID NO: 8136 - DNA, 40 bp, Artificial Sequence
  PCR primer for ORF amplification
ggatccagctagcaaaatggtcacaaaacatcagattgaa

SEQ ID NO: 8137 - DNA, 40 bp, Artificial Sequence
  PCR primer for ORF amplification
ggatccagctagcaaaatgaatgactaccatctcgaggat

SEQ ID NO: 8138 - DNA, 40 bp, Artificial Sequence
  PCR primer for ORF amplification
ggatccagctagcaaaatgatcagaacatcatctatatta

SEQ ID NO: 8139 - DNA, 40 bp, Artificial Sequence
  PCR primer for ORF amplification
ggatccagctagcaaaatgcttgctgtcagaagattaaca

SEQ ID NO: 8140 - DNA, 40 bp, Artificial Sequence
  PCR primer for ORF amplification
ggatccagctagcaaaatggatagatatcaaagaaagata

SEQ ID NO: 8141 - DNA, 40 bp, Artificial Sequence
  PCR primer for ORF amplification
ggatccagctagcaaaatggatgaaattcttgccaaagca

SEQ ID NO: 8142 - DNA, 40 bp, Artificial Sequence
  PCR primer for ORF amplification
ggatccagctagcaaaatgtcactttcaaataagactgta

SEQ ID NO: 8143 - DNA, 40 bp, Artificial Sequence
  PCR primer for ORF amplification
ggatccagctagcaaaatgtcgaagacaagatactatttg

SEQ ID NO: 8144 - DNA, 40 bp, Artificial Sequence
  PCR primer for ORF amplification
ggatccagctagcaaaatgtctgaaaataacgaattccag

SEQ ID NO: 8145 - DNA, 40 bp, Artificial Sequence
  PCR primer for ORF amplification
ggatccagctagcaaaatgagaatatcatcaacattgctt

SEQ ID NO: 8146 - DNA, 40 bp, Artificial Sequence
  PCR primer for ORF amplification
ggatccagctagcaaaatgagctcgacgatgttggatgat

SEQ ID NO: 8147 - DNA, 40 bp, Artificial Sequence
  PCR primer for ORF amplification
ggatccagctagcaaaatgagtagcacgatattttaccgc

SEQ ID NO: 8148 - DNA, 40 bp, Artificial Sequence
  PCR primer for ORF amplification
ggatccagctagcaaaatggccccaaatcaaagatcacgt

SEQ ID NO: 8149 - DNA, 40 bp, Artificial Sequence
  PCR primer for ORF amplification
ggatccagctagcaaaatgaataggactgtctttttggca

SEQ ID NO: 8150 - DNA, 40 bp, Artificial Sequence
  PCR primer for ORF amplification
ggatccagctagcaaaatgagtaatttcattagaaggcta

SEQ ID NO: 8151 - DNA, 40 bp, Artificial Sequence
  PCR primer for ORF amplification
ggatccagctagcaaaatgatcaccggtaaagaattgaga

SEQ ID NO: 8152 - DNA, 40 bp, Artificial Sequence
  PCR primer for ORF amplification
ggatccagctagcaaaatgcggctggggaatgcttatgcg

SEQ ID NO: 8153 - DNA, 40 bp, Artificial Sequence
  PCR primer for ORF amplification
ggatccagctagcaaaatggccctctttctcagtaagaga

SEQ ID NO: 8154 - DNA, 40 bp, Artificial Sequence
  PCR primer for ORF amplification
ggatccagctagcaaaatgtcaactgaacaagatgctgtt

SEQ ID NO: 8155 - DNA, 40 bp, Artificial Sequence
  PCR primer for ORF amplification
ggatccagctagcaaaatgtcaagaagagtggttatcaca

SEQ ID NO: 8156 - DNA, 40 bp, Artificial Sequence
  PCR primer for ORF amplification
ggatccagctagcaaaatgaaatacaaggaaatcaatttc

SEQ ID NO: 8157 - DNA, 40 bp, Artificial Sequence
  PCR primer for ORF amplification
ggatccagctagcaaaatgaacagtacacctcctacgtca

SEQ ID NO: 8158 - DNA, 40 bp, Artificial Sequence
  PCR primer for ORF amplification
ggatccagctagcaaaatgagaggctttagtaatgagata

SEQ ID NO: 8159 - DNA, 40 bp, Artificial Sequence
  PCR primer for ORF amplification
ggatccagctagcaaaatgagtatggataacaatgatgac

SEQ ID NO: 8160 - DNA, 40 bp, Artificial Sequence
  PCR primer for ORF amplification
ggatccagctagcaaaatgtcaagagatgtaagggcagag

SEQ ID NO: 8161 - DNA, 40 bp, Artificial Sequence
  PCR primer for ORF amplification
ggatccagctagcaaaatgtcattaccgttcttaacttct

SEQ ID NO: 8162 - DNA, 40 bp, Artificial Sequence
  PCR primer for ORF amplification
ggatccagctagcaaaatgtctttataccctttacaaaga

SEQ ID NO: 8163 - DNA, 40 bp, Artificial Sequence
  PCR primer for ORF amplification
ggatccagctagcaaaatgaaacaacgattcattcgtcaa

SEQ ID NO: 8164 - DNA, 40 bp, Artificial Sequence
  PCR primer for ORF amplification
ggatccagctagcaaaatgaacgtcgttgtgtgctccggt

SEQ ID NO: 8165 - DNA, 40 bp, Artificial Sequence
  PCR primer for ORF amplification
ggatccagctagcaaaatgactacaagaaagacagcttcc

SEQ ID NO: 8166 - DNA, 40 bp, Artificial Sequence
  PCR primer for ORF amplification
ggatccagctagcaaaatgagcgtcattcatcctttgcag

SEQ ID NO: 8167 - DNA, 40 bp, Artificial Sequence
  PCR primer for ORF amplification
ggatccagctagcaaaatgcaattacattcacttatcgct

SEQ ID NO: 8168 - DNA, 40 bp, Artificial Sequence
  PCR primer for ORF amplification
ggatccagctagcaaaatgccatctcatttcgatactgtt

SEQ ID NO: 8169 - DNA, 40 bp, Artificial Sequence
  PCR primer for ORF amplification
ggatccagctagcaaaatggagtatggacatcacgctaga

SEQ ID NO: 8170 - DNA, 40 bp, Artificial Sequence
  PCR primer for ORF amplification
ggatccagctagcaaaatgggaaagctattacaattggca

SEQ ID NO: 8171 - DNA, 40 bp, Artificial Sequence
  PCR primer for ORF amplification
ggatccagctagcaaaatgtttcatggcgctaaaggacct

SEQ ID NO: 8172 - DNA, 40 bp, Artificial Sequence
  PCR primer for ORF amplification
ggatccagctagcaaaatgtttgtttcaccacctccagca

SEQ ID NO: 8173 - DNA, 40 bp, Artificial Sequence
  PCR primer for ORF amplification
ggatccagctagcaaaatgatgatgttaattactatgaaa

SEQ ID NO: 8174 - DNA, 40 bp, Artificial Sequence
  PCR primer for ORF amplification
ggatccagctagcaaaatggcaagtctacctggtattgat

SEQ ID NO: 8175 - DNA, 40 bp, Artificial Sequence
  PCR primer for ORF amplification
ggatccagctagcaaaatggtttcgttcagagggctgact

SEQ ID NO: 8176 - DNA, 40 bp, Artificial Sequence
  PCR primer for ORF amplification
ggatccagctagcaaaatgtcaagagatgcaccaattaag

SEQ ID NO: 8177 - DNA, 40 bp, Artificial Sequence
  PCR primer for ORF amplification
ggatccagctagcaaaatgtccaaaaaacaggaatatatt

SEQ ID NO: 8178 - DNA, 40 bp, Artificial Sequence
  PCR primer for ORF amplification
ggatccagctagcaaaatgtcccatgacggaaaagaagaa

SEQ ID NO: 8179 - DNA, 40 bp, Artificial Sequence
  PCR primer for ORF amplification
ggatccagctagcaaaatgttcaagtcaactttaaactcc

SEQ ID NO: 8180 - DNA, 40 bp, Artificial Sequence
  PCR primer for ORF amplification
ggatccagctagcaaaatgaatgccctaaaatatttctca

SEQ ID NO: 8181 - DNA, 40 bp, Artificial Sequence
  PCR primer for ORF amplification
ggatccagctagcaaaatgattataaggcgcttattttca

SEQ ID NO: 8182 - DNA, 40 bp, Artificial Sequence
  PCR primer for ORF amplification
ggatccagctagcaaaatgcacgtactgctgagcaaaaaa

SEQ ID NO: 8183 - DNA, 40 bp, Artificial Sequence
  PCR primer for ORF amplification
ggatccagctagcaaaatggacgacaaagtttcagaaaag

SEQ ID NO: 8184 - DNA, 40 bp, Artificial Sequence
  PCR primer for ORF amplification
ggatccagctagcaaaatgggaaagaacgttttgttgcta

SEQ ID NO: 8185 - DNA, 40 bp, Artificial Sequence
  PCR primer for ORF amplification
ggatccagctagcaaaatgtcacacgaaggtgaagaagat

SEQ ID NO: 8186 - DNA, 40 bp, Artificial Sequence
  PCR primer for ORF amplification
ggatccagctagcaaaatgtcagcaaacagtggtgtaaaa

SEQ ID NO: 8187 - DNA, 40 bp, Artificial Sequence
  PCR primer for ORF amplification
ggatccagctagcaaaatgacttcagtatcgccctcgcca

SEQ ID NO: 8188 - DNA, 40 bp, Artificial Sequence
  PCR primer for ORF amplification
ggatccagctagcaaaatgcccaaggagtcagaggtcata

SEQ ID NO: 8189 - DNA, 40 bp, Artificial Sequence
  PCR primer for ORF amplification
ggatccagctagcaaaatggtagagaaggatacatggaaa

SEQ ID NO: 8190 - DNA, 40 bp, Artificial Sequence
  PCR primer for ORF amplification
ggatccagctagcaaaatgtcatcgcaaaacctcaatgat

SEQ ID NO: 8191 - DNA, 40 bp, Artificial Sequence
  PCR primer for ORF amplification
ggatccagctagcaaaatgctttcgcttaaaacgttactg

SEQ ID NO: 8192 - DNA, 40 bp, Artificial Sequence
  PCR primer for ORF amplification
ggatccagctagcaaaatggaggttgataacaaaaggaga

SEQ ID NO: 8193 - DNA, 40 bp, Artificial Sequence
  PCR primer for ORF amplification
ggatccagctagcaaaatggatgttcgtcgacctataagg

SEQ ID NO: 8194 - DNA, 40 bp, Artificial Sequence
  PCR primer for ORF amplification
ggatccagctagcaaaatggcaccggaaatttttgttaaa

SEQ ID NO: 8195 - DNA, 40 bp, Artificial Sequence
  PCR primer for ORF amplification
ggatccagctagcaaaatgggctccaaaaaactgaccgta

SEQ ID NO: 8196 - DNA, 40 bp, Artificial Sequence
  PCR primer for ORF amplification
ggatccagctagcaaaatgggcttggaccaggacaagata

SEQ ID NO: 8197 - DNA, 40 bp, Artificial Sequence
  PCR primer for ORF amplification
ggatccagctagcaaaatggtagctagtattagatcaggt

SEQ ID NO: 8198 - DNA, 40 bp, Artificial Sequence
  PCR primer for ORF amplification
ggatccagctagcaaaatggtgatgtcaagaatacgagat

SEQ ID NO: 8199 - DNA, 40 bp, Artificial Sequence
  PCR primer for ORF amplification
ggatccagctagcaaaatgttgcgacttttttcactggca

SEQ ID NO: 8200 - DNA, 40 bp, Artificial Sequence
  PCR primer for ORF amplification
ggatccagctagcaaaatgcgtctaaaagaattgttacct

SEQ ID NO: 8201 - DNA, 40 bp, Artificial Sequence
  PCR primer for ORF amplification
ggatccagctagcaaaatgctagtaaataaagtgataggg

SEQ ID NO: 8202 - DNA, 40 bp, Artificial Sequence
  PCR primer for ORF amplification
ggatccagctagcaaaatgggtctctgcgcatcttcagaa

SEQ ID NO: 8203 - DNA, 40 bp, Artificial Sequence
  PCR primer for ORF amplification
ggatccagctagcaaaatgtcatacttaaacaatcccgct

SEQ ID NO: 8204 - DNA, 40 bp, Artificial Sequence
  PCR primer for ORF amplification
ggatccagctagcaaaatgtctgctccagctcaaaactac

SEQ ID NO: 8205 - DNA, 40 bp, Artificial Sequence
  PCR primer for ORF amplification
ggatccagctagcaaaatgtttttggaaattcctcggtgg

SEQ ID NO: 8206 - DNA, 40 bp, Artificial Sequence
  PCR primer for ORF amplification
ggatccagctagcaaaatgaaagtagatttaccagaatcc

SEQ ID NO: 8207 - DNA, 40 bp, Artificial Sequence
  PCR primer for ORF amplification
ggatccagctagcaaaatgacttcggataaacaccttttt

SEQ ID NO: 8208 - DNA, 40 bp, Artificial Sequence
  PCR primer for ORF amplification
ggatccagctagcaaaatgctacgtatgtcaacttcaaga

SEQ ID NO: 8209 - DNA, 40 bp, Artificial Sequence
  PCR primer for ORF amplification
ggatccagctagcaaaatggctaaagatttattgcccaag

SEQ ID NO: 8210 - DNA, 40 bp, Artificial Sequence
  PCR primer for ORF amplification
ggatccagctagcaaaatggtcaatagtaagaggcagcag

SEQ ID NO: 8211 - DNA, 40 bp, Artificial Sequence
  PCR primer for ORF amplification
ggatccagctagcaaaatgtcctcaagatatagagtggaa

SEQ ID NO: 8212 - DNA, 40 bp, Artificial Sequence
  PCR primer for ORF amplification
ggatccagctagcaaaatgactgatgatgaaaagagggag

SEQ ID NO: 8213 - DNA, 40 bp, Artificial Sequence
  PCR primer for ORF amplification
ggatccagctagcaaaatgagtaggaatcaagatgtgttc

SEQ ID NO: 8214 - DNA, 40 bp, Artificial Sequence
  PCR primer for ORF amplification
ggatccagctagcaaaatggacggaaatgatcacaaagtc

SEQ ID NO: 8215 - DNA, 40 bp, Artificial Sequence
  PCR primer for ORF amplification
ggatccagctagcaaaatggatcaagaaacaatagacact

SEQ ID NO: 8216 - DNA, 40 bp, Artificial Sequence
  PCR primer for ORF amplification
ggatccagctagcaaaatgtcagaagtttccaaatggcca

SEQ ID NO: 8217 - DNA, 40 bp, Artificial Sequence
  PCR primer for ORF amplification
ggatccagctagcaaaatgtcagagttgagagccttcagt

SEQ ID NO: 8218 - DNA, 40 bp, Artificial Sequence
  PCR primer for ORF amplification
ggatccagctagcaaaatgttgaggacgaggcttactaat

SEQ ID NO: 8219 - DNA, 40 bp, Artificial Sequence
  PCR primer for ORF amplification
ggatccagctagcaaaatggccgtatcagcccgtttgaga

SEQ ID NO: 8220 - DNA, 40 bp, Artificial Sequence
  PCR primer for ORF amplification
ggatccagctagcaaaatggctaatactttcaagtattat

SEQ ID NO: 8221 - DNA, 40 bp, Artificial Sequence
  PCR primer for ORF amplification
ggatccagctagcaaaatggggtacagtactatttccaac

SEQ ID NO: 8222 - DNA, 40 bp, Artificial Sequence
  PCR primer for ORF amplification
ggatccagctagcaaaatgggtagaagaaaaattgaaatt

SEQ ID NO: 8223 - DNA, 40 bp, Artificial Sequence
  PCR primer for ORF amplification
ggatccagctagcaaaatggtatcagaggataagattgag

SEQ ID NO: 8224 - DNA, 40 bp, Artificial Sequence
  PCR primer for ORF amplification
ggatccagctagcaaaatgtcatcatctgcgattaaaata

SEQ ID NO: 8225 - DNA, 40 bp, Artificial Sequence
  PCR primer for ORF amplification
ggatccagctagcaaaatgtctggaacatttagttatgat

SEQ ID NO: 8226 - DNA, 40 bp, Artificial Sequence
  PCR primer for ORF amplification
ggatccagctagcaaaatgtgcgtgtacaagtcaaattcg

SEQ ID NO: 8227 - DNA, 40 bp, Artificial Sequence
  PCR primer for ORF amplification
ggatccagctagcaaaatgaacaacacttccataaccgga

SEQ ID NO: 8228 - DNA, 40 bp, Artificial Sequence
  PCR primer for ORF amplification
ggatccagctagcaaaatgatggatatcagccctacctgt

SEQ ID NO: 8229 - DNA, 40 bp, Artificial Sequence
  PCR primer for ORF amplification
ggatccagctagcaaaatgattcaaacgcaaagtacagcg

SEQ ID NO: 8230 - DNA, 40 bp, Artificial Sequence
  PCR primer for ORF amplification
ggatccagctagcaaaatgcctgacaataatacggagcaa

SEQ ID NO: 8231 - DNA, 40 bp, Artificial Sequence
  PCR primer for ORF amplification
ggatccagctagcaaaatgcttttaataaagaggtacttg

SEQ ID NO: 8232 - DNA, 40 bp, Artificial Sequence
  PCR primer for ORF amplification
ggatccagctagcaaaatggaactgaatcaggttttagaa

SEQ ID NO: 8233 - DNA, 40 bp, Artificial Sequence
  PCR primer for ORF amplification
ggatccagctagcaaaatggagaaagctttggaattagac

SEQ ID NO: 8234 - DNA, 40 bp, Artificial Sequence
  PCR primer for ORF amplification
ggatccagctagcaaaatggccaagagaagacaaaagaaa

SEQ ID NO: 8235 - DNA, 40 bp, Artificial Sequence
  PCR primer for ORF amplification
ggatccagctagcaaaatggctaaaagaaggcagaaaaag

SEQ ID NO: 8236 - DNA, 40 bp, Artificial Sequence
  PCR primer for ORF amplification
ggatccagctagcaaaatgtactcatttgaactggacaaa

SEQ ID NO: 8237 - DNA, 40 bp, Artificial Sequence
  PCR primer for ORF amplification
ggatccagctagcaaaatgtctgaaaataacgaagaacaa

SEQ ID NO: 8238 - DNA, 40 bp, Artificial Sequence
  PCR primer for ORF amplification
ggatccagctagcaaaatgtttgatcttaagacgattctc

SEQ ID NO: 8239 - DNA, 40 bp, Artificial Sequence
  PCR primer for ORF amplification
ggatccagctagcaaaatgcatgggcctacttcaaaagct

SEQ ID NO: 8240 - DNA, 40 bp, Artificial Sequence
  PCR primer for ORF amplification
ggatccagctagcaaaatgctgaaatacaggtctttgcca

SEQ ID NO: 8241 - DNA, 40 bp, Artificial Sequence
  PCR primer for ORF amplification
ggatccagctagcaaaatgtcagagccagaatttcaacaa

SEQ ID NO: 8242 - DNA, 40 bp, Artificial Sequence
  PCR primer for ORF amplification
ggatccagctagcaaaatgtcctcttccatcgatatcagt

SEQ ID NO: 8243 - DNA, 40 bp, Artificial Sequence
  PCR primer for ORF amplification
ggatccagctagcaaaatgtcgaaacaatttgttagatct

SEQ ID NO: 8244 - DNA, 40 bp, Artificial Sequence
  PCR primer for ORF amplification
ggatccagctagcaaaatgactatatctactcttagtaac

SEQ ID NO: 8245 - DNA, 40 bp, Artificial Sequence
  PCR primer for ORF amplification
ggatccagctagcaaaatggacatggccaaccagttgcta

SEQ ID NO: 8246 - DNA, 40 bp, Artificial Sequence
  PCR primer for ORF amplification
ggatccagctagcaaaatggatatatttaggcatactttt

SEQ ID NO: 8247 - DNA, 40 bp, Artificial Sequence
  PCR primer for ORF amplification
ggatccagctagcaaaatggctccaactaatctaaccaag

SEQ ID NO: 8248 - DNA, 40 bp, Artificial Sequence
  PCR primer for ORF amplification
ggatccagctagcaaaatgggtttagtagacggttatgac

SEQ ID NO: 8249 - DNA, 40 bp, Artificial Sequence
  PCR primer for ORF amplification
ggatccagctagcaaaatgtcaaaattgttcttagatgaa

SEQ ID NO: 8250 - DNA, 40 bp, Artificial Sequence
  PCR primer for ORF amplification
ggatccagctagcaaaatgtcagaagaggataaagcgaaa

SEQ ID NO: 8251 - DNA, 40 bp, Artificial Sequence
  PCR primer for ORF amplification
ggatccagctagcaaaatgttacaaaagctttccatgacc

SEQ ID NO: 8252 - DNA, 40 bp, Artificial Sequence
  PCR primer for ORF amplification
ggatccagctagcaaaatgaccggtgattccagaagcatc

SEQ ID NO: 8253 - DNA, 40 bp, Artificial Sequence
  PCR primer for ORF amplification
ggatccagctagcaaaatgcaacctaaaactttcgtccac

SEQ ID NO: 8254 - DNA, 40 bp, Artificial Sequence
  PCR primer for ORF amplification
ggatccagctagcaaaatgcccacacctatgacgcctgtc

SEQ ID NO: 8255 - DNA, 40 bp, Artificial Sequence
  PCR primer for ORF amplification
ggatccagctagcaaaatgtcagagaaggcttctgaagag

SEQ ID NO: 8256 - DNA, 40 bp, Artificial Sequence
  PCR primer for ORF amplification
ggatccagctagcaaaatgtcatttcgtaaaagaggtgaa

SEQ ID NO: 8257 - DNA, 40 bp, Artificial Sequence
  PCR primer for ORF amplification
ggatccagctagcaaaatgtccagttcacaacaaatagcc

SEQ ID NO: 8258 - DNA, 40 bp, Artificial Sequence
  PCR primer for ORF amplification
ggatccagctagcaaaatgtcggataagccgattgacata

SEQ ID NO: 8259 - DNA, 40 bp, Artificial Sequence
  PCR primer for ORF amplification
ggatccagctagcaaaatgttgagatactatggggcgaca

SEQ ID NO: 8260 - DNA, 40 bp, Artificial Sequence
  PCR primer for ORF amplification
ggatccagctagcaaaatgtttcgctcgggttactatcca

SEQ ID NO: 8261 - DNA, 40 bp, Artificial Sequence
  PCR primer for ORF amplification
ggatccagctagcaaaatgacaagcgaaccagagtttcag

SEQ ID NO: 8262 - DNA, 40 bp, Artificial Sequence
  PCR primer for ORF amplification
ggatccagctagcaaaatgacagcactagattctcgaaac

SEQ ID NO: 8263 - DNA, 40 bp, Artificial Sequence
  PCR primer for ORF amplification
ggatccagctagcaaaatgagagaaatcattcatatctcg

SEQ ID NO: 8264 - DNA, 40 bp, Artificial Sequence
  PCR primer for ORF amplification
ggatccagctagcaaaatgctaagaacagtaacttcaaag

SEQ ID NO: 8265 - DNA, 40 bp, Artificial Sequence
  PCR primer for ORF amplification
ggatccagctagcaaaatgctaatagacgcaattcatggt

SEQ ID NO: 8266 - DNA, 40 bp, Artificial Sequence
  PCR primer for ORF amplification
ggatccagctagcaaaatggttagctcactggcatcaaat

SEQ ID NO: 8267 - DNA, 40 bp, Artificial Sequence
  PCR primer for ORF amplification
ggatccagctagcaaaatgtctgacaaccctgagatgaaa

SEQ ID NO: 8268 - DNA, 40 bp, Artificial Sequence
  PCR primer for ORF amplification
ggatccagctagcaaaatgggtaaagagaagtctcacatt

SEQ ID NO: 8269 - DNA, 40 bp, Artificial Sequence
  PCR primer for ORF amplification
ggatccagctagcaaaatgaaggatgtcttacaatgggcg

SEQ ID NO: 8270 - DNA, 40 bp, Artificial Sequence
  PCR primer for ORF amplification
ggatccagctagcaaaatgaatatgctcattgtcggtaga

SEQ ID NO: 8271 - DNA, 40 bp, Artificial Sequence
  PCR primer for ORF amplification
ggatccagctagcaaaatgaccgatgagaaacgagctttt

SEQ ID NO: 8272 - DNA, 40 bp, Artificial Sequence
  PCR primer for ORF amplification
ggatccagctagcaaaatgatcgtcaatattagtgcgaag

SEQ ID NO: 8273 - DNA, 40 bp, Artificial Sequence
  PCR primer for ORF amplification
ggatccagctagcaaaatggaaggtgaacagtctccgcaa

SEQ ID NO: 8274 - DNA, 40 bp, Artificial Sequence
  PCR primer for ORF amplification
ggatccagctagcaaaatggttgccaattgggtacttgct

SEQ ID NO: 8275 - DNA, 40 bp, Artificial Sequence
  PCR primer for ORF amplification
ggatccagctagcaaaatgtaccaaggcccaccgcaaccg

SEQ ID NO: 8276 - DNA, 40 bp, Artificial Sequence
  PCR primer for ORF amplification
ggatccagctagcaaaatgtctaacgaattacggcttgaa

SEQ ID NO: 8277 - DNA, 40 bp, Artificial Sequence
  PCR primer for ORF amplification
ggatccagctagcaaaatgacagcagctaataagaatatt

SEQ ID NO: 8278 - DNA, 40 bp, Artificial Sequence
  PCR primer for ORF amplification
ggatccagctagcaaaatgaccgaaaaccaaaccgcacat

SEQ ID NO: 8279 - DNA, 40 bp, Artificial Sequence
  PCR primer for ORF amplification
ggatccagctagcaaaatgagtggcagtgatagaggagac

SEQ ID NO: 8280 - DNA, 40 bp, Artificial Sequence
  PCR primer for ORF amplification
ggatccagctagcaaaatgccgtcaaacgtacgttcggga

SEQ ID NO: 8281 - DNA, 40 bp, Artificial Sequence
  PCR primer for ORF amplification
ggatccagctagcaaaatggttttagcaatggaaagtaga

SEQ ID NO: 8282 - DNA, 40 bp, Artificial Sequence
  PCR primer for ORF amplification
ggatccagctagcaaaatgtcatttagattcaacgaagct

SEQ ID NO: 8283 - DNA, 40 bp, Artificial Sequence
  PCR primer for ORF amplification
ggatccagctagcaaaatgtcctctgcaattgacaatctc

SEQ ID NO: 8284 - DNA, 40 bp, Artificial Sequence
  PCR primer for ORF amplification
ggatccagctagcaaaatgacagaagataaatcgcaggtt

SEQ ID NO: 8285 - DNA, 40 bp, Artificial Sequence
  PCR primer for ORF amplification
ggatccagctagcaaaatgacagttccttatctaaattca

SEQ ID NO: 8286 - DNA, 40 bp, Artificial Sequence
  PCR primer for ORF amplification
ggatccagctagcaaaatgagcactttagatattgcagaa

SEQ ID NO: 8287 - DNA, 40 bp, Artificial Sequence
  PCR primer for ORF amplification
ggatccagctagcaaaatgatgcttgaagggtatacggta

SEQ ID NO: 8288 - DNA, 40 bp, Artificial Sequence
  PCR primer for ORF amplification
ggatccagctagcaaaatgcctagggccttatcaataaaa

SEQ ID NO: 8289 - DNA, 40 bp, Artificial Sequence
  PCR primer for ORF amplification
ggatccagctagcaaaatgcctatcaatgccatcacttcc

SEQ ID NO: 8290 - DNA, 40 bp, Artificial Sequence
  PCR primer for ORF amplification
ggatccagctagcaaaatgtccaacaagctgttcaggtta

SEQ ID NO: 8291 - DNA, 40 bp, Artificial Sequence
  PCR primer for ORF amplification
ggatccagctagcaaaatgtctgaatcagtggccattata

SEQ ID NO: 8292 - DNA, 40 bp, Artificial Sequence
  PCR primer for ORF amplification
ggatccagctagcaaaatgatgatgttccataattgcaga

SEQ ID NO: 8293 - DNA, 40 bp, Artificial Sequence
  PCR primer for ORF amplification
ggatccagctagcaaaatggaagaatttgaagaatttcga

SEQ ID NO: 8294 - DNA, 40 bp, Artificial Sequence
  PCR primer for ORF amplification
ggatccagctagcaaaatggctcctgtagttatttcagaa

SEQ ID NO: 8295 - DNA, 40 bp, Artificial Sequence
  PCR primer for ORF amplification
ggatccagctagcaaaatgggtatacctatgcaaatatac

SEQ ID NO: 8296 - DNA, 40 bp, Artificial Sequence
  PCR primer for ORF amplification
ggatccagctagcaaaatgaaaatacaacttgtaagatgg

SEQ ID NO: 8297 - DNA, 40 bp, Artificial Sequence
  PCR primer for ORF amplification
ggatccagctagcaaaatgagcgaaataaataatgaaaat

SEQ ID NO: 8298 - DNA, 40 bp, Artificial Sequence
  PCR primer for ORF amplification
ggatccagctagcaaaatgagtgacgaaaccatgcctgta

SEQ ID NO: 8299 - DNA, 40 bp, Artificial Sequence
  PCR primer for ORF amplification
ggatccagctagcaaaatgagttactttcctcgaacatat

SEQ ID NO: 8300 - DNA, 40 bp, Artificial Sequence
  PCR primer for ORF amplification
ggatccagctagcaaaatgcaaagaaataataggttaaga

SEQ ID NO: 8301 - DNA, 40 bp, Artificial Sequence
  PCR primer for ORF amplification
ggatccagctagcaaaatgcccgctcgagaatataactat

SEQ ID NO: 8302 - DNA, 40 bp, Artificial Sequence
  PCR primer for ORF amplification
ggatccagctagcaaaatggaaagatatgatagacagctg

SEQ ID NO: 8303 - DNA, 40 bp, Artificial Sequence
  PCR primer for ORF amplification
ggatccagctagcaaaatgttggacatcaaccaatttatc

SEQ ID NO: 8304 - DNA, 40 bp, Artificial Sequence
  PCR primer for ORF amplification
ggatccagctagcaaaatgttttcaagaacagcatccaag

SEQ ID NO: 8305 - DNA, 40 bp, Artificial Sequence
  PCR primer for ORF amplification
ggatccagctagcaaaatgaaccgtattactaggaaaagt

SEQ ID NO: 8306 - DNA, 40 bp, Artificial Sequence
  PCR primer for ORF amplification
ggatccagctagcaaaatgaggttactagtcagctgtgtg

SEQ ID NO: 8307 - DNA, 40 bp, Artificial Sequence
  PCR primer for ORF amplification
ggatccagctagcaaaatgcctaccattttatacaacacc

SEQ ID NO: 8308 - DNA, 40 bp, Artificial Sequence
  PCR primer for ORF amplification
ggatccagctagcaaaatgctttccagagcgacgcgtact

SEQ ID NO: 8309 - DNA, 40 bp, Artificial Sequence
  PCR primer for ORF amplification
ggatccagctagcaaaatggtcgctatcagtgaagtcaaa

SEQ ID NO: 8310 - DNA, 40 bp, Artificial Sequence
  PCR primer for ORF amplification
ggatccagctagcaaaatgtcagacggcactcaaaaacta

SEQ ID NO: 8311 - DNA, 40 bp, Artificial Sequence
  PCR primer for ORF amplification
ggatccagctagcaaaatgtcgaagaaatttagctctaaa

SEQ ID NO: 8312 - DNA, 40 bp, Artificial Sequence
  PCR primer for ORF amplification
ggatccagctagcaaaatgtggaaataccttcatagatca

SEQ ID NO: 8313 - DNA, 40 bp, Artificial Sequence
  PCR primer for ORF amplification
ggatccagctagcaaaatgaggtttctttcaaaaaggata

SEQ ID NO: 8314 - DNA, 40 bp, Artificial Sequence
  PCR primer for ORF amplification
ggatccagctagcaaaatgccactgaaacgctccttaaaa

SEQ ID NO: 8315 - DNA, 40 bp, Artificial Sequence
  PCR primer for ORF amplification
ggatccagctagcaaaatgccagaagatacaagctatagc

SEQ ID NO: 8316 - DNA, 40 bp, Artificial Sequence
  PCR primer for ORF amplification
ggatccagctagcaaaatggctttgactcagtttgaaaat

SEQ ID NO: 8317 - DNA, 40 bp, Artificial Sequence
  PCR primer for ORF amplification
ggatccagctagcaaaatgggaagcgtgaactcatcaccg

SEQ ID NO: 8318 - DNA, 40 bp, Artificial Sequence
  PCR primer for ORF amplification
ggatccagctagcaaaatgggacaaattctatcaaacccg

SEQ ID NO: 8319 - DNA, 40 bp, Artificial Sequence
  PCR primer for ORF amplification
ggatccagctagcaaaatgtcatctgaaagcccacaggat

SEQ ID NO: 8320 - DNA, 40 bp, Artificial Sequence
  PCR primer for ORF amplification
ggatccagctagcaaaatgacattattttcttgtagtgta

SEQ ID NO: 8321 - DNA, 40 bp, Artificial Sequence
  PCR primer for ORF amplification
ggatccagctagcaaaatgagtaaatatattgcacttgaa

SEQ ID NO: 8322 - DNA, 40 bp, Artificial Sequence
  PCR primer for ORF amplification
ggatccagctagcaaaatgagtagtgaactcatgttcaac

SEQ ID NO: 8323 - DNA, 40 bp, Artificial Sequence
  PCR primer for ORF amplification
ggatccagctagcaaaatgccgatcaagagattagataca

SEQ ID NO: 8324 - DNA, 40 bp, Artificial Sequence
  PCR primer for ORF amplification
ggatccagctagcaaaatgcgtggagaatggcaggaattt

SEQ ID NO: 8325 - DNA, 40 bp, Artificial Sequence
  PCR primer for ORF amplification
ggatccagctagcaaaatgctaagatcaaatttatgcaga

SEQ ID NO: 8326 - DNA, 40 bp, Artificial Sequence
  PCR primer for ORF amplification
ggatccagctagcaaaatggacgggcataatcagaaccag

SEQ ID NO: 8327 - DNA, 40 bp, Artificial Sequence
  PCR primer for ORF amplification
ggatccagctagcaaaatggcccgcaatagacaagcgtgc

SEQ ID NO: 8328 - DNA, 40 bp, Artificial Sequence
  PCR primer for ORF amplification
ggatccagctagcaaaatggcgtttgaggattatttttct

SEQ ID NO: 8329 - DNA, 40 bp, Artificial Sequence
  PCR primer for ORF amplification
ggatccagctagcaaaatgccatttaatcataatagcaag

SEQ ID NO: 8330 - DNA, 40 bp, Artificial Sequence
  PCR primer for ORF amplification
ggatccagctagcaaaatgtctagtactcaagtaggaaat

SEQ ID NO: 8331 - DNA, 40 bp, Artificial Sequence
  PCR primer for ORF amplification
ggatccagctagcaaaatgtacgagtactgctcagttgta

SEQ ID NO: 8332 - DNA, 40 bp, Artificial Sequence
  PCR primer for ORF amplification
ggatccagctagcaaaatgttgaagtcagccgtttattca

SEQ ID NO: 8333 - DNA, 40 bp, Artificial Sequence
  PCR primer for ORF amplification
ggatccagctagcaaaatgcaattcgctgggaagaaaact

SEQ ID NO: 8334 - DNA, 40 bp, Artificial Sequence
  PCR primer for ORF amplification
ggatccagctagcaaaatgcattgcgtactagcgcgaata

SEQ ID NO: 8335 - DNA, 40 bp, Artificial Sequence
  PCR primer for ORF amplification
ggatccagctagcaaaatgccaccaaaagaagactgggaa

SEQ ID NO: 8336 - DNA, 40 bp, Artificial Sequence
  PCR primer for ORF amplification
ggatccagctagcaaaatgcgaatctcaaaaaatagtcat

SEQ ID NO: 8337 - DNA, 40 bp, Artificial Sequence
  PCR primer for ORF amplification
ggatccagctagcaaaatggcaatcgttaatagttggcta

SEQ ID NO: 8338 - DNA, 40 bp, Artificial Sequence
  PCR primer for ORF amplification
ggatccagctagcaaaatggcgaaaagcaaatccagtcag

SEQ ID NO: 8339 - DNA, 40 bp, Artificial Sequence
  PCR primer for ORF amplification
ggatccagctagcaaaatgttgcttagtgcgcctgttaac

SEQ ID NO: 8340 - DNA, 40 bp, Artificial Sequence
  PCR primer for ORF amplification
ggatccagctagcaaaatgtttaaatctgttgtttattca

SEQ ID NO: 8341 - DNA, 40 bp, Artificial Sequence
  PCR primer for ORF amplification
ggatccagctagcaaaatgtttaagtctgttgtttattcg

SEQ ID NO: 8342 - DNA, 40 bp, Artificial Sequence
  PCR primer for ORF amplification
ggatccagctagcaaaatgaatcttaaactttctgctatt

SEQ ID NO: 8343 - DNA, 40 bp, Artificial Sequence
  PCR primer for ORF amplification
ggatccagctagcaaaatgaattttgttacctgccatgtt

SEQ ID NO: 8344 - DNA, 40 bp, Artificial Sequence
  PCR primer for ORF amplification
ggatccagctagcaaaatgactttagtcaagtatgcatgc

SEQ ID NO: 8345 - DNA, 40 bp, Artificial Sequence
  PCR primer for ORF amplification
ggatccagctagcaaaatggaagcttcacatttgcaaatc

SEQ ID NO: 8346 - DNA, 40 bp, Artificial Sequence
  PCR primer for ORF amplification
ggatccagctagcaaaatgggtcaaatattgtccaatcca

SEQ ID NO: 8347 - DNA, 40 bp, Artificial Sequence
  PCR primer for ORF amplification
ggatccagctagcaaaatggtgaagcccgttatttttgcc

SEQ ID NO: 8348 - DNA, 40 bp, Artificial Sequence
  PCR primer for ORF amplification
ggatccagctagcaaaatgttactgaatactacttatact

SEQ ID NO: 8349 - DNA, 40 bp, Artificial Sequence
  PCR primer for ORF amplification
ggatccagctagcaaaatgacaagcattgacattaacaac

SEQ ID NO: 8350 - DNA, 40 bp, Artificial Sequence
  PCR primer for ORF amplification
ggatccagctagcaaaatgcccccaagaaatacctatgaa

SEQ ID NO: 8351 - DNA, 40 bp, Artificial Sequence
  PCR primer for ORF amplification
ggatccagctagcaaaatgccttacactctatccgacgct

SEQ ID NO: 8352 - DNA, 40 bp, Artificial Sequence
  PCR primer for ORF amplification
ggatccagctagcaaaatggataatcagcaggaaagtata

SEQ ID NO: 8353 - DNA, 40 bp, Artificial Sequence
  PCR primer for ORF amplification
ggatccagctagcaaaatgtcttattcagctgccgataat

SEQ ID NO: 8354 - DNA, 40 bp, Artificial Sequence
  PCR primer for ORF amplification
ggatccagctagcaaaatgtttctcaatagaatgatgaag

SEQ ID NO: 8355 - DNA, 40 bp, Artificial Sequence
  PCR primer for ORF amplification
ggatccagctagcaaaatgaatcggcgtctcctggtacgt

SEQ ID NO: 8356 - DNA, 40 bp, Artificial Sequence
  PCR primer for ORF amplification
ggatccagctagcaaaatgactatccctggaagatttatg

SEQ ID NO: 8357 - DNA, 40 bp, Artificial Sequence
  PCR primer for ORF amplification
ggatccagctagcaaaatgagtattgtaagacagtcatgt

SEQ ID NO: 8358 - DNA, 40 bp, Artificial Sequence
  PCR primer for ORF amplification
ggatccagctagcaaaatgcagaatccttacggtcacttt

SEQ ID NO: 8359 - DNA, 40 bp, Artificial Sequence
  PCR primer for ORF amplification
ggatccagctagcaaaatgtcatacaagtcagcaataata

SEQ ID NO: 8360 - DNA, 40 bp, Artificial Sequence
  PCR primer for ORF amplification
ggatccagctagcaaaatgtcctcccaacaacacaagttc

SEQ ID NO: 8361 - DNA, 40 bp, Artificial Sequence
  PCR primer for ORF amplification
ggatccagctagcaaaatgtcgaaattggtcatatcaacg

SEQ ID NO: 8362 - DNA, 40 bp, Artificial Sequence
  PCR primer for ORF amplification
ggatccagctagcaaaatgtctctctctcccgttgttgtt

SEQ ID NO: 8363 - DNA, 40 bp, Artificial Sequence
  PCR primer for ORF amplification
ggatccagctagcaaaatgaagttcgtgacagctagttat

SEQ ID NO: 8364 - DNA, 40 bp, Artificial Sequence
  PCR primer for ORF amplification
ggatccagctagcaaaatgaatgaaattatggatatggat

SEQ ID NO: 8365 - DNA, 40 bp, Artificial Sequence
  PCR primer for ORF amplification
ggatccagctagcaaaatgagcatttgtccacatatacag

SEQ ID NO: 8366 - DNA, 40 bp, Artificial Sequence
  PCR primer for ORF amplification
ggatccagctagcaaaatgatcgtatttcgtcgctttcct

SEQ ID NO: 8367 - DNA, 40 bp, Artificial Sequence
  PCR primer for ORF amplification
ggatccagctagcaaaatgatggttttttcgagcaccttt

SEQ ID NO: 8368 - DNA, 40 bp, Artificial Sequence
  PCR primer for ORF amplification
ggatccagctagcaaaatggaaagttttgaaaatttgagc

SEQ ID NO: 8369 - DNA, 40 bp, Artificial Sequence
  PCR primer for ORF amplification
ggatccagctagcaaaatgggctcaaaagtagcaggtaaa

SEQ ID NO: 8370 - DNA, 40 bp, Artificial Sequence
  PCR primer for ORF amplification
ggatccagctagcaaaatgtcacgatcccttttggtagag

SEQ ID NO: 8371 - DNA, 40 bp, Artificial Sequence
  PCR primer for ORF amplification
ggatccagctagcaaaatgtcgattcaaactagtgatcca

SEQ ID NO: 8372 - DNA, 40 bp, Artificial Sequence
  PCR primer for ORF amplification
ggatccagctagcaaaatgtctatttgtgaacaatactac

SEQ ID NO: 8373 - DNA, 40 bp, Artificial Sequence
  PCR primer for ORF amplification
ggatccagctagcaaaatggggtgtacagtgagtacgcaa

SEQ ID NO: 8374 - DNA, 40 bp, Artificial Sequence
  PCR primer for ORF amplification
ggatccagctagcaaaatgtttggattaaataaagcatct

SEQ ID NO: 8375 - DNA, 40 bp, Artificial Sequence
  PCR primer for ORF amplification
ggatccagctagcaaaatgactttaactaagcaaacatgc

SEQ ID NO: 8376 - DNA, 40 bp, Artificial Sequence
  PCR primer for ORF amplification
ggatccagctagcaaaatgcgatcttatatgcagattctt

SEQ ID NO: 8377 - DNA, 40 bp, Artificial Sequence
  PCR primer for ORF amplification
ggatccagctagcaaaatgctcaggtgtgcggtcaagaag

SEQ ID NO: 8378 - DNA, 40 bp, Artificial Sequence
  PCR primer for ORF amplification
ggatccagctagcaaaatggcaaaggataatagtgagaag

SEQ ID NO: 8379 - DNA, 40 bp, Artificial Sequence
  PCR primer for ORF amplification
ggatccagctagcaaaatgggtgccgtaatttctttgcca

SEQ ID NO: 8380 - DNA, 40 bp, Artificial Sequence
  PCR primer for ORF amplification
ggatccagctagcaaaatgggtggagaaattattactttg

SEQ ID NO: 8381 - DNA, 40 bp, Artificial Sequence
  PCR primer for ORF amplification
ggatccagctagcaaaatgtccgaagaacggcatgaagat

SEQ ID NO: 8382 - DNA, 40 bp, Artificial Sequence
  PCR primer for ORF amplification
ggatccagctagcaaaatgtttcaaaggtctggcgctgct

SEQ ID NO: 8383 - DNA, 40 bp, Artificial Sequence
  PCR primer for ORF amplification
ggatccagctagcaaaatgaaattaaaattgatagtaaat

SEQ ID NO: 8384 - DNA, 40 bp, Artificial Sequence
  PCR primer for ORF amplification
ggatccagctagcaaaatgagtatttcaaattggatcacc

SEQ ID NO: 8385 - DNA, 40 bp, Artificial Sequence
  PCR primer for ORF amplification
ggatccagctagcaaaatgtttagagtcaagatcatctct

SEQ ID NO: 8386 - DNA, 40 bp, Artificial Sequence
  PCR primer for ORF amplification
ggatccagctagcaaaatgcatgaagtagtaacgatatcg

SEQ ID NO: 8387 - DNA, 40 bp, Artificial Sequence
  PCR primer for ORF amplification
ggatccagctagcaaaatggcagaccttcaaaaacaagag

SEQ ID NO: 8388 - DNA, 40 bp, Artificial Sequence
  PCR primer for ORF amplification
ggatccagctagcaaaatggcttctgcagtgtatttttgc

SEQ ID NO: 8389 - DNA, 40 bp, Artificial Sequence
  PCR primer for ORF amplification
ggatccagctagcaaaatgtctgaagcgatattccagcca

SEQ ID NO: 8390 - DNA, 40 bp, Artificial Sequence
  PCR primer for ORF amplification
ggatccagctagcaaaatgaaattctcaactgccgttact

SEQ ID NO: 8391 - DNA, 40 bp, Artificial Sequence
  PCR primer for ORF amplification
ggatccagctagcaaaatgaggcaggtttggttctcttgg

SEQ ID NO: 8392 - DNA, 40 bp, Artificial Sequence
  PCR primer for ORF amplification
ggatccagctagcaaaatgagttttagaaggattaactct

SEQ ID NO: 8393 - DNA, 40 bp, Artificial Sequence
  PCR primer for ORF amplification
ggatccagctagcaaaatgatagcttccaaaagctcctta

SEQ ID NO: 8394 - DNA, 40 bp, Artificial Sequence
  PCR primer for ORF amplification
ggatccagctagcaaaatgctgtccattttaagaaattcg

SEQ ID NO: 8395 - DNA, 40 bp, Artificial Sequence
  PCR primer for ORF amplification
ggatccagctagcaaaatggctgacaattctacttccaga

SEQ ID NO: 8396 - DNA, 40 bp, Artificial Sequence
  PCR primer for ORF amplification
ggatccagctagcaaaatgtcatcatcagacatctttgat

SEQ ID NO: 8397 - DNA, 40 bp, Artificial Sequence
  PCR primer for ORF amplification
ggatccagctagcaaaatgttacaagataataatgggccc

SEQ ID NO: 8398 - DNA, 40 bp, Artificial Sequence
  PCR primer for ORF amplification
ggatccagctagcaaaatgacattgaataggaagtgcgta

SEQ ID NO: 8399 - DNA, 40 bp, Artificial Sequence
  PCR primer for ORF amplification
ggatccagctagcaaaatgactgacacaaaacagctattc

SEQ ID NO: 8400 - DNA, 40 bp, Artificial Sequence
  PCR primer for ORF amplification
ggatccagctagcaaaatgtacaacagaaaagacagagat

SEQ ID NO: 8401 - DNA, 40 bp, Artificial Sequence
  PCR primer for ORF amplification
ggatccagctagcaaaatgtttcgaaggggagataattca

SEQ ID NO: 8402 - DNA, 40 bp, Artificial Sequence
  PCR primer for ORF amplification
ggatccagctagcaaaatgaaattctctaccatcttacct

SEQ ID NO: 8403 - DNA, 40 bp, Artificial Sequence
  PCR primer for ORF amplification
ggatccagctagcaaaatgaatgctttgacaaccatagat

SEQ ID NO: 8404 - DNA, 40 bp, Artificial Sequence
  PCR primer for ORF amplification
ggatccagctagcaaaatgactggtcctggacctgaaata

SEQ ID NO: 8405 - DNA, 40 bp, Artificial Sequence
  PCR primer for ORF amplification
ggatccagctagcaaaatgccttctttcaatcctgttaga

SEQ ID NO: 8406 - DNA, 40 bp, Artificial Sequence
  PCR primer for ORF amplification
ggatccagctagcaaaatggattctggtatgttctagcgc

SEQ ID NO: 8407 - DNA, 40 bp, Artificial Sequence
  PCR primer for ORF amplification
ggatccagctagcaaaatggcaaacaaatcacgacccaag

SEQ ID NO: 8408 - DNA, 40 bp, Artificial Sequence
  PCR primer for ORF amplification
ggatccagctagcaaaatgggcgcaaccaaaattttaatg

SEQ ID NO: 8409 - DNA, 40 bp, Artificial Sequence
  PCR primer for ORF amplification
ggatccagctagcaaaatgtctgaaaataagaactctgag

SEQ ID NO: 8410 - DNA, 40 bp, Artificial Sequence
  PCR primer for ORF amplification
ggatccagctagcaaaatgtcttctgaatcaggaaagcct

SEQ ID NO: 8411 - DNA, 40 bp, Artificial Sequence
  PCR primer for ORF amplification
ggatccagctagcaaaatgaatgtgaccactccggaagtt

SEQ ID NO: 8412 - DNA, 40 bp, Artificial Sequence
  PCR primer for ORF amplification
ggatccagctagcaaaatgacgcacccagttatatcacta

SEQ ID NO: 8413 - DNA, 40 bp, Artificial Sequence
  PCR primer for ORF amplification
ggatccagctagcaaaatggaaggaaaggttgatgtcttg

SEQ ID NO: 8414 - DNA, 40 bp, Artificial Sequence
  PCR primer for ORF amplification
ggatccagctagcaaaatgggttttgttgatttcttcgaa

SEQ ID NO: 8415 - DNA, 40 bp, Artificial Sequence
  PCR primer for ORF amplification
ggatccagctagcaaaatgtcagcgatattatcaacaact

SEQ ID NO: 8416 - DNA, 40 bp, Artificial Sequence
  PCR primer for ORF amplification
ggatccagctagcaaaatgttcttttcaaaagttatgctt

SEQ ID NO: 8417 - DNA, 40 bp, Artificial Sequence
  PCR primer for ORF amplification
ggatccagctagcaaaatgagtgagaaagaaacaaattac

SEQ ID NO: 8418 - DNA, 40 bp, Artificial Sequence
  PCR primer for ORF amplification
ggatccagctagcaaaatgtcccaagaaatttcatataca

SEQ ID NO: 8419 - DNA, 40 bp, Artificial Sequence
  PCR primer for ORF amplification
ggatccagctagcaaaatgtcctccaaccgtgttctagac

SEQ ID NO: 8420 - DNA, 40 bp, Artificial Sequence
  PCR primer for ORF amplification
ggatccagctagcaaaatgtctaggaagttgtcccacctg

SEQ ID NO: 8421 - DNA, 40 bp, Artificial Sequence
  PCR primer for ORF amplification
ggatccagctagcaaaatgtctgagttaggtgagtattct

SEQ ID NO: 8422 - DNA, 40 bp, Artificial Sequence
  PCR primer for ORF amplification
ggatccagctagcaaaatgggtatttttcaatcaatagaa

SEQ ID NO: 8423 - DNA, 40 bp, Artificial Sequence
  PCR primer for ORF amplification
ggatccagctagcaaaatgtctcactcacttacttccgtt

SEQ ID NO: 8424 - DNA, 40 bp, Artificial Sequence
  PCR primer for ORF amplification
ggatccagctagcaaaatgttgaagtggataaaaggtggg

SEQ ID NO: 8425 - DNA, 40 bp, Artificial Sequence
  PCR primer for ORF amplification
ggatccagctagcaaaatgtctgctaacttagataaatcc

SEQ ID NO: 8426 - DNA, 40 bp, Artificial Sequence
  PCR primer for ORF amplification
ggatccagctagcaaaatgagtgatacaaagagagatccg

SEQ ID NO: 8427 - DNA, 40 bp, Artificial Sequence
  PCR primer for ORF amplification
ggatccagctagcaaaatgagttttaaagggtttaccaag

SEQ ID NO: 8428 - DNA, 40 bp, Artificial Sequence
  PCR primer for ORF amplification
ggatccagctagcaaaatgcctgactatgacaattacact

SEQ ID NO: 8429 - DNA, 40 bp, Artificial Sequence
  PCR primer for ORF amplification
ggatccagctagcaaaatgctaaggaacggcgttcagagg

SEQ ID NO: 8430 - DNA, 40 bp, Artificial Sequence
  PCR primer for ORF amplification
ggatccagctagcaaaatggatagacctatagatgatatt

SEQ ID NO: 8431 - DNA, 40 bp, Artificial Sequence
  PCR primer for ORF amplification
ggatccagctagcaaaatggatttttatactactgatatc

SEQ ID NO: 8432 - DNA, 40 bp, Artificial Sequence
  PCR primer for ORF amplification
ggatccagctagcaaaatgggcggctatttggcgatcgtg

SEQ ID NO: 8433 - DNA, 40 bp, Artificial Sequence
  PCR primer for ORF amplification
ggatccagctagcaaaatggtcaaaagaacagtcgccacc

SEQ ID NO: 8434 - DNA, 40 bp, Artificial Sequence
  PCR primer for ORF amplification
ggatccagctagcaaaatgtctgcctttgtcagggtggtt

SEQ ID NO: 8435 - DNA, 40 bp, Artificial Sequence
  PCR primer for ORF amplification
ggatccagctagcaaaatgagtagctccacaaagtgcaag

SEQ ID NO: 8436 - DNA, 40 bp, Artificial Sequence
  PCR primer for ORF amplification
ggatccagctagcaaaatgctttctgcaaccaaacaaaca

SEQ ID NO: 8437 - DNA, 40 bp, Artificial Sequence
  PCR primer for ORF amplification
ggatccagctagcaaaatggccagagcatcctctactaaa

SEQ ID NO: 8438 - DNA, 40 bp, Artificial Sequence
  PCR primer for ORF amplification
ggatccagctagcaaaatggtaacacagaccaatccggtc

SEQ ID NO: 8439 - DNA, 40 bp, Artificial Sequence
  PCR primer for ORF amplification
ggatccagctagcaaaatgtatttgtcattctatatcact

SEQ ID NO: 8440 - DNA, 40 bp, Artificial Sequence
  PCR primer for ORF amplification
ggatccagctagcaaaatgtcaaaggaggatttcgttatt

SEQ ID NO: 8441 - DNA, 40 bp, Artificial Sequence
  PCR primer for ORF amplification
ggatccagctagcaaaatgacctcatcatctggtgttgat

SEQ ID NO: 8442 - DNA, 40 bp, Artificial Sequence
  PCR primer for ORF amplification
ggatccagctagcaaaatgctacggataagtattgactct

SEQ ID NO: 8443 - DNA, 40 bp, Artificial Sequence
  PCR primer for ORF amplification
ggatccagctagcaaaatggatagtgtaattcaaaaaaga

SEQ ID NO: 8444 - DNA, 40 bp, Artificial Sequence
  PCR primer for ORF amplification
ggatccagctagcaaaatggctgataagatagagaggcat

SEQ ID NO: 8445 - DNA, 40 bp, Artificial Sequence
  PCR primer for ORF amplification
ggatccagctagcaaaatgggtaaaaataagaagaaaaca

SEQ ID NO: 8446 - DNA, 40 bp, Artificial Sequence
  PCR primer for ORF amplification
ggatccagctagcaaaatgggttcaaatgatttgataaat

SEQ ID NO: 8447 - DNA, 40 bp, Artificial Sequence
  PCR primer for ORF amplification
ggatccagctagcaaaatgtccttggaagataaatttgat

SEQ ID NO: 8448 - DNA, 40 bp, Artificial Sequence
  PCR primer for ORF amplification
ggatccagctagcaaaatgtctgtgcacgctgcaacaaac

SEQ ID NO: 8449 - DNA, 40 bp, Artificial Sequence
  PCR primer for ORF amplification
ggatccagctagcaaaatgtctgttaccagtagggaacaa

SEQ ID NO: 8450 - DNA, 40 bp, Artificial Sequence
  PCR primer for ORF amplification
ggatccagctagcaaaatgttactacgttctcttacaagt

SEQ ID NO: 8451 - DNA, 40 bp, Artificial Sequence
  PCR primer for ORF amplification
ggatccagctagcaaaatggttcatttaggtccaaagaaa

SEQ ID NO: 8452 - DNA, 40 bp, Artificial Sequence
  PCR primer for ORF amplification
ggatccagctagcaaaatgtctggccaaaagggcgagatc

SEQ ID NO: 8453 - DNA, 40 bp, Artificial Sequence
  PCR primer for ORF amplification
ggatccagctagcaaaatgggcttcaatatagcgtatgtc

SEQ ID NO: 8454 - DNA, 40 bp, Artificial Sequence
  PCR primer for ORF amplification
ggatccagctagcaaaatgagagaagttattagtattaat

SEQ ID NO: 8455 - DNA, 40 bp, Artificial Sequence
  PCR primer for ORF amplification
ggatccagctagcaaaatggttcatttaggtccaaaaaaa

SEQ ID NO: 8456 - DNA, 40 bp, Artificial Sequence
  PCR primer for ORF amplification
ggatccagctagcaaaatgaataggattctatctagtgca

SEQ ID NO: 8457 - DNA, 40 bp, Artificial Sequence
  PCR primer for ORF amplification
ggatccagctagcaaaatgagcgaacaaaaggaagatttg

SEQ ID NO: 8458 - DNA, 40 bp, Artificial Sequence
  PCR primer for ORF amplification
ggatccagctagcaaaatgagtcttaaagaagacgacttt

SEQ ID NO: 8459 - DNA, 40 bp, Artificial Sequence
  PCR primer for ORF amplification
ggatccagctagcaaaatgatgaacaataacgaaagtgag

SEQ ID NO: 8460 - DNA, 40 bp, Artificial Sequence
  PCR primer for ORF amplification
ggatccagctagcaaaatgccaagaaaggctaatttgcta

SEQ ID NO: 8461 - DNA, 40 bp, Artificial Sequence
  PCR primer for ORF amplification
ggatccagctagcaaaatgcctctatcaaaggtggagcac

SEQ ID NO: 8462 - DNA, 40 bp, Artificial Sequence
  PCR primer for ORF amplification
ggatccagctagcaaaatgcttttcagaaacatagaagtg

SEQ ID NO: 8463 - DNA, 40 bp, Artificial Sequence
  PCR primer for ORF amplification
ggatccagctagcaaaatggacgatataatcacgcaagtt

SEQ ID NO: 8464 - DNA, 40 bp, Artificial Sequence
  PCR primer for ORF amplification
ggatccagctagcaaaatggtacaaaggcttctaccgggc

SEQ ID NO: 8465 - DNA, 40 bp, Artificial Sequence
  PCR primer for ORF amplification
ggatccagctagcaaaatgtcgcatactttaaaatcgaaa

SEQ ID NO: 8466 - DNA, 40 bp, Artificial Sequence
  PCR primer for ORF amplification
ggatccagctagcaaaatgcgattccatcgtcaaggtatc

SEQ ID NO: 8467 - DNA, 40 bp, Artificial Sequence
  PCR primer for ORF amplification
ggatccagctagcaaaatggaccaccaaataaccactgca

SEQ ID NO: 8468 - DNA, 40 bp, Artificial Sequence
  PCR primer for ORF amplification
ggatccagctagcaaaatggacgcattgttaacaaagttc

SEQ ID NO: 8469 - DNA, 40 bp, Artificial Sequence
  PCR primer for ORF amplification
ggatccagctagcaaaatggactcacaaccagttgacgtt

SEQ ID NO: 8470 - DNA, 40 bp, Artificial Sequence
  PCR primer for ORF amplification
ggatccagctagcaaaatggcttactctaaaatcacatta

SEQ ID NO: 8471 - DNA, 40 bp, Artificial Sequence
  PCR primer for ORF amplification
ggatccagctagcaaaatggctgaaactgaaagactaatg

SEQ ID NO: 8472 - DNA, 40 bp, Artificial Sequence
  PCR primer for ORF amplification
ggatccagctagcaaaatgtcagctatacaatcgccagca

SEQ ID NO: 8473 - DNA, 40 bp, Artificial Sequence
  PCR primer for ORF amplification
ggatccagctagcaaaatgttgagatttaccaattgtagt

SEQ ID NO: 8474 - DNA, 40 bp, Artificial Sequence
  PCR primer for ORF amplification
ggatccagctagcaaaatgaagattaagaccattaaaaga

SEQ ID NO: 8475 - DNA, 40 bp, Artificial Sequence
  PCR primer for ORF amplification
ggatccagctagcaaaatgacaaaaagtgatttattattt

SEQ ID NO: 8476 - DNA, 40 bp, Artificial Sequence
  PCR primer for ORF amplification
ggatccagctagcaaaatgagctcgcaatttccttcgtcc

SEQ ID NO: 8477 - DNA, 40 bp, Artificial Sequence
  PCR primer for ORF amplification
ggatccagctagcaaaatgcaagaatcaaaagaaccacaa

SEQ ID NO: 8478 - DNA, 40 bp, Artificial Sequence
  PCR primer for ORF amplification
ggatccagctagcaaaatgcaatttcactcagataagcag

SEQ ID NO: 8479 - DNA, 40 bp, Artificial Sequence
  PCR primer for ORF amplification
ggatccagctagcaaaatgcatttgaaaaaggggaagagg

SEQ ID NO: 8480 - DNA, 40 bp, Artificial Sequence
  PCR primer for ORF amplification
ggatccagctagcaaaatggactataagcataattttgct

SEQ ID NO: 8481 - DNA, 40 bp, Artificial Sequence
  PCR primer for ORF amplification
ggatccagctagcaaaatggagttgttaaagcttctgtgt

SEQ ID NO: 8482 - DNA, 40 bp, Artificial Sequence
  PCR primer for ORF amplification
ggatccagctagcaaaatggctcggggtgacggacatcta

SEQ ID NO: 8483 - DNA, 40 bp, Artificial Sequence
  PCR primer for ORF amplification
ggatccagctagcaaaatgggtaatgttccagggaaaata

SEQ ID NO: 8484 - DNA, 40 bp, Artificial Sequence
  PCR primer for ORF amplification
ggatccagctagcaaaatgtccaatgctgctttgcaagtt

SEQ ID NO: 8485 - DNA, 40 bp, Artificial Sequence
  PCR primer for ORF amplification
ggatccagctagcaaaatgtctgctgatttcggtttgatt

SEQ ID NO: 8486 - DNA, 40 bp, Artificial Sequence
  PCR primer for ORF amplification
ggatccagctagcaaaatgaatgcggaccatcacctgcaa

SEQ ID NO: 8487 - DNA, 40 bp, Artificial Sequence
  PCR primer for ORF amplification
ggatccagctagcaaaatgaatttctacagggatgcaaca

SEQ ID NO: 8488 - DNA, 40 bp, Artificial Sequence
  PCR primer for ORF amplification
ggatccagctagcaaaatgctggtatcatcatcttttgca

SEQ ID NO: 8489 - DNA, 40 bp, Artificial Sequence
  PCR primer for ORF amplification
ggatccagctagcaaaatggaaagcaaagaaatatcaatt

SEQ ID NO: 8490 - DNA, 40 bp, Artificial Sequence
  PCR primer for ORF amplification
ggatccagctagcaaaatggaggctacatcaagtgctctt

SEQ ID NO: 8491 - DNA, 40 bp, Artificial Sequence
  PCR primer for ORF amplification
ggatccagctagcaaaatgtcgactttaaaacagagaaaa

SEQ ID NO: 8492 - DNA, 40 bp, Artificial Sequence
  PCR primer for ORF amplification
ggatccagctagcaaaatgtctggttttcgtctaattgat

SEQ ID NO: 8493 - DNA, 40 bp, Artificial Sequence
  PCR primer for ORF amplification
ggatccagctagcaaaatgttcaggatacaactgagaact

SEQ ID NO: 8494 - DNA, 40 bp, Artificial Sequence
  PCR primer for ORF amplification
ggatccagctagcaaaatgtttcccagagcttctgcattg

SEQ ID NO: 8495 - DNA, 40 bp, Artificial Sequence
  PCR primer for ORF amplification
ggatccagctagcaaaatgggtattaacaatcctattcca

SEQ ID NO: 8496 - DNA, 40 bp, Artificial Sequence
  PCR primer for ORF amplification
ggatccagctagcaaaatgaaactctcaactaaactttgt

SEQ ID NO: 8497 - DNA, 40 bp, Artificial Sequence
  PCR primer for ORF amplification
ggatccagctagcaaaatgaagccacagtgcatactcatc

SEQ ID NO: 8498 - DNA, 40 bp, Artificial Sequence
  PCR primer for ORF amplification
ggatccagctagcaaaatgaattctccaacaatgaaatcg

SEQ ID NO: 8499 - DNA, 40 bp, Artificial Sequence
  PCR primer for ORF amplification
ggatccagctagcaaaatgaccagtttgtccaaaagcttc

SEQ ID NO: 8500 - DNA, 40 bp, Artificial Sequence
  PCR primer for ORF amplification
ggatccagctagcaaaatgaggttgatatccaaaagaaga

SEQ ID NO: 8501 - DNA, 40 bp, Artificial Sequence
  PCR primer for ORF amplification
ggatccagctagcaaaatgagtgctctactgtccgagtct

SEQ ID NO: 8502 - DNA, 40 bp, Artificial Sequence
  PCR primer for ORF amplification
ggatccagctagcaaaatgatattagatccattatctcca

SEQ ID NO: 8503 - DNA, 40 bp, Artificial Sequence
  PCR primer for ORF amplification
ggatccagctagcaaaatgattagtggtgtgctggtatac

SEQ ID NO: 8504 - DNA, 40 bp, Artificial Sequence
  PCR primer for ORF amplification
ggatccagctagcaaaatggcacactatccaccttccaag

SEQ ID NO: 8505 - DNA, 40 bp, Artificial Sequence
  PCR primer for ORF amplification
ggatccagctagcaaaatggtatatcgtaacaggtcaaag

SEQ ID NO: 8506 - DNA, 40 bp, Artificial Sequence
  PCR primer for ORF amplification
ggatccagctagcaaaatgtccaacccaatagaaaacaca

SEQ ID NO: 8507 - DNA, 40 bp, Artificial Sequence
  PCR primer for ORF amplification
ggatccagctagcaaaatgtctaagtatcaaattaattgc

SEQ ID NO: 8508 - DNA, 40 bp, Artificial Sequence
  PCR primer for ORF amplification
ggatccagctagcaaaatgagcgatgacttgttttctaag

SEQ ID NO: 8509 - DNA, 40 bp, Artificial Sequence
  PCR primer for ORF amplification
ggatccagctagcaaaatgataatgtcatcaactatgtcg

SEQ ID NO: 8510 - DNA, 40 bp, Artificial Sequence
  PCR primer for ORF amplification
ggatccagctagcaaaatgcaagatcccaatatttgccag

SEQ ID NO: 8511 - DNA, 40 bp, Artificial Sequence
  PCR primer for ORF amplification
ggatccagctagcaaaatgcgcccaagaaggagaggatta

SEQ ID NO: 8512 - DNA, 40 bp, Artificial Sequence
  PCR primer for ORF amplification
ggatccagctagcaaaatgctcgaattacgaagttgtagt

SEQ ID NO: 8513 - DNA, 40 bp, Artificial Sequence
  PCR primer for ORF amplification
ggatccagctagcaaaatggagagtcgaactacagggcct

SEQ ID NO: 8514 - DNA, 40 bp, Artificial Sequence
  PCR primer for ORF amplification
ggatccagctagcaaaatggcaaagagcaaaaaaaaaaca

SEQ ID NO: 8515 - DNA, 40 bp, Artificial Sequence
  PCR primer for ORF amplification
ggatccagctagcaaaatggctaatgatcaagatcccaac

SEQ ID NO: 8516 - DNA, 40 bp, Artificial Sequence
  PCR primer for ORF amplification
ggatccagctagcaaaatgtcaaaggcagtaggtgattta

SEQ ID NO: 8517 - DNA, 40 bp, Artificial Sequence
  PCR primer for ORF amplification
ggatccagctagcaaaatgtttcatgctttcaccttcctt

SEQ ID NO: 8518 - DNA, 40 bp, Artificial Sequence
  PCR primer for ORF amplification
ggatccagctagcaaaatgaataaagacgtcgactatcaa

SEQ ID NO: 8519 - DNA, 40 bp, Artificial Sequence
  PCR primer for ORF amplification
ggatccagctagcaaaatgacggttttctctggagtaaat

SEQ ID NO: 8520 - DNA, 40 bp, Artificial Sequence
  PCR primer for ORF amplification
ggatccagctagcaaaatgagctttgttcaaataaggcac

SEQ ID NO: 8521 - DNA, 40 bp, Artificial Sequence
  PCR primer for ORF amplification
ggatccagctagcaaaatgagtaacgatgaaggagaaaca

SEQ ID NO: 8522 - DNA, 40 bp, Artificial Sequence
  PCR primer for ORF amplification
ggatccagctagcaaaatgctaccctatatggaccaagta

SEQ ID NO: 8523 - DNA, 40 bp, Artificial Sequence
  PCR primer for ORF amplification
ggatccagctagcaaaatgcttcttttcgagcaacctgtt

SEQ ID NO: 8524 - DNA, 40 bp, Artificial Sequence
  PCR primer for ORF amplification
ggatccagctagcaaaatggagtgccagaggtgccctgca

SEQ ID NO: 8525 - DNA, 40 bp, Artificial Sequence
  PCR primer for ORF amplification
ggatccagctagcaaaatgactaactggcagcaacagctt

SEQ ID NO: 8526 - DNA, 40 bp, Artificial Sequence
  PCR primer for ORF amplification
ggatccagctagcaaaatgagctctgaagaggactatttc

SEQ ID NO: 8527 - DNA, 40 bp, Artificial Sequence
  PCR primer for ORF amplification
ggatccagctagcaaaatgcagaggtggctacaactgtgg

SEQ ID NO: 8528 - DNA, 40 bp, Artificial Sequence
  PCR primer for ORF amplification
ggatccagctagcaaaatgctgctgaaaaattgcgagacg

SEQ ID NO: 8529 - DNA, 40 bp, Artificial Sequence
  PCR primer for ORF amplification
ggatccagctagcaaaatggacttaagagtaggaaggaaa

SEQ ID NO: 8530 - DNA, 40 bp, Artificial Sequence
  PCR primer for ORF amplification
ggatccagctagcaaaatggataagtacggacatatagct

SEQ ID NO: 8531 - DNA, 40 bp, Artificial Sequence
  PCR primer for ORF amplification
ggatccagctagcaaaatggatgatttttcaagagatacc

SEQ ID NO: 8532 - DNA, 40 bp, Artificial Sequence
  PCR primer for ORF amplification
ggatccagctagcaaaatgaaaactgatagattactgatt

SEQ ID NO: 8533 - DNA, 40 bp, Artificial Sequence
  PCR primer for ORF amplification
ggatccagctagcaaaatgactacggataacgctaaggcg

SEQ ID NO: 8534 - DNA, 40 bp, Artificial Sequence
  PCR primer for ORF amplification
ggatccagctagcaaaatgtcaaattctccaacagtagca

SEQ ID NO: 8535 - DNA, 40 bp, Artificial Sequence
  PCR primer for ORF amplification
ggatccagctagcaaaatgattaaatgaacaataattaat

SEQ ID NO: 8536 - DNA, 40 bp, Artificial Sequence
  PCR primer for ORF amplification
ggatccagctagcaaaatggctccatttaggcaggacagt

SEQ ID NO: 8537 - DNA, 40 bp, Artificial Sequence
  PCR primer for ORF amplification
ggatccagctagcaaaatgaaagtattacaattcaatcaa

SEQ ID NO: 8538 - DNA, 40 bp, Artificial Sequence
  PCR primer for ORF amplification
ggatccagctagcaaaatgacggccgcacatcctgttgct

SEQ ID NO: 8539 - DNA, 40 bp, Artificial Sequence
  PCR primer for ORF amplification
ggatccagctagcaaaatgtcaatgagtaatattgttgtt

SEQ ID NO: 8540 - DNA, 40 bp, Artificial Sequence
  PCR primer for ORF amplification
ggatccagctagcaaaatgtctgctgttaacgttgcacct

SEQ ID NO: 8541 - DNA, 40 bp, Artificial Sequence
  PCR primer for ORF amplification
ggatccagctagcaaaatgactttgagtaagtattctaaa

SEQ ID NO: 8542 - DNA, 40 bp, Artificial Sequence
  PCR primer for ORF amplification
ggatccagctagcaaaatgagaccgttgtatagctgcaac

SEQ ID NO: 8543 - DNA, 40 bp, Artificial Sequence
  PCR primer for ORF amplification
ggatccagctagcaaaatgccattaaggtcattatttcat

SEQ ID NO: 8544 - DNA, 40 bp, Artificial Sequence
  PCR primer for ORF amplification
ggatccagctagcaaaatggatgcttcctcggttccacca

SEQ ID NO: 8545 - DNA, 40 bp, Artificial Sequence
  PCR primer for ORF amplification
ggatccagctagcaaaatgttcatcagtagaagatgcaga

SEQ ID NO: 8546 - DNA, 40 bp, Artificial Sequence
  PCR primer for ORF amplification
ggatccagctagcaaaatgttgaaatcaactgctacaaga

SEQ ID NO: 8547 - DNA, 40 bp, Artificial Sequence
  PCR primer for ORF amplification
ggatccagctagcaaaatgtttaaccatgattggaagtac

SEQ ID NO: 8548 - DNA, 40 bp, Artificial Sequence
  PCR primer for ORF amplification
ggatccagctagcaaaatgaaaatcgcactgccagtattc

SEQ ID NO: 8549 - DNA, 40 bp, Artificial Sequence
  PCR primer for ORF amplification
ggatccagctagcaaaatgagcggagaaacgtttgagttc

SEQ ID NO: 8550 - DNA, 40 bp, Artificial Sequence
  PCR primer for ORF amplification
ggatccagctagcaaaatggagaatagaaacagtagtacc

SEQ ID NO: 8551 - DNA, 40 bp, Artificial Sequence
  PCR primer for ORF amplification
ggatccagctagcaaaatgggaggtgaagacgaaatatta

SEQ ID NO: 8552 - DNA, 40 bp, Artificial Sequence
  PCR primer for ORF amplification
ggatccagctagcaaaatgtccactaagaagcacaccaaa

SEQ ID NO: 8553 - DNA, 40 bp, Artificial Sequence
  PCR primer for ORF amplification
ggatccagctagcaaaatgtcttacaattttacaggtacg

SEQ ID NO: 8554 - DNA, 40 bp, Artificial Sequence
  PCR primer for ORF amplification
ggatccagctagcaaaatgtcttggataaaaaatgtaaca

SEQ ID NO: 8555 - DNA, 40 bp, Artificial Sequence
  PCR primer for ORF amplification
ggatccagctagcaaaatgttaagaatcagatcactccta

SEQ ID NO: 8556 - DNA, 40 bp, Artificial Sequence
  PCR primer for ORF amplification
ggatccagctagcaaaatgaagtataataacagaaaactc

SEQ ID NO: 8557 - DNA, 40 bp, Artificial Sequence
  PCR primer for ORF amplification
ggatccagctagcaaaatgactaagctacactttgacact

SEQ ID NO: 8558 - DNA, 40 bp, Artificial Sequence
  PCR primer for ORF amplification
ggatccagctagcaaaatgactttacctgaatcaaaagac

SEQ ID NO: 8559 - DNA, 40 bp, Artificial Sequence
  PCR primer for ORF amplification
ggatccagctagcaaaatgctcagaaatacgctaaaatgt

SEQ ID NO: 8560 - DNA, 40 bp, Artificial Sequence
  PCR primer for ORF amplification
ggatccagctagcaaaatgtcaattatgccagttaagaac

SEQ ID NO: 8561 - DNA, 40 bp, Artificial Sequence
  PCR primer for ORF amplification
ggatccagctagcaaaatgtcagagggaaaagtagacgaa

SEQ ID NO: 8562 - DNA, 40 bp, Artificial Sequence
  PCR primer for ORF amplification
ggatccagctagcaaaatgtcattcgacgacttacacaaa

SEQ ID NO: 8563 - DNA, 40 bp, Artificial Sequence
  PCR primer for ORF amplification
ggatccagctagcaaaatgtcatttgaaaatttacataaa

SEQ ID NO: 8564 - DNA, 40 bp, Artificial Sequence
  PCR primer for ORF amplification
ggatccagctagcaaaatgtctagattagaaagattgacc

SEQ ID NO: 8565 - DNA, 40 bp, Artificial Sequence
  PCR primer for ORF amplification
ggatccagctagcaaaatgtctgattcatcacctactatc

SEQ ID NO: 8566 - DNA, 40 bp, Artificial Sequence
  PCR primer for ORF amplification
ggatccagctagcaaaatgattagatctgtgagaagggtt

SEQ ID NO: 8567 - DNA, 40 bp, Artificial Sequence
  PCR primer for ORF amplification
ggatccagctagcaaaatgattggctcacttagaaacaaa

SEQ ID NO: 8568 - DNA, 40 bp, Artificial Sequence
  PCR primer for ORF amplification
ggatccagctagcaaaatgcttttacaaggaatgcgttta

SEQ ID NO: 8569 - DNA, 40 bp, Artificial Sequence
  PCR primer for ORF amplification
ggatccagctagcaaaatggttacaaatatggtgaaattg

SEQ ID NO: 8570 - DNA, 40 bp, Artificial Sequence
  PCR primer for ORF amplification
ggatccagctagcaaaatgtcagaagagagggaagaaaac

SEQ ID NO: 8571 - DNA, 40 bp, Artificial Sequence
  PCR primer for ORF amplification
ggatccagctagcaaaatgtccaaaattgttaagagaaag

SEQ ID NO: 8572 - DNA, 40 bp, Artificial Sequence
  PCR primer for ORF amplification
ggatccagctagcaaaatgtcccatcgtatagcaccttcc

SEQ ID NO: 8573 - DNA, 40 bp, Artificial Sequence
  PCR primer for ORF amplification
ggatccagctagcaaaatgttgaacattcccataattgct

SEQ ID NO: 8574 - DNA, 40 bp, Artificial Sequence
  PCR primer for ORF amplification
ggatccagctagcaaaatgacaaaatcagacgaaacaaca

SEQ ID NO: 8575 - DNA, 40 bp, Artificial Sequence
  PCR primer for ORF amplification
ggatccagctagcaaaatgaaattttctgcgtatttatgg

SEQ ID NO: 8576 - DNA, 40 bp, Artificial Sequence
  PCR primer for ORF amplification
ggatccagctagcaaaatgaacaacaataatgttacggaa

SEQ ID NO: 8577 - DNA, 40 bp, Artificial Sequence
  PCR primer for ORF amplification
ggatccagctagcaaaatgacagaaagtgtaggtggaaat

SEQ ID NO: 8578 - DNA, 40 bp, Artificial Sequence
  PCR primer for ORF amplification
ggatccagctagcaaaatgataccaccacgaatcgttcca

SEQ ID NO: 8579 - DNA, 40 bp, Artificial Sequence
  PCR primer for ORF amplification
ggatccagctagcaaaatgccaatttggaaaacacaaaca

SEQ ID NO: 8580 - DNA, 40 bp, Artificial Sequence
  PCR primer for ORF amplification
ggatccagctagcaaaatgctgctggacgtgaacacaaat

SEQ ID NO: 8581 - DNA, 40 bp, Artificial Sequence
  PCR primer for ORF amplification
ggatccagctagcaaaatgctgtcagactgcttgctgaac

SEQ ID NO: 8582 - DNA, 40 bp, Artificial Sequence
  PCR primer for ORF amplification
ggatccagctagcaaaatgaacatattgctaatgcaacgg

SEQ ID NO: 8583 - DNA, 40 bp, Artificial Sequence
  PCR primer for ORF amplification
ggatccagctagcaaaatgaggaagctaaatccagcttta

SEQ ID NO: 8584 - DNA, 40 bp, Artificial Sequence
  PCR primer for ORF amplification
ggatccagctagcaaaatgattgaaaaggataaaagaacg

SEQ ID NO: 8585 - DNA, 40 bp, Artificial Sequence
  PCR primer for ORF amplification
ggatccagctagcaaaatgcacctagatctcatacacaag

SEQ ID NO: 8586 - DNA, 40 bp, Artificial Sequence
  PCR primer for ORF amplification
ggatccagctagcaaaatgctttgtgctattagtgggaaa

SEQ ID NO: 8587 - DNA, 40 bp, Artificial Sequence
  PCR primer for ORF amplification
ggatccagctagcaaaatggaaaaaattcccaggtggttg

SEQ ID NO: 8588 - DNA, 40 bp, Artificial Sequence
  PCR primer for ORF amplification
ggatccagctagcaaaatgtccgatagattcgttatttgg

SEQ ID NO: 8589 - DNA, 40 bp, Artificial Sequence
  PCR primer for ORF amplification
ggatccagctagcaaaatgtctgacttccaattagaaatt

SEQ ID NO: 8590 - DNA, 40 bp, Artificial Sequence
  PCR primer for ORF amplification
ggatccagctagcaaaatgaataaatttgacgagtttata

SEQ ID NO: 8591 - DNA, 40 bp, Artificial Sequence
  PCR primer for ORF amplification
ggatccagctagcaaaatgaccagtacaagaacgttgaga

SEQ ID NO: 8592 - DNA, 40 bp, Artificial Sequence
  PCR primer for ORF amplification
ggatccagctagcaaaatgcaaagcccatatccaatgaca

SEQ ID NO: 8593 - DNA, 40 bp, Artificial Sequence
  PCR primer for ORF amplification
ggatccagctagcaaaatggctcctattgaatacctactg

SEQ ID NO: 8594 - DNA, 40 bp, Artificial Sequence
  PCR primer for ORF amplification
ggatccagctagcaaaatgtttgaaatgcgctacgtctat

SEQ ID NO: 8595 - DNA, 40 bp, Artificial Sequence
  PCR primer for ORF amplification
ggatccagctagcaaaatgaagttgggtattataccttac

SEQ ID NO: 8596 - DNA, 40 bp, Artificial Sequence
  PCR primer for ORF amplification
ggatccagctagcaaaatgagtgaaggccccgtcaaattc

SEQ ID NO: 8597 - DNA, 40 bp, Artificial Sequence
  PCR primer for ORF amplification
ggatccagctagcaaaatgattgacgatactgagaactcc

SEQ ID NO: 8598 - DNA, 40 bp, Artificial Sequence
  PCR primer for ORF amplification
ggatccagctagcaaaatggatagccaagtagaaggcaaa

SEQ ID NO: 8599 - DNA, 40 bp, Artificial Sequence
  PCR primer for ORF amplification
ggatccagctagcaaaatggatctattcaaaagaaaagtt

SEQ ID NO: 8600 - DNA, 40 bp, Artificial Sequence
  PCR primer for ORF amplification
ggatccagctagcaaaatggctaccccgtcaaataaacgt

SEQ ID NO: 8601 - DNA, 40 bp, Artificial Sequence
  PCR primer for ORF amplification
ggatccagctagcaaaatgcctaccttgtatactgatatc

SEQ ID NO: 8602 - DNA, 40 bp, Artificial Sequence; identical to SEQ ID NO: 8601
  PCR primer for ORF amplification

SEQ ID NO: 8603 - DNA, 40 bp, Artificial Sequence
  PCR primer for ORF amplification
ggatccagctagcaaaatgccagagtccagattgcagaga

SEQ ID NO: 8604 - DNA, 40 bp, Artificial Sequence
  PCR primer for ORF amplification
ggatccagctagcaaaatggaatcgacagcaatagtgcct

SEQ ID NO: 8605 - DNA, 40 bp, Artificial Sequence
  PCR primer for ORF amplification
ggatccagctagcaaaatggatccatttttagagttcaga

SEQ ID NO: 8606 - DNA, 40 bp, Artificial Sequence
  PCR primer for ORF amplification
ggatccagctagcaaaatggccattgattactctaagtgg

SEQ ID NO: 8607 - DNA, 40 bp, Artificial Sequence
  PCR primer for ORF amplification
ggatccagctagcaaaatggcttcaatgttcagaccacca

SEQ ID NO: 8608 - DNA, 40 bp, Artificial Sequence
  PCR primer for ORF amplification
ggatccagctagcaaaatgggttccatcaataataacttc

SEQ ID NO: 8609 - DNA, 40 bp, Artificial Sequence
  PCR primer for ORF amplification
ggatccagctagcaaaatgaaagtgcttgacctactaacg

SEQ ID NO: 8610 - DNA, 40 bp, Artificial Sequence
  PCR primer for ORF amplification
ggatccagctagcaaaatgacaaatgcaaagattttagta

SEQ ID NO: 8611 - DNA, 40 bp, Artificial Sequence
  PCR primer for ORF amplification
ggatccagctagcaaaatgacaagcaaaacgaagaatatc

SEQ ID NO: 8612 - DNA, 40 bp, Artificial Sequence
  PCR primer for ORF amplification
ggatccagctagcaaaatgacaatgacacaccaacaggat

SEQ ID NO: 8613 - DNA, 40 bp, Artificial Sequence
  PCR primer for ORF amplification
ggatccagctagcaaaatgaccgcttccatcaaaattcaa

SEQ ID NO: 8614 - DNA, 40 bp, Artificial Sequence
  PCR primer for ORF amplification
ggatccagctagcaaaatgactaaatctgagcagcaagcc

SEQ ID NO: 8615 - DNA, 40 bp, Artificial Sequence
  PCR primer for ORF amplification
ggatccagctagcaaaatgataacaccaagattctctata

SEQ ID NO: 8616 - DNA, 40 bp, Artificial Sequence
  PCR primer for ORF amplification
ggatccagctagcaaaatgtttgaagtccctataacttta

SEQ ID NO: 8617 - DNA, 40 bp, Artificial Sequence
  PCR primer for ORF amplification
ggatccagctagcaaaatgaaacttcaattggcggcagtg

SEQ ID NO: 8618 - DNA, 40 bp, Artificial Sequence
  PCR primer for ORF amplification
ggatccagctagcaaaatgaagtatctaaacttagttttc

SEQ ID NO: 8619 - DNA, 40 bp, Artificial Sequence
  PCR primer for ORF amplification
ggatccagctagcaaaatgaatacagtttcaccagccaaa

SEQ ID NO: 8620 - DNA, 40 bp, Artificial Sequence
  PCR primer for ORF amplification
ggatccagctagcaaaatggcttcactgttcagaccccca

SEQ ID NO: 8621 - DNA, 40 bp, Artificial Sequence
  PCR primer for ORF amplification
ggatccagctagcaaaatgatcgctttgaagcccaatgct

SEQ ID NO: 8622 - DNA, 40 bp, Artificial Sequence
  PCR primer for ORF amplification
ggatccagctagcaaaatgccaaatgtgctttctgatgat

SEQ ID NO: 8623 - DNA, 40 bp, Artificial Sequence
  PCR primer for ORF amplification
ggatccagctagcaaaatgaaggccgttttcaaagtaacg

SEQ ID NO: 8624 - DNA, 40 bp, Artificial Sequence
  PCR primer for ORF amplification
ggatccagctagcaaaatgacttcatctctagatgatata

SEQ ID NO: 8625 - DNA, 40 bp, Artificial Sequence
  PCR primer for ORF amplification
ggatccagctagcaaaatgacttccaaaacgtcagaaagt

SEQ ID NO: 8626 - DNA, 40 bp, Artificial Sequence
  PCR primer for ORF amplification
ggatccagctagcaaaatgcacgttttctttcctttgctt

SEQ ID NO: 8627 - DNA, 40 bp, Artificial Sequence
  PCR primer for ORF amplification
ggatccagctagcaaaatgccaacttctggaactactatt

SEQ ID NO: 8628 - DNA, 40 bp, Artificial Sequence
  PCR primer for ORF amplification
ggatccagctagcaaaatgtgtggtattttaggtattgta

SEQ ID NO: 8629 - DNA, 40 bp, Artificial Sequence
  PCR primer for ORF amplification
ggatccagctagcaaaatgttaagaatctgcgtaaaaagg

SEQ ID NO: 8630 - DNA, 40 bp, Artificial Sequence
  PCR primer for ORF amplification
ggatccagctagcaaaatgcctgctcctcacggtggtatt

SEQ ID NO: 8631 - DNA, 40 bp, Artificial Sequence
  PCR primer for ORF amplification
ggatccagctagcaaaatggacaattacgaaggcagtgat

SEQ ID NO: 8632 - DNA, 40 bp, Artificial Sequence
  PCR primer for ORF amplification
ggatccagctagcaaaatggcttacgttttaactgaaact

SEQ ID NO: 8633 - DNA, 40 bp, Artificial Sequence
  PCR primer for ORF amplification
ggatccagctagcaaaatggctttccaacaaggtgtattg

SEQ ID NO: 8634 - DNA, 40 bp, Artificial Sequence
  PCR primer for ORF amplification
ggatccagctagcaaaatggtaggacactcagctcagcac

SEQ ID NO: 8635 - DNA, 40 bp, Artificial Sequence
  PCR primer for ORF amplification
ggatccagctagcaaaatggttttgccaagactatatact

SEQ ID NO: 8636 - DNA, 40 bp, Artificial Sequence
  PCR primer for ORF amplification
ggatccagctagcaaaatgtcgaaaaggtctatcgaggtc

SEQ ID NO: 8637 - DNA, 40 bp, Artificial Sequence
  PCR primer for ORF amplification
ggatccagctagcaaaatgttacataggataaacccagta

SEQ ID NO: 8638 - DNA, 40 bp, Artificial Sequence
  PCR primer for ORF amplification
ggatccagctagcaaaatgaagtcaaaagggagtcggttg

SEQ ID NO: 8639 - DNA, 40 bp, Artificial Sequence
  PCR primer for ORF amplification
ggatccagctagcaaaatgatgaaggaatcgaaatctatc

SEQ ID NO: 8640 - DNA, 40 bp, Artificial Sequence
  PCR primer for ORF amplification
ggatccagctagcaaaatggtagcaacaataatgcagacg

SEQ ID NO: 8641 - DNA, 40 bp, Artificial Sequence
  PCR primer for ORF amplification
ggatccagctagcaaaatgtcagtaaacccagaatttata

SEQ ID NO: 8642 - DNA, 40 bp, Artificial Sequence
  PCR primer for ORF amplification
ggatccagctagcaaaatgtccatgactatttgctcaaat

SEQ ID NO: 8643 - DNA, 40 bp, Artificial Sequence
  PCR primer for ORF amplification
ggatccagctagcaaaatgaagcaattcaagttggttaat

SEQ ID NO: 8644 - DNA, 40 bp, Artificial Sequence
  PCR primer for ORF amplification
ggatccagctagcaaaatgactgctggttctgccccccct

SEQ ID NO: 8645 - DNA, 40 bp, Artificial Sequence
  PCR primer for ORF amplification
ggatccagctagcaaaatgagtgactattccctgaagcat

SEQ ID NO: 8646 - DNA, 40 bp, Artificial Sequence
  PCR primer for ORF amplification
ggatccagctagcaaaatgagtttgtccacgaaaagagag

SEQ ID NO: 8647 - DNA, 40 bp, Artificial Sequence
  PCR primer for ORF amplification
ggatccagctagcaaaatgctatcgaagaatttgtatagt

SEQ ID NO: 8648 - DNA, 40 bp, Artificial Sequence
  PCR primer for ORF amplification
ggatccagctagcaaaatggcagataaattaatggacaaa

SEQ ID NO: 8649 - DNA, 40 bp, Artificial Sequence
  PCR primer for ORF amplification
ggatccagctagcaaaatggtatcgaggctatcaaagaga

SEQ ID NO: 8650 - DNA, 40 bp, Artificial Sequence
  PCR primer for ORF amplification
ggatccagctagcaaaatgtcaacacccacagcagcagat

SEQ ID NO: 8651 - DNA, 40 bp, Artificial Sequence
  PCR primer for ORF amplification
ggatccagctagcaaaatgtcagaaaaccaaaaggaggta

SEQ ID NO: 8652 - DNA, 40 bp, Artificial Sequence
  PCR primer for ORF amplification
ggatccagctagcaaaatgtcagctataccaataactcca

SEQ ID NO: 8653 - DNA, 40 bp, Artificial Sequence
  PCR primer for ORF amplification
ggatccagctagcaaaatgtcgactgctaggcctagaata

SEQ ID NO: 8654 - DNA, 40 bp, Artificial Sequence
  PCR primer for ORF amplification
ggatccagctagcaaaatgaacgaagttacttgttccata

SEQ ID NO: 8655 - DNA, 40 bp, Artificial Sequence
  PCR primer for ORF amplification
ggatccagctagcaaaatgcctaacgcttcccaagtttac

SEQ ID NO: 8656 - DNA, 40 bp, Artificial Sequence
  PCR primer for ORF amplification
ggatccagctagcaaaatggaggaacaacgtgaaatactg

SEQ ID NO: 8657 - DNA, 40 bp, Artificial Sequence
  PCR primer for ORF amplification
ggatccagctagcaaaatggttgcagaatttcaaatagcg

SEQ ID NO: 8658 - DNA, 40 bp, Artificial Sequence
  PCR primer for ORF amplification
ggatccagctagcaaaatgtctactttcataagaggtccc

SEQ ID NO: 8659 - DNA, 40 bp, Artificial Sequence
  PCR primer for ORF amplification
ggatccagctagcaaaatgaaagcgtacgcaaagaaacgt

SEQ ID NO: 8660 - DNA, 40 bp, Artificial Sequence
  PCR primer for ORF amplification
ggatccagctagcaaaatgacacaagacaaagaagtcaaa

SEQ ID NO: 8661 - DNA, 40 bp, Artificial Sequence
  PCR primer for ORF amplification
ggatccagctagcaaaatggatcttgaaaatgtttcatgt

SEQ ID NO: 8662 - DNA, 40 bp, Artificial Sequence
  PCR primer for ORF amplification
ggatccagctagcaaaatgggtgttaccgttcaagacata

SEQ ID NO: 8663 - DNA, 40 bp, Artificial Sequence
  PCR primer for ORF amplification
ggatccagctagcaaaatgtcaactagctcctccgtaacg

SEQ ID NO: 8664 - DNA, 40 bp, Artificial Sequence
  PCR primer for ORF amplification
ggatccagctagcaaaatgtccaccctgattcctccacct

SEQ ID NO: 8665 - DNA, 40 bp, Artificial Sequence
  PCR primer for ORF amplification
ggatccagctagcaaaatgtcgaaattgggacaagaaaaa

SEQ ID NO: 8666 - DNA, 40 bp, Artificial Sequence
  PCR primer for ORF amplification
ggatccagctagcaaaatgtttcaacgaaagactttacag

SEQ ID NO: 8667 - DNA, 40 bp, Artificial Sequence
  PCR primer for ORF amplification
ggatccagctagcaaaatgaattccggaggtgaagaacca

SEQ ID NO: 8668 - DNA, 40 bp, Artificial Sequence
  PCR primer for ORF amplification
ggatccagctagcaaaatgatgaggtatcaatggtggctt

SEQ ID NO: 8669 - DNA, 40 bp, Artificial Sequence
  PCR primer for ORF amplification
ggatccagctagcaaaatggcagagaaatcaatatttaat

SEQ ID NO: 8670 - DNA, 40 bp, Artificial Sequence
  PCR primer for ORF amplification
ggatccagctagcaaaatgtccactgagtatgtcaaaaac

SEQ ID NO: 8671 - DNA, 40 bp, Artificial Sequence
  PCR primer for ORF amplification
ggatccagctagcaaaatgtctacacagcagcaatcttac

SEQ ID NO: 8672 - DNA, 40 bp, Artificial Sequence
  PCR primer for ORF amplification
ggatccagctagcaaaatgtttttagccaaaaatctaaaa

SEQ ID NO: 8673 - DNA, 40 bp, Artificial Sequence
  PCR primer for ORF amplification
ggatccagctagcaaaatgactacgtttaggccactatca

SEQ ID NO: 8674 - DNA, 40 bp, Artificial Sequence
  PCR primer for ORF amplification
ggatccagctagcaaaatgagtactagtgcggacactgat

SEQ ID NO: 8675 - DNA, 40 bp, Artificial Sequence
  PCR primer for ORF amplification
ggatccagctagcaaaatgcaagtgaccacaagatttata

SEQ ID NO: 8676 - DNA, 40 bp, Artificial Sequence
  PCR primer for ORF amplification
ggatccagctagcaaaatggctataagattgaatccaaaa

SEQ ID NO: 8677 - DNA, 40 bp, Artificial Sequence
  PCR primer for ORF amplification
ggatccagctagcaaaatggttttgtctgataaggagttg

SEQ ID NO: 8678 - DNA, 40 bp, Artificial Sequence
  PCR primer for ORF amplification
ggatccagctagcaaaatgacttatgaaattggggacaga

SEQ ID NO: 8679 - DNA, 40 bp, Artificial Sequence
  PCR primer for ORF amplification
ggatccagctagcaaaatgattactacagtgcaagaaatc

SEQ ID NO: 8680 - DNA, 40 bp, Artificial Sequence
  PCR primer for ORF amplification
ggatccagctagcaaaatggaagacaaagatatcacatcg

SEQ ID NO: 8681 - DNA, 40 bp, Artificial Sequence
  PCR primer for ORF amplification
ggatccagctagcaaaatggaattcacacctatagatccg

SEQ ID NO: 8682 - DNA, 40 bp, Artificial Sequence
  PCR primer for ORF amplification
ggatccagctagcaaaatggatgaatatagtagtatatat

SEQ ID NO: 8683 - DNA, 40 bp, Artificial Sequence
  PCR primer for ORF amplification
ggatccagctagcaaaatggcgcccatctttagaaattac

SEQ ID NO: 8684 - DNA, 40 bp, Artificial Sequence
  PCR primer for ORF amplification
ggatccagctagcaaaatggctccaaaaatttcaatatcc

SEQ ID NO: 8685 - DNA, 40 bp, Artificial Sequence
  PCR primer for ORF amplification
ggatccagctagcaaaatgtcgatagcttggtctagcgtt

SEQ ID NO: 8686 - DNA, 40 bp, Artificial Sequence
  PCR primer for ORF amplification
ggatccagctagcaaaatgccctctaccacgctactgttt

SEQ ID NO: 8687 - DNA, 40 bp, Artificial Sequence
  PCR primer for ORF amplification
ggatccagctagcaaaatgccttccgaatcatccgtctct

SEQ ID NO: 8688 - DNA, 40 bp, Artificial Sequence
  PCR primer for ORF amplification
ggatccagctagcaaaatggtcgctataatacctcatgct

SEQ ID NO: 8689 - DNA, 40 bp, Artificial Sequence
  PCR primer for ORF amplification
ggatccagctagcaaaatgttacgctctcttcattctgcg

SEQ ID NO: 8690 - DNA, 40 bp, Artificial Sequence
  PCR primer for ORF amplification
ggatccagctagcaaaatgttcagtagatctacgctctgc

SEQ ID NO: 8691 - DNA, 40 bp, Artificial Sequence
  PCR primer for ORF amplification
ggatccagctagcaaaatgaatacaaacgttccaatattc

SEQ ID NO: 8692 - DNA, 40 bp, Artificial Sequence
  PCR primer for ORF amplification
ggatccagctagcaaaatgagagtcagaaagcgccaatct

SEQ ID NO: 8693 - DNA, 40 bp, Artificial Sequence
  PCR primer for ORF amplification
ggatccagctagcaaaatgagtttaaaggaggaacaagtg

SEQ ID NO: 8694 - DNA, 40 bp, Artificial Sequence
  PCR primer for ORF amplification
ggatccagctagcaaaatgctttctcgcacaagagctgca

SEQ ID NO: 8695 - DNA, 40 bp, Artificial Sequence
  PCR primer for ORF amplification
ggatccagctagcaaaatgtcatcaagcgaaaacacgtta

SEQ ID NO: 8696 - DNA, 40 bp, Artificial Sequence
  PCR primer for ORF amplification
ggatccagctagcaaaatgttgaaatctgcaagccaaaac

SEQ ID NO: 8697 - DNA, 40 bp, Artificial Sequence
  PCR primer for ORF amplification
ggatccagctagcaaaatgttgcataaaagcccttcaaga

SEQ ID NO: 8698 - DNA, 40 bp, Artificial Sequence
  PCR primer for ORF amplification
ggatccagctagcaaaatgtcccaaggtactttatacatt

SEQ ID NO: 8699 - DNA, 40 bp, Artificial Sequence
  PCR primer for ORF amplification
ggatccagctagcaaaatgacgactcgtttgctccaactc

SEQ ID NO: 8700 - DNA, 40 bp, Artificial Sequence
  PCR primer for ORF amplification
ggatccagctagcaaaatgagctcagacagtttaacgcct

SEQ ID NO: 8701 - DNA, 40 bp, Artificial Sequence
  PCR primer for ORF amplification
ggatccagctagcaaaatgtcccatctcttcccaccatca

SEQ ID NO: 8702 - DNA, 40 bp, Artificial Sequence
  PCR primer for ORF amplification
ggatccagctagcaaaatgaagttttctgctggtgccgtc

SEQ ID NO: 8703 - DNA, 40 bp, Artificial Sequence
  PCR primer for ORF amplification
ggatccagctagcaaaatgccggaattaacagaatttcag

SEQ ID NO: 8704 - DNA, 40 bp, Artificial Sequence
  PCR primer for ORF amplification
ggatccagctagcaaaatggcattggcaaattccagacct

SEQ ID NO: 8705 - DNA, 40 bp, Artificial Sequence
  PCR primer for ORF amplification
ggatccagctagcaaaatgtacacgcctatccctgctaat

SEQ ID NO: 8706 - DNA, 40 bp, Artificial Sequence
  PCR primer for ORF amplification
ggatccagctagcaaaatgttgctaataagaaggacgata

SEQ ID NO: 8707 - DNA, 40 bp, Artificial Sequence
  PCR primer for ORF amplification
ggatccagctagcaaaatgaaaaacatgtcacaacgatcc

SEQ ID NO: 8708 - DNA, 40 bp, Artificial Sequence
  PCR primer for ORF amplification
ggatccagctagcaaaatgaaacatccgtatgaggaattc

SEQ ID NO: 8709 - DNA, 40 bp, Artificial Sequence
  PCR primer for ORF amplification
ggatccagctagcaaaatgacaaaggaagaaatcgcagac

SEQ ID NO: 8710 - DNA, 40 bp, Artificial Sequence
  PCR primer for ORF amplification
ggatccagctagcaaaatgagagtatatcagttttgccga

SEQ ID NO: 8711 - DNA, 40 bp, Artificial Sequence
  PCR primer for ORF amplification
ggatccagctagcaaaatgagtggtaacacaactaacgtg

SEQ ID NO: 8712 - DNA, 40 bp, Artificial Sequence
  PCR primer for ORF amplification
ggatccagctagcaaaatggatccctttcacaatggcaat

SEQ ID NO: 8713 - DNA, 40 bp, Artificial Sequence
  PCR primer for ORF amplification
ggatccagctagcaaaatggccgccattagagactacaag

SEQ ID NO: 8714 - DNA, 40 bp, Artificial Sequence
  PCR primer for ORF amplification
ggatccagctagcaaaatggccgccgttagagactacaag

SEQ ID NO: 8715 - DNA, 40 bp, Artificial Sequence
  PCR primer for ORF amplification
ggatccagctagcaaaatggctagcactgcagtaatgatg

SEQ ID NO: 8716 - DNA, 40 bp, Artificial Sequence
  PCR primer for ORF amplification
ggatccagctagcaaaatggctattaaccaggcacatgtt

SEQ ID NO: 8717 - DNA, 40 bp, Artificial Sequence
  PCR primer for ORF amplification
ggatccagctagcaaaatgggtgaagattttatgcaccca

SEQ ID NO: 8718 - DNA, 40 bp, Artificial Sequence
  PCR primer for ORF amplification
ggatccagctagcaaaatgtaccaaaataatgtattgaat

SEQ ID NO: 8719 - DNA, 40 bp, Artificial Sequence
  PCR primer for ORF amplification
ggatccagctagcaaaatgtcctataaacaaacaacatat

SEQ ID NO: 8720 - DNA, 40 bp, Artificial Sequence
  PCR primer for ORF amplification
ggatccagctagcaaaatgttgttttcgtcttcatcttct

SEQ ID NO: 8721 - DNA, 40 bp, Artificial Sequence
  PCR primer for ORF amplification
ggatccagctagcaaaatgcaactatctaaaagtatacta

SEQ ID NO: 8722 - DNA, 40 bp, Artificial Sequence
  PCR primer for ORF amplification
ggatccagctagcaaaatggaacaccaagcacttcgaagg

SEQ ID NO: 8723 - DNA, 40 bp, Artificial Sequence
  PCR primer for ORF amplification
ggatccagctagcaaaatggagaaagatcaaatccagcct

SEQ ID NO: 8724 - DNA, 40 bp, Artificial Sequence
  PCR primer for ORF amplification
ggatccagctagcaaaatgggtatcaataatccaattcct

SEQ ID NO: 8725 - DNA, 40 bp, Artificial Sequence
  PCR primer for ORF amplification
ggatccagctagcaaaatgtcccaacgatcttcacaacac

SEQ ID NO: 8726 - DNA, 40 bp, Artificial Sequence
  PCR primer for ORF amplification
ggatccagctagcaaaatgaatgaaatcgatgagaaaaat

SEQ ID NO: 8727 - DNA, 40 bp, Artificial Sequence
  PCR primer for ORF amplification
ggatccagctagcaaaatgacgttgccgaaactcagtagc

SEQ ID NO: 8728 - DNA, 40 bp, Artificial Sequence
  PCR primer for ORF amplification
ggatccagctagcaaaatgattttctcactagatgaagaa

SEQ ID NO: 8729 - DNA, 40 bp, Artificial Sequence
  PCR primer for ORF amplification
ggatccagctagcaaaatgccaaaaaatcgtggtgtcttg

SEQ ID NO: 8730 - DNA, 40 bp, Artificial Sequence
  PCR primer for ORF amplification
ggatccagctagcaaaatggatgcaaagaaaaatactggt

SEQ ID NO: 8731 - DNA, 40 bp, Artificial Sequence
  PCR primer for ORF amplification
ggatccagctagcaaaatggctgccggtgaacaagtttct

SEQ ID NO: 8732 - DNA, 40 bp, Artificial Sequence
  PCR primer for ORF amplification
ggatccagctagcaaaatgtctcaagaacagtacacagaa

SEQ ID NO: 8733 - DNA, 40 bp, Artificial Sequence
  PCR primer for ORF amplification
ggatccagctagcaaaatgtgcgggattctattgcattat

SEQ ID NO: 8734 - DNA, 40 bp, Artificial Sequence
  PCR primer for ORF amplification
ggatccagctagcaaaatgaatagtgcatctttcttacaa

SEQ ID NO: 8735 - DNA, 40 bp, Artificial Sequence
  PCR primer for ORF amplification
ggatccagctagcaaaatgacaatttctaatttgttaaag

SEQ ID NO: 8736 - DNA, 40 bp, Artificial Sequence
  PCR primer for ORF amplification
ggatccagctagcaaaatgacattgactatcaaaatagga

SEQ ID NO: 8737 - DNA, 40 bp, Artificial Sequence
  PCR primer for ORF amplification
ggatccagctagcaaaatgcctgactctaagtacacaatg

SEQ ID NO: 8738 - DNA, 40 bp, Artificial Sequence
  PCR primer for ORF amplification
ggatccagctagcaaaatggcacaaaacaattttgatttt

SEQ ID NO: 8739 - DNA, 40 bp, Artificial Sequence
  PCR primer for ORF amplification
ggatccagctagcaaaatgtccaccctttttctgattgga

SEQ ID NO: 8740 - DNA, 40 bp, Artificial Sequence
  PCR primer for ORF amplification
ggatccagctagcaaaatgtctactatcccatttagaaag

SEQ ID NO: 8741 - DNA, 40 bp, Artificial Sequence
  PCR primer for ORF amplification
ggatccagctagcaaaatgtggatactcatatacctattt

SEQ ID NO: 8742 - DNA, 40 bp, Artificial Sequence
  PCR primer for ORF amplification
ggatccagctagcaaaatgaatgtcatattttctttggcg

SEQ ID NO: 8743 - DNA, 40 bp, Artificial Sequence
  PCR primer for ORF amplification
ggatccagctagcaaaatgagtctctcgcaggtgtcacct

SEQ ID NO: 8744 - DNA, 40 bp, Artificial Sequence
  PCR primer for ORF amplification
ggatccagctagcaaaatgagtgacttacaagaccaagaa

SEQ ID NO: 8745 - DNA, 40 bp, Artificial Sequence
  PCR primer for ORF amplification
ggatccagctagcaaaatgagtgtacagatatttggagac

SEQ ID NO: 8746 - DNA, 40 bp, Artificial Sequence
  PCR primer for ORF amplification
ggatccagctagcaaaatgccaatggatttccaacctaca

SEQ ID NO: 8747 - DNA, 40 bp, Artificial Sequence
  PCR primer for ORF amplification
ggatccagctagcaaaatgcctcaaaatacaagacacacg

SEQ ID NO: 8748 - DNA, 40 bp, Artificial Sequence
  PCR primer for ORF amplification
ggatccagctagcaaaatggctgatgaaaagagactggag

SEQ ID NO: 8749 - DNA, 40 bp, Artificial Sequence
  PCR primer for ORF amplification
ggatccagctagcaaaatggcttctacttcgaacacgttc

SEQ ID NO: 8750 - DNA, 40 bp, Artificial Sequence
  PCR primer for ORF amplification
ggatccagctagcaaaatgaaattgtcttccgcttttgta

SEQ ID NO: 8751 - DNA, 40 bp, Artificial Sequence
  PCR primer for ORF amplification
ggatccagctagcaaaatgaattatggcgtggagaagctg

SEQ ID NO: 8752 - DNA, 40 bp, Artificial Sequence
  PCR primer for ORF amplification
ggatccagctagcaaaatgactaaatctcattcagaagaa

SEQ ID NO: 8753 - DNA, 40 bp, Artificial Sequence
  PCR primer for ORF amplification
ggatccagctagcaaaatgagctatggaactataaatgat

SEQ ID NO: 8754 - DNA, 40 bp, Artificial Sequence
  PCR primer for ORF amplification
ggatccagctagcaaaatgcaaaatgctcaaataaagagc

SEQ ID NO: 8755 - DNA, 40 bp, Artificial Sequence
  PCR primer for ORF amplification
ggatccagctagcaaaatgcaacaaaacacgtctttatat

SEQ ID NO: 8756 - DNA, 40 bp, Artificial Sequence
  PCR primer for ORF amplification
ggatccagctagcaaaatgcctcaaacgcacgaaatgtcc

SEQ ID NO: 8757 - DNA, 40 bp, Artificial Sequence
  PCR primer for ORF amplification
ggatccagctagcaaaatgtcctacaataatggcaatact

SEQ ID NO: 8758 - DNA, 40 bp, Artificial Sequence
  PCR primer for ORF amplification
ggatccagctagcaaaatgtctgctaaagttccatctaac

SEQ ID NO: 8759 - DNA, 40 bp, Artificial Sequence
  PCR primer for ORF amplification
ggatccagctagcaaaatgttcaggcagtcaaaaagaaga

SEQ ID NO: 8760 - DNA, 40 bp, Artificial Sequence
  PCR primer for ORF amplification
ggatccagctagcaaaatgtttggaatacgttcaggcaat

SEQ ID NO: 8761 - DNA, 40 bp, Artificial Sequence
  PCR primer for ORF amplification
ggatccagctagcaaaatgactataagcgaagctcgtcta

SEQ ID NO: 8762 - DNA, 40 bp, Artificial Sequence
  PCR primer for ORF amplification
ggatccagctagcaaaatggttttggaataccaacaaagg

SEQ ID NO: 8763 - DNA, 40 bp, Artificial Sequence
  PCR primer for ORF amplification
ggatccagctagcaaaatgtgcactccagatgaaaacgat

SEQ ID NO: 8764 - DNA, 40 bp, Artificial Sequence
  PCR primer for ORF amplification
ggatccagctagcaaaatgaaggagaatgacatgaataat

SEQ ID NO: 8765 - DNA, 40 bp, Artificial Sequence
  PCR primer for ORF amplification
ggatccagctagcaaaatgaatttacttgaaacaaggagg

SEQ ID NO: 8766 - DNA, 40 bp, Artificial Sequence
  PCR primer for ORF amplification
ggatccagctagcaaaatgacaagaaagcaggctattgac

SEQ ID NO: 8767 - DNA, 40 bp, Artificial Sequence
  PCR primer for ORF amplification
ggatccagctagcaaaatgattagctcagaattaacgaat

SEQ ID NO: 8768 - DNA, 40 bp, Artificial Sequence
  PCR primer for ORF amplification
ggatccagctagcaaaatgccagaaaagttagccatgtca

SEQ ID NO: 8769 - DNA, 40 bp, Artificial Sequence
  PCR primer for ORF amplification
ggatccagctagcaaaatgctaagaaacattttggtgaga

SEQ ID NO: 8770 - DNA, 40 bp, Artificial Sequence
  PCR primer for ORF amplification
ggatccagctagcaaaatgtctgctaccaagtcaatcgtt

SEQ ID NO: 8771 - DNA, 40 bp, Artificial Sequence
  PCR primer for ORF amplification
ggatccagctagcaaaatggcttctacggaacttagccta

SEQ ID NO: 8772 - DNA, 40 bp, Artificial Sequence
  PCR primer for ORF amplification
ggatccagctagcaaaatgtcaaaagttgacgtaaaaatt

SEQ ID NO: 8773 - DNA, 40 bp, Artificial Sequence
  PCR primer for ORF amplification
ggatccagctagcaaaatgaaagcattcaccagtttacta

SEQ ID NO: 8774 - DNA, 40 bp, Artificial Sequence
  PCR primer for ORF amplification
ggatccagctagcaaaatgcttttgcaagctttccttttc

SEQ ID NO: 8775 - DNA, 40 bp, Artificial Sequence
  PCR primer for ORF amplification
ggatccagctagcaaaatggatagaacgtggctattactg

SEQ ID NO: 8776 - DNA, 40 bp, Artificial Sequence
  PCR primer for ORF amplification
ggatccagctagcaaaatgtcaaacgacggctcaaaaata

SEQ ID NO: 8777 - DNA, 40 bp, Artificial Sequence
  PCR primer for ORF amplification
ggatccagctagcaaaatgaacttgtggagacatagtcca

SEQ ID NO: 8778 - DNA, 40 bp, Artificial Sequence
  PCR primer for ORF amplification
ggatccagctagcaaaatgacagaagataatattgctcca

SEQ ID NO: 8779 - DNA, 40 bp, Artificial Sequence
  PCR primer for ORF amplification
ggatccagctagcaaaatggagcgattgaagcaactggag

SEQ ID NO: 8780 - DNA, 40 bp, Artificial Sequence
  PCR primer for ORF amplification
ggatccagctagcaaaatgtcagcacctgttcctcaatta

SEQ ID NO: 8781 - DNA, 40 bp, Artificial Sequence
  PCR primer for ORF amplification
ggatccagctagcaaaatgttggaagagggaaataatgtt

SEQ ID NO: 8782 - DNA, 40 bp, Artificial Sequence
  PCR primer for ORF amplification
ggatccagctagcaaaatgagcaacaaatttacaatggag

SEQ ID NO: 8783 - DNA, 40 bp, Artificial Sequence
  PCR primer for ORF amplification
ggatccagctagcaaaatgagctctgacgaagaagatttc

SEQ ID NO: 8784 - DNA, 40 bp, Artificial Sequence
  PCR primer for ORF amplification
ggatccagctagcaaaatgcaagctccagtggtatttatg

SEQ ID NO: 8785 - DNA, 40 bp, Artificial Sequence
  PCR primer for ORF amplification
ggatccagctagcaaaatgcatcaccaaactaagttagat

SEQ ID NO: 8786 - DNA, 40 bp, Artificial Sequence
  PCR primer for ORF amplification
ggatccagctagcaaaatggaaaaatcactagcggatcaa

SEQ ID NO: 8787 - DNA, 40 bp, Artificial Sequence
  PCR primer for ORF amplification
ggatccagctagcaaaatggaagttgcaccggccttatcg

SEQ ID NO: 8788 - DNA, 40 bp, Artificial Sequence
  PCR primer for ORF amplification
ggatccagctagcaaaatgtacaccaattattcacttaca

SEQ ID NO: 8789 - DNA, 40 bp, Artificial Sequence
  PCR primer for ORF amplification
ggatccagctagcaaaatgtccaatgcaaatctaagaaaa

SEQ ID NO: 8790 - DNA, 40 bp, Artificial Sequence
  PCR primer for ORF amplification
ggatccagctagcaaaatgagtataacaagtgaagaacta

SEQ ID NO: 8791 - DNA, 40 bp, Artificial Sequence
  PCR primer for ORF amplification
ggatccagctagcaaaatggaagatatagaaggatacgaa

SEQ ID NO: 8792 - DNA, 40 bp, Artificial Sequence
  PCR primer for ORF amplification
ggatccagctagcaaaatgggcatgttttttaatttaagg

SEQ ID NO: 8793 - DNA, 40 bp, Artificial Sequence
  PCR primer for ORF amplification
ggatccagctagcaaaatgtgccttgaaccaatctctctt

SEQ ID NO: 8794 - DNA, 40 bp, Artificial Sequence
  PCR primer for ORF amplification
ggatccagctagcaaaatgacatttactagcaacttgccc

SEQ ID NO: 8795 - DNA, 40 bp, Artificial Sequence
  PCR primer for ORF amplification
ggatccagctagcaaaatgatcatgttgagaataccgaca

SEQ ID NO: 8796 - DNA, 40 bp, Artificial Sequence
  PCR primer for ORF amplification
ggatccagctagcaaaatgcaattgatttccatcctctct

SEQ ID NO: 8797 - DNA, 40 bp, Artificial Sequence
  PCR primer for ORF amplification
ggatccagctagcaaaatgcacttttctttgaagcaattg

SEQ ID NO: 8798 - DNA, 40 bp, Artificial Sequence
  PCR primer for ORF amplification
ggatccagctagcaaaatgagatttgtgttcgatgaggtt

SEQ ID NO: 8799 - DNA, 40 bp, Artificial Sequence
  PCR primer for ORF amplification
ggatccagctagcaaaatgagttctgtcgcagaaaatata

SEQ ID NO: 8800 - DNA, 40 bp, Artificial Sequence
  PCR primer for ORF amplification
ggatccagctagcaaaatggccaccaccacgcaaccacaa

SEQ ID NO: 8801 - DNA, 40 bp, Artificial Sequence
  PCR primer for ORF amplification
ggatccagctagcaaaatggtaaataaggtggttgatgag

SEQ ID NO: 8802 - DNA, 40 bp, Artificial Sequence
  PCR primer for ORF amplification
ggatccagctagcaaaatgtccatgcccatagcaagtacc

SEQ ID NO: 8803 - DNA, 40 bp, Artificial Sequence
  PCR primer for ORF amplification
ggatccagctagcaaaatgtcctctccagtgattggtatc

SEQ ID NO: 8804 - DNA, 40 bp, Artificial Sequence
  PCR primer for ORF amplification
ggatccagctagcaaaatgagtaccaataagttcgttgta

SEQ ID NO: 8805 - DNA, 40 bp, Artificial Sequence
  PCR primer for ORF amplification
ggatccagctagcaaaatgcaattcaagaacgctttgact

SEQ ID NO: 8806 - DNA, 40 bp, Artificial Sequence
  PCR primer for ORF amplification
ggatccagctagcaaaatgcatcgtaaatcattgaggagg

SEQ ID NO: 8807 - DNA, 40 bp, Artificial Sequence
  PCR primer for ORF amplification
ggatccagctagcaaaatgccattgaatgaaaaatacgag

SEQ ID NO: 8808 - DNA, 40 bp, Artificial Sequence
  PCR primer for ORF amplification
ggatccagctagcaaaatgtcttccaatccagaaaattct

SEQ ID NO: 8809 - DNA, 40 bp, Artificial Sequence
  PCR primer for ORF amplification
ggatccagctagcaaaatgttattaccattaacaaagcta

SEQ ID NO: 8810 - DNA, 40 bp, Artificial Sequence
  PCR primer for ORF amplification
ggatccagctagcaaaatgacagcaatgaaagctattgtc

SEQ ID NO: 8811 - DNA, 40 bp, Artificial Sequence
  PCR primer for ORF amplification
ggatccagctagcaaaatgactgctcagattccgtatcaa

SEQ ID NO: 8812 - DNA, 40 bp, Artificial Sequence
  PCR primer for ORF amplification
ggatccagctagcaaaatgatgctaagaactactgcctca

SEQ ID NO: 8813 - DNA, 40 bp, Artificial Sequence
  PCR primer for ORF amplification
ggatccagctagcaaaatggtatttactaaggaagaagtt

SEQ ID NO: 8814 - DNA, 40 bp, Artificial Sequence
  PCR primer for ORF amplification
ggatccagctagcaaaatgttttcaatcttcaaaaagaaa

SEQ ID NO: 8815 - DNA, 40 bp, Artificial Sequence
  PCR primer for ORF amplification
ggatccagctagcaaaatgcctatcttatcactatcttca

SEQ ID NO: 8816 - DNA, 40 bp, Artificial Sequence
  PCR primer for ORF amplification
ggatccagctagcaaaatggttttggctgatttggggaag

SEQ ID NO: 8817 - DNA, 40 bp, Artificial Sequence
  PCR primer for ORF amplification
ggatccagctagcaaaatgtctgaattcgctactagccgc

SEQ ID NO: 8818 - DNA, 40 bp, Artificial Sequence
  PCR primer for ORF amplification
ggatccagctagcaaaatgttgcggcttgcacgtttttat

SEQ ID NO: 8819 - DNA, 40 bp, Artificial Sequence
  PCR primer for ORF amplification
ggatccagctagcaaaatgtttggtttcagcggtagtaat

SEQ ID NO: 8820 - DNA, 40 bp, Artificial Sequence
  PCR primer for ORF amplification
ggatccagctagcaaaatgaatagcagtctgcaagttggc

SEQ ID NO: 8821 - DNA, 40 bp, Artificial Sequence
  PCR primer for ORF amplification
ggatccagctagcaaaatgatttcacccataagctttcta

SEQ ID NO: 8822 - DNA, 40 bp, Artificial Sequence
  PCR primer for ORF amplification
ggatccagctagcaaaatgcaagctaaaattatatatgct

SEQ ID NO: 8823 - DNA, 40 bp, Artificial Sequence
  PCR primer for ORF amplification
ggatccagctagcaaaatggataatggtacagattcttcc

SEQ ID NO: 8824 - DNA, 40 bp, Artificial Sequence
  PCR primer for ORF amplification
ggatccagctagcaaaatggcaggagcaacatcaagtata

SEQ ID NO: 8825 - DNA, 40 bp, Artificial Sequence
  PCR primer for ORF amplification
ggatccagctagcaaaatgggcaatcagtcattagttgtg

SEQ ID NO: 8826 - DNA, 40 bp, Artificial Sequence
  PCR primer for ORF amplification
ggatccagctagcaaaatgtccgtacaaaaagaagaatac

SEQ ID NO: 8827 - DNA, 40 bp, Artificial Sequence
  PCR primer for ORF amplification
ggatccagctagcaaaatgtcgttactgagactgtggaac

SEQ ID NO: 8828 - DNA, 40 bp, Artificial Sequence
  PCR primer for ORF amplification
ggatccagctagcaaaatgaagagtactttgagtttaact

SEQ ID NO: 8829 - DNA, 40 bp, Artificial Sequence
  PCR primer for ORF amplification
ggatccagctagcaaaatgacaagtgccgctactgttact

SEQ ID NO: 8830 - DNA, 40 bp, Artificial Sequence
  PCR primer for ORF amplification
ggatccagctagcaaaatgacagcagaagatatactcctt

SEQ ID NO: 8831 - DNA, 40 bp, Artificial Sequence
  PCR primer for ORF amplification
ggatccagctagcaaaatgatggactcgtcaagcaaaagc

SEQ ID NO: 8832 - DNA, 40 bp, Artificial Sequence
  PCR primer for ORF amplification
ggatccagctagcaaaatgtcagcggatgctagtacaaat

SEQ ID NO: 8833 - DNA, 40 bp, Artificial Sequence
  PCR primer for ORF amplification
ggatccagctagcaaaatggataaatatactgctttgatt

SEQ ID NO: 8834 - DNA, 40 bp, Artificial Sequence
  PCR primer for ORF amplification
ggatccagctagcaaaatggccattggcaaaaggttactg

SEQ ID NO: 8835 - DNA, 40 bp, Artificial Sequence
  PCR primer for ORF amplification
ggatccagctagcaaaatgtcacgagaaacaaatttcaat

SEQ ID NO: 8836 - DNA, 40 bp, Artificial Sequence
  PCR primer for ORF amplification
ggatccagctagcaaaatgtctgaagagaatttgaggcct

SEQ ID NO: 8837 - DNA, 40 bp, Artificial Sequence
  PCR primer for ORF amplification
ggatccagctagcaaaatgagagaggtcattagtattaat

SEQ ID NO: 8838 - DNA, 40 bp, Artificial Sequence
  PCR primer for ORF amplification
ggatccagctagcaaaatgctgcccagacttggttttgcg

SEQ ID NO: 8839 - DNA, 40 bp, Artificial Sequence
  PCR primer for ORF amplification
ggatccagctagcaaaatggcaacagacctaaatcgtaaa

SEQ ID NO: 8840 - DNA, 40 bp, Artificial Sequence
  PCR primer for ORF amplification
ggatccagctagcaaaatggctagtgctgaaccaagaccc

SEQ ID NO: 8841 - DNA, 40 bp, Artificial Sequence
  PCR primer for ORF amplification
ggatccagctagcaaaatgttggctcgtactgctgctatt

SEQ ID NO: 8842 - DNA, 40 bp, Artificial Sequence
  PCR primer for ORF amplification
ggatccagctagcaaaatgaaccactcagaagtgaaaact

SEQ ID NO: 8843 - DNA, 40 bp, Artificial Sequence
  PCR primer for ORF amplification
ggatccagctagcaaaatgctacggtctactatatctcta

SEQ ID NO: 8844 - DNA, 40 bp, Artificial Sequence
  PCR primer for ORF amplification
ggatccagctagcaaaatgcttagtagatcactaaataaa

SEQ ID NO: 8845 - DNA, 40 bp, Artificial Sequence
  PCR primer for ORF amplification
ggatccagctagcaaaatggaaccgctgctttttaatagt

SEQ ID NO: 8846 - DNA, 40 bp, Artificial Sequence
  PCR primer for ORF amplification
ggatccagctagcaaaatggcatccccaggatcgacagca

SEQ ID NO: 8847 - DNA, 40 bp, Artificial Sequence
  PCR primer for ORF amplification
ggatccagctagcaaaatggtggttttggctgcttctatc

SEQ ID NO: 8848 - DNA, 40 bp, Artificial Sequence
  PCR primer for ORF amplification
ggatccagctagcaaaatggttagttcaagtgtttccatt

SEQ ID NO: 8849 - DNA, 40 bp, Artificial Sequence
  PCR primer for ORF amplification
ggatccagctagcaaaatgtcattgcaattgttgaatccg

SEQ ID NO: 8850 - DNA, 40 bp, Artificial Sequence
  PCR primer for ORF amplification
ggatccagctagcaaaatgtctcaagtgcaaagtcctttg

SEQ ID NO: 8851 - DNA, 40 bp, Artificial Sequence
  PCR primer for ORF amplification
ggatccagctagcaaaatgacgaaaataaccagagatgtt

SEQ ID NO: 8852 - DNA, 40 bp, Artificial Sequence
  PCR primer for ORF amplification
ggatccagctagcaaaatgactaaatcggttggtgatgaa

SEQ ID NO: 8853 - DNA, 40 bp, Artificial Sequence
  PCR primer for ORF amplification
ggatccagctagcaaaatggtaaagaaacaccaaaatagt

SEQ ID NO: 8854 - DNA, 40 bp, Artificial Sequence
  PCR primer for ORF amplification
ggatccagctagcaaaatggtccgattaaatcatgcagca

SEQ ID NO: 8855 - DNA, 40 bp, Artificial Sequence
  PCR primer for ORF amplification
ggatccagctagcaaaatgatagtgtggcaagcactattc

SEQ ID NO: 8856 - DNA, 40 bp, Artificial Sequence
  PCR primer for ORF amplification
ggatccagctagcaaaatgcaacgctccatttttgcgagg

SEQ ID NO: 8857 - DNA, 40 bp, Artificial Sequence
  PCR primer for ORF amplification
ggatccagctagcaaaatgcataaaggaaaaaaaaattac

SEQ ID NO: 8858 - DNA, 40 bp, Artificial Sequence
  PCR primer for ORF amplification
ggatccagctagcaaaatgggcagtgcttggacaaactac

SEQ ID NO: 8859 - DNA, 40 bp, Artificial Sequence
  PCR primer for ORF amplification
ggatccagctagcaaaatggtatacacttcaacgtacaga

SEQ ID NO: 8860 - DNA, 40 bp, Artificial Sequence
  PCR primer for ORF amplification
ggatccagctagcaaaatgtacttcccctttttaggcaga

SEQ ID NO: 8861 - DNA, 40 bp, Artificial Sequence
  PCR primer for ORF amplification
ggatccagctagcaaaatgtatataaaggcagaacagaaa

SEQ ID NO: 8862 - DNA, 40 bp, Artificial Sequence
  PCR primer for ORF amplification
ggatccagctagcaaaatgttggaatgtctaagcgctctg

SEQ ID NO: 8863 - DNA, 40 bp, Artificial Sequence
  PCR primer for ORF amplification
ggatccagctagcaaaatgaaactagaacgcgtaagcagc

SEQ ID NO: 8864 - DNA, 40 bp, Artificial Sequence
  PCR primer for ORF amplification
ggatccagctagcaaaatgaagaactctgtcggtatttca

SEQ ID NO: 8865 - DNA, 40 bp, Artificial Sequence
  PCR primer for ORF amplification
ggatccagctagcaaaatgacgtcccaagaatatgaacct

SEQ ID NO: 8866 - DNA, 40 bp, Artificial Sequence
  PCR primer for ORF amplification
ggatccagctagcaaaatgactgtgcactcaacgtggaag

SEQ ID NO: 8867 - DNA, 40 bp, Artificial Sequence
  PCR primer for ORF amplification
ggatccagctagcaaaatgagaagaagcccgtccagatca

SEQ ID NO: 8868 - DNA, 40 bp, Artificial Sequence
  PCR primer for ORF amplification
ggatccagctagcaaaatgagttacactgacaaccctcct

SEQ ID NO: 8869 - DNA, 40 bp, Artificial Sequence
  PCR primer for ORF amplification
ggatccagctagcaaaatggattatatgaaattggggctt

SEQ ID NO: 8870 - DNA, 40 bp, Artificial Sequence
  PCR primer for ORF amplification
ggatccagctagcaaaatggcaagacaaaagatgttttat

SEQ ID NO: 8871 - DNA, 40 bp, Artificial Sequence
  PCR primer for ORF amplification
ggatccagctagcaaaatgtccccttctaaaatgaatgct

SEQ ID NO: 8872 - DNA, 40 bp, Artificial Sequence
  PCR primer for ORF amplification
ggatccagctagcaaaatgaactttggaagccaaacacct

SEQ ID NO: 8873 - DNA, 40 bp, Artificial Sequence
  PCR primer for ORF amplification
ggatccagctagcaaaatgtcattcaagtttctgatagaa

SEQ ID NO: 8874 - DNA, 40 bp, Artificial Sequence
  PCR primer for ORF amplification
ggatccagctagcaaaatgaagaaaaattcttcggtagtt

SEQ ID NO: 8875 - DNA, 40 bp, Artificial Sequence
  PCR primer for ORF amplification
ggatccagctagcaaaatgacctattctacagttaatatt

SEQ ID NO: 8876 - DNA, 40 bp, Artificial Sequence
  PCR primer for ORF amplification
ggatccagctagcaaaatgacctattctacagttagcatc

SEQ ID NO: 8877 - DNA, 40 bp, Artificial Sequence
  PCR primer for ORF amplification
ggatccagctagcaaaatgacttcggctgtaccttatgat

SEQ ID NO: 8878 - DNA, 40 bp, Artificial Sequence
  PCR primer for ORF amplification
ggatccagctagcaaaatgagcactgcttcaacaccgcca

SEQ ID NO: 8879 - DNA, 40 bp, Artificial Sequence
  PCR primer for ORF amplification
ggatccagctagcaaaatgagtagtggtaccgaaaatgat

SEQ ID NO: 8880 - DNA, 40 bp, Artificial Sequence
  PCR primer for ORF amplification
ggatccagctagcaaaatgcgtaggagtgtatacctcgac

SEQ ID NO: 8881 - DNA, 40 bp, Artificial Sequence
  PCR primer for ORF amplification
ggatccagctagcaaaatgcgttggtctgtccttgataca

SEQ ID NO: 8882 - DNA, 40 bp, Artificial Sequence
  PCR primer for ORF amplification
ggatccagctagcaaaatgctgaaaaacttcaaactctca

SEQ ID NO: 8883 - DNA, 40 bp, Artificial Sequence
  PCR primer for ORF amplification
ggatccagctagcaaaatggcaagctgcaatccgaccagg

SEQ ID NO: 8884 - DNA, 40 bp, Artificial Sequence
  PCR primer for ORF amplification
ggatccagctagcaaaatggcatcgcaggctacaactctt

SEQ ID NO: 8885 - DNA, 40 bp, Artificial Sequence
  PCR primer for ORF amplification
ggatccagctagcaaaatggtgccagaaaatagaaggaaa

SEQ ID NO: 8886 - DNA, 40 bp, Artificial Sequence
  PCR primer for ORF amplification
ggatccagctagcaaaatgtcacaatttgttggtttcgga

SEQ ID NO: 8887 - DNA, 40 bp, Artificial Sequence
  PCR primer for ORF amplification
ggatccagctagcaaaatgtttgcatccgctggacaacaa

SEQ ID NO: 8888 - DNA, 40 bp, Artificial Sequence
  PCR primer for ORF amplification
ggatccagctagcaaaatgagtaccgactttgatagaatt

SEQ ID NO: 8889 - DNA, 40 bp, Artificial Sequence
  PCR primer for ORF amplification
ggatccagctagcaaaatgccggtcgttcacgtgattgac

SEQ ID NO: 8890 - DNA, 40 bp, Artificial Sequence
  PCR primer for ORF amplification
ggatccagctagcaaaatggaggcacttatcgtatttata

SEQ ID NO: 8891 - DNA, 40 bp, Artificial Sequence
  PCR primer for ORF amplification
ggatccagctagcaaaatgggtaaaattgcagagtttctc

SEQ ID NO: 8892 - DNA, 40 bp, Artificial Sequence
  PCR primer for ORF amplification
ggatccagctagcaaaatggtattgcttatatcagaaatt

SEQ ID NO: 8893 - DNA, 40 bp, Artificial Sequence
  PCR primer for ORF amplification
ggatccagctagcaaaatgtccgtaacttttaaggacgat

SEQ ID NO: 8894 - DNA, 40 bp, Artificial Sequence
  PCR primer for ORF amplification
ggatccagctagcaaaatgcaagtagaagggcctgacact

SEQ ID NO: 8895 - DNA, 40 bp, Artificial Sequence
  PCR primer for ORF amplification
ggatccagctagcaaaatggcattccaagatcaagatata

SEQ ID NO: 8896 - DNA, 40 bp, Artificial Sequence
  PCR primer for ORF amplification
ggatccagctagcaaaatggccgctgagtatgtatacgaa

SEQ ID NO: 8897 - DNA, 40 bp, Artificial Sequence
  PCR primer for ORF amplification
ggatccagctagcaaaatgtcgaaagacttgaattcttca

SEQ ID NO: 8898 - DNA, 40 bp, Artificial Sequence
  PCR primer for ORF amplification
ggatccagctagcaaaatgaacaatatatttcatggaact

SEQ ID NO: 8899 - DNA, 40 bp, Artificial Sequence
  PCR primer for ORF amplification
ggatccagctagcaaaatgacacctaacttaccagggttt

SEQ ID NO: 8900 - DNA, 40 bp, Artificial Sequence
  PCR primer for ORF amplification
ggatccagctagcaaaatgaccgcaaagacttttctacta

SEQ ID NO: 8901 - DNA, 40 bp, Artificial Sequence
  PCR primer for ORF amplification
ggatccagctagcaaaatggacagagatataagctaccag

SEQ ID NO: 8902 - DNA, 40 bp, Artificial Sequence
  PCR primer for ORF amplification
ggatccagctagcaaaatggactcggtgacaaattttttc

SEQ ID NO: 8903 - DNA, 40 bp, Artificial Sequence
  PCR primer for ORF amplification
ggatccagctagcaaaatgggtcacaagaagaacggtcac

SEQ ID NO: 8904 - DNA, 40 bp, Artificial Sequence
  PCR primer for ORF amplification
ggatccagctagcaaaatggtgaagataagcttggacaac

SEQ ID NO: 8905 - DNA, 40 bp, Artificial Sequence
  PCR primer for ORF amplification
ggatccagctagcaaaatggttaaggtcagtttggataac

SEQ ID NO: 8906 - DNA, 40 bp, Artificial Sequence
  PCR primer for ORF amplification
ggatccagctagcaaaatgtcatctttgtacattaaggag

SEQ ID NO: 8907 - DNA, 40 bp, Artificial Sequence
  PCR primer for ORF amplification
ggatccagctagcaaaatgtccaataactcattcactaac

SEQ ID NO: 8908 - DNA, 40 bp, Artificial Sequence
  PCR primer for ORF amplification
ggatccagctagcaaaatgaacaagaaacaaaatttttac

SEQ ID NO: 8909 - DNA, 40 bp, Artificial Sequence
  PCR primer for ORF amplification
ggatccagctagcaaaatgaattgcaaggcggtaaccatt

SEQ ID NO: 8910 - DNA, 40 bp, Artificial Sequence
  PCR primer for ORF amplification
ggatccagctagcaaaatggatgagcaagttatttttaca

SEQ ID NO: 8911 - DNA, 40 bp, Artificial Sequence
  PCR primer for ORF amplification
ggatccagctagcaaaatgtataatggcaaggatagagca

SEQ ID NO: 8912 - DNA, 40 bp, Artificial Sequence
  PCR primer for ORF amplification
ggatccagctagcaaaatgtcaaacgaggatgaaacaact

SEQ ID NO: 8913 - DNA, 40 bp, Artificial Sequence
  PCR primer for ORF amplification
ggatccagctagcaaaatgtctacagatgaaagtgaagac

SEQ ID NO: 8914 - DNA, 40 bp, Artificial Sequence
  PCR primer for ORF amplification
ggatccagctagcaaaatgcaacacaaggatacggcagta

SEQ ID NO: 8915 - DNA, 40 bp, Artificial Sequence
  PCR primer for ORF amplification
ggatccagctagcaaaatggaaagagtatggtttgcaaaa

SEQ ID NO: 8916 - DNA, 40 bp, Artificial Sequence
  PCR primer for ORF amplification
ggatccagctagcaaaatggatggtgcgttgataaattcc

SEQ ID NO: 8917 - DNA, 40 bp, Artificial Sequence
  PCR primer for ORF amplification
ggatccagctagcaaaatgttgaatctgtgtcatgctctt

SEQ ID NO: 8918 - DNA, 40 bp, Artificial Sequence
  PCR primer for ORF amplification
ggatccagctagcaaaatgtttgataagttaccttatgag

SEQ ID NO: 8919 - DNA, 40 bp, Artificial Sequence
  PCR primer for ORF amplification
ggatccagctagcaaaatgaaggttgattacgagcaattg

SEQ ID NO: 8920 - DNA, 40 bp, Artificial Sequence
  PCR primer for ORF amplification
ggatccagctagcaaaatgaagtgccaaacatgtcactta

SEQ ID NO: 8921 - DNA, 40 bp, Artificial Sequence
  PCR primer for ORF amplification
ggatccagctagcaaaatgagcgacactgaaaaggataag

SEQ ID NO: 8922 - DNA, 40 bp, Artificial Sequence
  PCR primer for ORF amplification
ggatccagctagcaaaatgccacaaagaattgagcttacc

SEQ ID NO: 8923 - DNA, 40 bp, Artificial Sequence
  PCR primer for ORF amplification
ggatccagctagcaaaatgcctatccccgttggaaatacg

SEQ ID NO: 8924 - DNA, 40 bp, Artificial Sequence
  PCR primer for ORF amplification
ggatccagctagcaaaatggctcgtcatggaaaaggccca

SEQ ID NO: 8925 - DNA, 40 bp, Artificial Sequence
  PCR primer for ORF amplification
ggatccagctagcaaaatgtctcaagacgaaaatattgtc

SEQ ID NO: 8926 - DNA, 40 bp, Artificial Sequence
  PCR primer for ORF amplification
ggatccagctagcaaaatgagaagaaaaaatcgactgttt

SEQ ID NO: 8927 - DNA, 40 bp, Artificial Sequence
  PCR primer for ORF amplification
ggatccagctagcaaaatggcacacatcccagaggtttta

SEQ ID NO: 8928 - DNA, 40 bp, Artificial Sequence
  PCR primer for ORF amplification
ggatccagctagcaaaatggcagtccttaacttgaaacgt

SEQ ID NO: 8929 - DNA, 40 bp, Artificial Sequence
  PCR primer for ORF amplification
ggatccagctagcaaaatgggacctccgaaaaatttcaag

SEQ ID NO: 8930 - DNA, 40 bp, Artificial Sequence
  PCR primer for ORF amplification
ggatccagctagcaaaatgtctgatttagatgaggattta

SEQ ID NO: 8931 - DNA, 40 bp, Artificial Sequence
  PCR primer for ORF amplification
ggatccagctagcaaaatgatggaagaattctcgtacgat

SEQ ID NO: 8932 - DNA, 40 bp, Artificial Sequence
  PCR primer for ORF amplification
ggatccagctagcaaaatgtcccaattattcaataactcg

SEQ ID NO: 8933 - DNA, 40 bp, Artificial Sequence
  PCR primer for ORF amplification
ggatccagctagcaaaatgttgtttaaatccctttcaaag

SEQ ID NO: 8934 - DNA, 40 bp, Artificial Sequence
  PCR primer for ORF amplification
ggatccagctagcaaaatgaattggtcttttctactacag

SEQ ID NO: 8935 - DNA, 40 bp, Artificial Sequence
  PCR primer for ORF amplification
ggatccagctagcaaaatgaccacgaccgctacccaacac

SEQ ID NO: 8936 - DNA, 40 bp, Artificial Sequence
  PCR primer for ORF amplification
ggatccagctagcaaaatgacttcaccggaatcactatct

SEQ ID NO: 8937 - DNA, 40 bp, Artificial Sequence
  PCR primer for ORF amplification
ggatccagctagcaaaatgattagacaatcattaatgaaa

SEQ ID NO: 8938 - DNA, 40 bp, Artificial Sequence
  PCR primer for ORF amplification
ggatccagctagcaaaatgcaagcccccaatatctacccc

SEQ ID NO: 8939 - DNA, 40 bp, Artificial Sequence
  PCR primer for ORF amplification
ggatccagctagcaaaatggaacctaagcgaaagagcggg

SEQ ID NO: 8940 - DNA, 40 bp, Artificial Sequence
  PCR primer for ORF amplification
ggatccagctagcaaaatggaatgttttgtaccgctgcgt

SEQ ID NO: 8941 - DNA, 40 bp, Artificial Sequence
  PCR primer for ORF amplification
ggatccagctagcaaaatggtactacttaaagaacctgtt

SEQ ID NO: 8942 - DNA, 40 bp, Artificial Sequence
  PCR primer for ORF amplification
ggatccagctagcaaaatgtcgctgatcagcatcctgtct

SEQ ID NO: 8943 - DNA, 40 bp, Artificial Sequence
  PCR primer for ORF amplification
ggatccagctagcaaaatgtctcaaagaaagctacaacag

SEQ ID NO: 8944 - DNA, 40 bp, Artificial Sequence
  PCR primer for ORF amplification
ggatccagctagcaaaatgaacagagtaggggcagtgttc

SEQ ID NO: 8945 - DNA, 40 bp, Artificial Sequence
  PCR primer for ORF amplification
ggatccagctagcaaaatgagtactcctgcaaactatacc

SEQ ID NO: 8946 - DNA, 40 bp, Artificial Sequence
  PCR primer for ORF amplification
ggatccagctagcaaaatgggcattttggactcgctgaaa

SEQ ID NO: 8947 - DNA, 40 bp, Artificial Sequence
  PCR primer for ORF amplification
ggatccagctagcaaaatgtcgctttttttcaagccagta

SEQ ID NO: 8948 - DNA, 40 bp, Artificial Sequence
  PCR primer for ORF amplification
ggatccagctagcaaaatgaacgtgttcggtaaaaaagaa

SEQ ID NO: 8949 - DNA, 40 bp, Artificial Sequence
  PCR primer for ORF amplification
ggatccagctagcaaaatgaccatcccacatatgaaatac

SEQ ID NO: 8950 - DNA, 40 bp, Artificial Sequence
  PCR primer for ORF amplification
ggatccagctagcaaaatgactgccgtcgcctctactagc

SEQ ID NO: 8951 - DNA, 40 bp, Artificial Sequence
  PCR primer for ORF amplification
ggatccagctagcaaaatgcaaacactagacgagacttca

SEQ ID NO: 8952 - DNA, 40 bp, Artificial Sequence
  PCR primer for ORF amplification
ggatccagctagcaaaatgcctttgaagtcgttttttttt

SEQ ID NO: 8953 - DNA, 40 bp, Artificial Sequence
  PCR primer for ORF amplification
ggatccagctagcaaaatggattcgcaagtgcccaataat

SEQ ID NO: 8954 - DNA, 40 bp, Artificial Sequence
  PCR primer for ORF amplification
ggatccagctagcaaaatggctgctcgtccacaacaacct

SEQ ID NO: 8955 - DNA, 40 bp, Artificial Sequence
  PCR primer for ORF amplification
ggatccagctagcaaaatgtcactcctttacatcattctt

SEQ ID NO: 8956 - DNA, 40 bp, Artificial Sequence
  PCR primer for ORF amplification
ggatccagctagcaaaatgaccaaacaacaaacttctgta

SEQ ID NO: 8957 - DNA, 40 bp, Artificial Sequence
  PCR primer for ORF amplification
ggatccagctagcaaaatgagattaagaaccgccattgcc

SEQ ID NO: 8958 - DNA, 40 bp, Artificial Sequence
  PCR primer for ORF amplification
ggatccagctagcaaaatgagtattcggaatgataatgct

SEQ ID NO: 8959 - DNA, 40 bp, Artificial Sequence
  PCR primer for ORF amplification
ggatccagctagcaaaatgcctatgaacaattttctagat

SEQ ID NO: 8960 - DNA, 40 bp, Artificial Sequence
  PCR primer for ORF amplification
ggatccagctagcaaaatgtctgaaataaccttaggtaaa

SEQ ID NO: 8961 - DNA, 40 bp, Artificial Sequence
  PCR primer for ORF amplification
ggatccagctagcaaaatgtctgaaattactcttggaaaa

SEQ ID NO: 8962 - DNA, 40 bp, Artificial Sequence
  PCR primer for ORF amplification
ggatccagctagcaaaatgtctgaaattactttgggtaaa

SEQ ID NO: 8963 - DNA, 40 bp, Artificial Sequence
  PCR primer for ORF amplification
ggatccagctagcaaaatgatgaatgaagacatatccatc

SEQ ID NO: 8964 - DNA, 40 bp, Artificial Sequence
  PCR primer for ORF amplification
ggatccagctagcaaaatgcaatcatccactgaaagtgat

SEQ ID NO: 8965 - DNA, 40 bp, Artificial Sequence
  PCR primer for ORF amplification
ggatccagctagcaaaatggatatttttagagtattaact

SEQ ID NO: 8966 - DNA, 40 bp, Artificial Sequence
  PCR primer for ORF amplification
ggatccagctagcaaaatgtctagtgcgcaatcctctatt

SEQ ID NO: 8967 - DNA, 40 bp, Artificial Sequence
  PCR primer for ORF amplification
ggatccagctagcaaaatgttttcacgaagtgatcgagag

SEQ ID NO: 8968 - DNA, 40 bp, Artificial Sequence
  PCR primer for ORF amplification
ggatccagctagcaaaatgaaaagaacggtaatatcttcc

SEQ ID NO: 8969 - DNA, 40 bp, Artificial Sequence
  PCR primer for ORF amplification
ggatccagctagcaaaatgtatcgcagtagaaaccgacca

SEQ ID NO: 8970 - DNA, 40 bp, Artificial Sequence
  PCR primer for ORF amplification
ggatccagctagcaaaatgtttaagaaggagcctcacata

SEQ ID NO: 8971 - DNA, 40 bp, Artificial Sequence
  PCR primer for ORF amplification
ggatccagctagcaaaatgacgaaaccgcgttacaatgac

SEQ ID NO: 8972 - DNA, 40 bp, Artificial Sequence
  PCR primer for ORF amplification
ggatccagctagcaaaatgatgactcacacattaccaagc

SEQ ID NO: 8973 - DNA, 40 bp, Artificial Sequence
  PCR primer for ORF amplification
ggatccagctagcaaaatgatgagtcccgcccaagataaa

SEQ ID NO: 8974 - DNA, 40 bp, Artificial Sequence
  PCR primer for ORF amplification
ggatccagctagcaaaatgcaggttcaaaaaatggtgaga

SEQ ID NO: 8975 - DNA, 40 bp, Artificial Sequence
  PCR primer for ORF amplification
ggatccagctagcaaaatggagtactggcattatgtggaa

SEQ ID NO: 8976 - DNA, 40 bp, Artificial Sequence
  PCR primer for ORF amplification
ggatccagctagcaaaatggtagaaggagactcttatgtg

SEQ ID NO: 8977 - DNA, 40 bp, Artificial Sequence
  PCR primer for ORF amplification
ggatccagctagcaaaatggttacagaaaatcctcaacgt

SEQ ID NO: 8978 - DNA, 40 bp, Artificial Sequence
  PCR primer for ORF amplification
ggatccagctagcaaaatgtccaaagtaatgaaacccagc

SEQ ID NO: 8979 - DNA, 40 bp, Artificial Sequence
  PCR primer for ORF amplification
ggatccagctagcaaaatgtccacaaacctgaacccattc

SEQ ID NO: 8980 - DNA, 40 bp, Artificial Sequence
  PCR primer for ORF amplification
ggatccagctagcaaaatggcaagcgaacagtcctcacca

SEQ ID NO: 8981 - DNA, 40 bp, Artificial Sequence
  PCR primer for ORF amplification
ggatccagctagcaaaatgaattcaactccagatttaata

SEQ ID NO: 8982 - DNA, 40 bp, Artificial Sequence
  PCR primer for ORF amplification
ggatccagctagcaaaatgactggcgacggtagtgcacat

SEQ ID NO: 8983 - DNA, 40 bp, Artificial Sequence
  PCR primer for ORF amplification
ggatccagctagcaaaatgggacagtcttcttcaatcagt

SEQ ID NO: 8984 - DNA, 40 bp, Artificial Sequence
  PCR primer for ORF amplification
ggatccagctagcaaaatgtcaggtgttaataatacatcc

SEQ ID NO: 8985 - DNA, 40 bp, Artificial Sequence
  PCR primer for ORF amplification
ggatccagctagcaaaatgtccggtgttaataatacatcc

SEQ ID NO: 8986 - DNA, 40 bp, Artificial Sequence
  PCR primer for ORF amplification
ggatccagctagcaaaatgagctctcaaaaggtttttggt

SEQ ID NO: 8987 - DNA, 40 bp, Artificial Sequence
  PCR primer for ORF amplification
ggatccagctagcaaaatgtcacttagattgccacaaaat

SEQ ID NO: 8988 - DNA, 40 bp, Artificial Sequence
  PCR primer for ORF amplification
ggatccagctagcaaaatgtctgatcaagaacgaggttca

SEQ ID NO: 8989 - DNA, 40 bp, Artificial Sequence
  PCR primer for ORF amplification
ggatccagctagcaaaatgtcttcattatatactaagttg

SEQ ID NO: 8990 - DNA, 40 bp, Artificial Sequence
  PCR primer for ORF amplification
ggatccagctagcaaaatgtttctggactattctggatat

SEQ ID NO: 8991 - DNA, 40 bp, Artificial Sequence
  PCR primer for ORF amplification
ggatccagctagcaaaatgaaactgaaaactgtaagatct

SEQ ID NO: 8992 - DNA, 40 bp, Artificial Sequence
  PCR primer for ORF amplification
ggatccagctagcaaaatgaaggatttaaaattatcgaat

SEQ ID NO: 8993 - DNA, 40 bp, Artificial Sequence
  PCR primer for ORF amplification
ggatccagctagcaaaatgactgatcgtaaaaccaacttg

SEQ ID NO: 8994 - DNA, 40 bp, Artificial Sequence
  PCR primer for ORF amplification
ggatccagctagcaaaatgatgaccaaagctttttttaac

SEQ ID NO: 8995 - DNA, 40 bp, Artificial Sequence
  PCR primer for ORF amplification
ggatccagctagcaaaatgtcatttcaaattgaaacggtt

SEQ ID NO: 8996 - DNA, 40 bp, Artificial Sequence
  PCR primer for ORF amplification
ggatccagctagcaaaatgtcacaagacgctgctattgca

SEQ ID NO: 8997 - DNA, 40 bp, Artificial Sequence; identical to SEQ ID NO: 8996
  PCR primer for ORF amplification

SEQ ID NO: 8998 - DNA, 40 bp, Artificial Sequence
  PCR primer for ORF amplification
ggatccagctagcaaaatgaaagaatcccctctcataacg

SEQ ID NO: 8999 - DNA, 40 bp, Artificial Sequence
  PCR primer for ORF amplification
ggatccagctagcaaaatgaattcaactcccgatctaata

SEQ ID NO: 9000 - DNA, 40 bp, Artificial Sequence
  PCR primer for ORF amplification
ggatccagctagcaaaatggaaggtttcttcaggataccc

SEQ ID NO: 9001 - DNA, 40 bp, Artificial Sequence
  PCR primer for ORF amplification
ggatccagctagcaaaatggacagcgtgtcaaaccttaag

SEQ ID NO: 9002 - DNA, 40 bp, Artificial Sequence
  PCR primer for ORF amplification
ggatccagctagcaaaatggttgccgctttaacgtatttg

SEQ ID NO: 9003 - DNA, 40 bp, Artificial Sequence
  PCR primer for ORF amplification
ggatccagctagcaaaatgtcacttctaatagattctgta

SEQ ID NO: 9004 - DNA, 40 bp, Artificial Sequence
  PCR primer for ORF amplification
ggatccagctagcaaaatgaatgatcctcgtgaaatttta

SEQ ID NO: 9005 - DNA, 40 bp, Artificial Sequence
  PCR primer for ORF amplification
ggatccagctagcaaaatgacggatgaaaaagtgaactca

SEQ ID NO: 9006 - DNA, 40 bp, Artificial Sequence
  PCR primer for ORF amplification
ggatccagctagcaaaatgagaagctctggcacatatgag

SEQ ID NO: 9007 - DNA, 40 bp, Artificial Sequence
  PCR primer for ORF amplification
ggatccagctagcaaaatgagtatgtcaagcaaaaacgag

SEQ ID NO: 9008 - DNA, 40 bp, Artificial Sequence
  PCR primer for ORF amplification
ggatccagctagcaaaatggattctagaacagttggtata

SEQ ID NO: 9009 - DNA, 40 bp, Artificial Sequence
  PCR primer for ORF amplification
ggatccagctagcaaaatgctatcaaaatcagaaaaaaat

SEQ ID NO: 9010 - DNA, 40 bp, Artificial Sequence
  PCR primer for ORF amplification
ggatccagctagcaaaatgctgaggaattgtttgaggaaa

SEQ ID NO: 9011 - DNA, 40 bp, Artificial Sequence
  PCR primer for ORF amplification
ggatccagctagcaaaatgggaagcgaaccgtttcagaaa

SEQ ID NO: 9012 - DNA, 40 bp, Artificial Sequence
  PCR primer for ORF amplification
ggatccagctagcaaaatggttatcatcctcctaggtctt

SEQ ID NO: 9013 - DNA, 40 bp, Artificial Sequence
  PCR primer for ORF amplification
ggatccagctagcaaaatgtctcccttaactagaaccgta

SEQ ID NO: 9014 - DNA, 40 bp, Artificial Sequence
  PCR primer for ORF amplification
ggatccagctagcaaaatgtgtggtatctttgcagccttc

SEQ ID NO: 9015 - DNA, 40 bp, Artificial Sequence
  PCR primer for ORF amplification
ggatccagctagcaaaatgtgtggtattttcgccgctttc

SEQ ID NO: 9016 - DNA, 40 bp, Artificial Sequence
  PCR primer for ORF amplification
ggatccagctagcaaaatgttgagatcatccgttgttcgt

SEQ ID NO: 9017 - DNA, 40 bp, Artificial Sequence
  PCR primer for ORF amplification
ggatccagctagcaaaatgcaagataccaaatactacgaa

SEQ ID NO: 9018 - DNA, 40 bp, Artificial Sequence
  PCR primer for ORF amplification
ggatccagctagcaaaatggatgaaactgtgaacatacaa

SEQ ID NO: 9019 - DNA, 40 bp, Artificial Sequence
  PCR primer for ORF amplification
ggatccagctagcaaaatgggtgtttctgcggtgttgaaa

SEQ ID NO: 9020 - DNA, 40 bp, Artificial Sequence
  PCR primer for ORF amplification
ggatccagctagcaaaatgtcagatgttacccaacagaaa

SEQ ID NO: 9021 - DNA, 40 bp, Artificial Sequence
  PCR primer for ORF amplification
ggatccagctagcaaaatgttacagcagggttcttcctcg

SEQ ID NO: 9022 - DNA, 40 bp, Artificial Sequence
  PCR primer for ORF amplification
ggatccagctagcaaaatgttgaatttcgcatcaagagcg

SEQ ID NO: 9023 - DNA, 40 bp, Artificial Sequence
  PCR primer for ORF amplification
ggatccagctagcaaaatggcagttgaggagaacaatatg

SEQ ID NO: 9024 - DNA, 40 bp, Artificial Sequence
  PCR primer for ORF amplification
ggatccagctagcaaaatggcgaaaaaaaactcacaattg

SEQ ID NO: 9025 - DNA, 40 bp, Artificial Sequence
  PCR primer for ORF amplification
ggatccagctagcaaaatggctttacatcaatttgactat

SEQ ID NO: 9026 - DNA, 40 bp, Artificial Sequence
  PCR primer for ORF amplification
ggatccagctagcaaaatgtcaattaggcctctcacgtta

SEQ ID NO: 9027 - DNA, 40 bp, Artificial Sequence
  PCR primer for ORF amplification
ggatccagctagcaaaatgtcggaaggaagaacgtttctg

SEQ ID NO: 9028 - DNA, 40 bp, Artificial Sequence
  PCR primer for ORF amplification
ggatccagctagcaaaatgtggaggagaatattcgcgcat

SEQ ID NO: 9029 - DNA, 40 bp, Artificial Sequence
  PCR primer for ORF amplification
ggatccagctagcaaaatgacggaaattgaatttgggcaa

SEQ ID NO: 9030 - DNA, 40 bp, Artificial Sequence
  PCR primer for ORF amplification
ggatccagctagcaaaatgattacaatgattaacaacaaa

SEQ ID NO: 9031 - DNA, 40 bp, Artificial Sequence
  PCR primer for ORF amplification
ggatccagctagcaaaatgcaatgtcgatcaattgtgcat

SEQ ID NO: 9032 - DNA, 40 bp, Artificial Sequence
  PCR primer for ORF amplification
ggatccagctagcaaaatgcagcaggacgacgattttcaa

SEQ ID NO: 9033 - DNA, 40 bp, Artificial Sequence
  PCR primer for ORF amplification
ggatccagctagcaaaatgctatcagcaaggtgcctcaaa

SEQ ID NO: 9034 - DNA, 40 bp, Artificial Sequence
  PCR primer for ORF amplification
ggatccagctagcaaaatgggctcctctttggatttggtg

SEQ ID NO: 9035 - DNA, 40 bp, Artificial Sequence
  PCR primer for ORF amplification
ggatccagctagcaaaatggtgaacgttggtccttctcat

SEQ ID NO: 9036 - DNA, 40 bp, Artificial Sequence
  PCR primer for ORF amplification
ggatccagctagcaaaatgaatgtgctgttaaaaagacgc

SEQ ID NO: 9037 - DNA, 40 bp, Artificial Sequence
  PCR primer for ORF amplification
ggatccagctagcaaaatgacaaaatatgagcgtgaccct

SEQ ID NO: 9038 - DNA, 40 bp, Artificial Sequence
  PCR primer for ORF amplification
ggatccagctagcaaaatgagtctggaacccacacaaacg

SEQ ID NO: 9039 - DNA, 40 bp, Artificial Sequence
  PCR primer for ORF amplification
ggatccagctagcaaaatgatcgccttaccagtagagaag

SEQ ID NO: 9040 - DNA, 40 bp, Artificial Sequence
  PCR primer for ORF amplification
ggatccagctagcaaaatgatttctgctactaattgggtt

SEQ ID NO: 9041 - DNA, 40 bp, Artificial Sequence
  PCR primer for ORF amplification
ggatccagctagcaaaatgtcagctactctactaaagcaa

SEQ ID NO: 9042 - DNA, 40 bp, Artificial Sequence
  PCR primer for ORF amplification
ggatccagctagcaaaatgtccctttctctgggtgccgct

SEQ ID NO: 9043 - DNA, 40 bp, Artificial Sequence
  PCR primer for ORF amplification
ggatccagctagcaaaatgtcgaatgagagcacacgagtt

SEQ ID NO: 9044 - DNA, 40 bp, Artificial Sequence
  PCR primer for ORF amplification
ggatccagctagcaaaatgtctgaagaagctgcctatcaa

SEQ ID NO: 9045 - DNA, 40 bp, Artificial Sequence
  PCR primer for ORF amplification
ggatccagctagcaaaatgttgaaatatcgtacattgtct

SEQ ID NO: 9046 - DNA, 40 bp, Artificial Sequence
  PCR primer for ORF amplification
ggatccagctagcaaaatgaaaggtgatcgttcgaggcaa

SEQ ID NO: 9047 - DNA, 40 bp, Artificial Sequence
  PCR primer for ORF amplification
ggatccagctagcaaaatgaacctttttgatgtggctgac

SEQ ID NO: 9048 - DNA, 40 bp, Artificial Sequence
  PCR primer for ORF amplification
ggatccagctagcaaaatggctgatattactgataagaca

SEQ ID NO: 9049 - DNA, 40 bp, Artificial Sequence
  PCR primer for ORF amplification
ggatccagctagcaaaatgggaaagctgataaagttaatc

SEQ ID NO: 9050 - DNA, 40 bp, Artificial Sequence
  PCR primer for ORF amplification
ggatccagctagcaaaatgtctaccgctaccatacaggat

SEQ ID NO: 9051 - DNA, 40 bp, Artificial Sequence
  PCR primer for ORF amplification
ggatccagctagcaaaatgaaatacgttgttgtttctggt

SEQ ID NO: 9052 - DNA, 40 bp, Artificial Sequence
  PCR primer for ORF amplification
ggatccagctagcaaaatgatccggttaccgaggctgtat

SEQ ID NO: 9053 - DNA, 40 bp, Artificial Sequence
  PCR primer for ORF amplification
ggatccagctagcaaaatgggttcatgttgtagttgcttg

SEQ ID NO: 9054 - DNA, 40 bp, Artificial Sequence
  PCR primer for ORF amplification
ggatccagctagcaaaatgtcaattcaggcttttgtcttt

SEQ ID NO: 9055 - DNA, 40 bp, Artificial Sequence
  PCR primer for ORF amplification
ggatccagctagcaaaatgaagtacgttgttgtttcaggt

SEQ ID NO: 9056 - DNA, 40 bp, Artificial Sequence
  PCR primer for ORF amplification
ggatccagctagcaaaatgaatagggacaacatggacaca

SEQ ID NO: 9057 - DNA, 40 bp, Artificial Sequence
  PCR primer for ORF amplification
ggatccagctagcaaaatgagtgagaccagctcaagtcgc

SEQ ID NO: 9058 - DNA, 40 bp, Artificial Sequence
  PCR primer for ORF amplification
ggatccagctagcaaaatggatgaaaacggtacagtaaag

SEQ ID NO: 9059 - DNA, 40 bp, Artificial Sequence
  PCR primer for ORF amplification
ggatccagctagcaaaatgtatgtcacttttaatgaggct

SEQ ID NO: 9060 - DNA, 40 bp, Artificial Sequence
  PCR primer for ORF amplification
ggatccagctagcaaaatgtccctttttaccaggcctttt

SEQ ID NO: 9061 - DNA, 40 bp, Artificial Sequence
  PCR primer for ORF amplification
ggatccagctagcaaaatgcttatcagatttagatcaaaa

SEQ ID NO: 9062 - DNA, 40 bp, Artificial Sequence
  PCR primer for ORF amplification
ggatccagctagcaaaatggccatattgaaggataccata

SEQ ID NO: 9063 - DNA, 40 bp, Artificial Sequence
  PCR primer for ORF amplification
ggatccagctagcaaaatggtattgcgcatacgaagaatt

SEQ ID NO: 9064 - DNA, 40 bp, Artificial Sequence
  PCR primer for ORF amplification
ggatccagctagcaaaatgtggataaatagactggttaaa

SEQ ID NO: 9065 - DNA, 40 bp, Artificial Sequence
  PCR primer for ORF amplification
ggatccagctagcaaaatgaactcgttagcttcaaacaca

SEQ ID NO: 9066 - DNA, 40 bp, Artificial Sequence
  PCR primer for ORF amplification
ggatccagctagcaaaatgacgatcatccataatcctaaa

SEQ ID NO: 9067 - DNA, 40 bp, Artificial Sequence
  PCR primer for ORF amplification
ggatccagctagcaaaatgactgatttcgatttaatgaat

SEQ ID NO: 9068 - DNA, 40 bp, Artificial Sequence
  PCR primer for ORF amplification
ggatccagctagcaaaatgtctaaacaatttagtcatacc

SEQ ID NO: 9069 - DNA, 40 bp, Artificial Sequence
  PCR primer for ORF amplification
ggatccagctagcaaaatggaggaaactaagtactcttcg

SEQ ID NO: 9070 - DNA, 40 bp, Artificial Sequence
  PCR primer for ORF amplification
ggatccagctagcaaaatgggcggtcaagaaagtatatca

SEQ ID NO: 9071 - DNA, 40 bp, Artificial Sequence
  PCR primer for ORF amplification
ggatccagctagcaaaatggtacaagaatcacgtccaggg

SEQ ID NO: 9072 - DNA, 40 bp, Artificial Sequence
  PCR primer for ORF amplification
ggatccagctagcaaaatgtctctaaagggtaaatttttc

SEQ ID NO: 9073 - DNA, 40 bp, Artificial Sequence
  PCR primer for ORF amplification
ggatccagctagcaaaatgcccaatacgcatactcaacat

SEQ ID NO: 9074 - DNA, 40 bp, Artificial Sequence
  PCR primer for ORF amplification
ggatccagctagcaaaatggatgaatttgaatctaccaaa

SEQ ID NO: 9075 - DNA, 40 bp, Artificial Sequence
  PCR primer for ORF amplification
ggatccagctagcaaaatgtcacaggtaatagaaccacaa

SEQ ID NO: 9076 - DNA, 40 bp, Artificial Sequence
  PCR primer for ORF amplification
ggatccagctagcaaaatgtcatcagatgcgttaaaagca

SEQ ID NO: 9077 - DNA, 40 bp, Artificial Sequence
  PCR primer for ORF amplification
ggatccagctagcaaaatgtcattcagattattcacgagg

SEQ ID NO: 9078 - DNA, 40 bp, Artificial Sequence
  PCR primer for ORF amplification
ggatccagctagcaaaatgtctatttggaaggaagctaaa

SEQ ID NO: 9079 - DNA, 40 bp, Artificial Sequence
  PCR primer for ORF amplification
ggatccagctagcaaaatgactatttctgatcatccagaa

SEQ ID NO: 9080 - DNA, 40 bp, Artificial Sequence
  PCR primer for ORF amplification
ggatccagctagcaaaatgccagtagtcaatcatgaggat

SEQ ID NO: 9081 - DNA, 40 bp, Artificial Sequence
  PCR primer for ORF amplification
ggatccagctagcaaaatgggaatacacataccatatctc

SEQ ID NO: 9082 - DNA, 40 bp, Artificial Sequence
  PCR primer for ORF amplification
ggatccagctagcaaaatgggggcaaagagtgtaacagcc

SEQ ID NO: 9083 - DNA, 40 bp, Artificial Sequence
  PCR primer for ORF amplification
ggatccagctagcaaaatgtccgctaaatcgtttgaagtc

SEQ ID NO: 9084 - DNA, 40 bp, Artificial Sequence
  PCR primer for ORF amplification
ggatccagctagcaaaatgtcgcgggaggcatttgatgta

SEQ ID NO: 9085 - DNA, 40 bp, Artificial Sequence
  PCR primer for ORF amplification
ggatccagctagcaaaatgatcacccaaactgagctagat

SEQ ID NO: 9086 - DNA, 40 bp, Artificial Sequence
  PCR primer for ORF amplification
ggatccagctagcaaaatgctgggccgggcactaatcaac

SEQ ID NO: 9087 - DNA, 40 bp, Artificial Sequence
  PCR primer for ORF amplification
ggatccagctagcaaaatggagaacgacaaggcgtcacat

SEQ ID NO: 9088 - DNA, 40 bp, Artificial Sequence
  PCR primer for ORF amplification
ggatccagctagcaaaatggaggaagtgttccgtttttac

SEQ ID NO: 9089 - DNA, 40 bp, Artificial Sequence
  PCR primer for ORF amplification
ggatccagctagcaaaatggatcaatttgagtatatcatt

SEQ ID NO: 9090 - DNA, 40 bp, Artificial Sequence
  PCR primer for ORF amplification
ggatccagctagcaaaatgggcttgttaacgaaagttgct

SEQ ID NO: 9091 - DNA, 40 bp, Artificial Sequence
  PCR primer for ORF amplification
ggatccagctagcaaaatgtcccatccgcactcacatagc

SEQ ID NO: 9092 - DNA, 40 bp, Artificial Sequence
  PCR primer for ORF amplification
ggatccagctagcaaaatgttacacaggcacggttctaag

SEQ ID NO: 9093 - DNA, 40 bp, Artificial Sequence
  PCR primer for ORF amplification
ggatccagctagcaaaatgactacagctagttcttctgct

SEQ ID NO: 9094 - DNA, 40 bp, Artificial Sequence
  PCR primer for ORF amplification
ggatccagctagcaaaatgctgattaggttaaagaagaga

SEQ ID NO: 9095 - DNA, 40 bp, Artificial Sequence
  PCR primer for ORF amplification
ggatccagctagcaaaatgctttctgaaaacacgactatt

SEQ ID NO: 9096 - DNA, 40 bp, Artificial Sequence
  PCR primer for ORF amplification
ggatccagctagcaaaatggacaaatataccaacagggat

SEQ ID NO: 9097 - DNA, 40 bp, Artificial Sequence
  PCR primer for ORF amplification
ggatccagctagcaaaatgtcacgaagtaacagtatatac

SEQ ID NO: 9098 - DNA, 40 bp, Artificial Sequence
  PCR primer for ORF amplification
ggatccagctagcaaaatgtcggatcattctcccatttct

SEQ ID NO: 9099 - DNA, 40 bp, Artificial Sequence
  PCR primer for ORF amplification
ggatccagctagcaaaatgttcattgaatactctagatta

SEQ ID NO: 9100 - DNA, 40 bp, Artificial Sequence
  PCR primer for ORF amplification
ggatccagctagcaaaatgttttcacttagttcgctatct

SEQ ID NO: 9101 - DNA, 40 bp, Artificial Sequence
  PCR primer for ORF amplification
ggatccagctagcaaaatgaacaaaacggaaaacctttct

SEQ ID NO: 9102 - DNA, 40 bp, Artificial Sequence
  PCR primer for ORF amplification
ggatccagctagcaaaatgaatagtcaaggttacgatgaa

SEQ ID NO: 9103 - DNA, 40 bp, Artificial Sequence
  PCR primer for ORF amplification
ggatccagctagcaaaatgagtaacaagaggacatctgta

SEQ ID NO: 9104 - DNA, 40 bp, Artificial Sequence
  PCR primer for ORF amplification
ggatccagctagcaaaatgagttccgtcaataaagatact

SEQ ID NO: 9105 - DNA, 40 bp, Artificial Sequence
  PCR primer for ORF amplification
ggatccagctagcaaaatgatgaatccacacgttcaagaa

SEQ ID NO: 9106 - DNA, 40 bp, Artificial Sequence
  PCR primer for ORF amplification
ggatccagctagcaaaatggacaagtatttgaattcattt

SEQ ID NO: 9107 - DNA, 40 bp, Artificial Sequence
  PCR primer for ORF amplification
ggatccagctagcaaaatggatatactcaagaggggaaat

SEQ ID NO: 9108 - DNA, 40 bp, Artificial Sequence
  PCR primer for ORF amplification
ggatccagctagcaaaatggcgaaccgtcttctcatatac

SEQ ID NO: 9109 - DNA, 40 bp, Artificial Sequence
  PCR primer for ORF amplification
ggatccagctagcaaaatgtctgcaattaatcatctttgt

SEQ ID NO: 9110 - DNA, 40 bp, Artificial Sequence
  PCR primer for ORF amplification
ggatccagctagcaaaatgttgtggaagcgtacttgcaca

SEQ ID NO: 9111 - DNA, 40 bp, Artificial Sequence
  PCR primer for ORF amplification
ggatccagctagcaaaatgtttactggtcaggagtatcat

SEQ ID NO: 9112 - DNA, 40 bp, Artificial Sequence
  PCR primer for ORF amplification
ggatccagctagcaaaatgaagcttctaaaggacttattg

SEQ ID NO: 9113 - DNA, 40 bp, Artificial Sequence
  PCR primer for ORF amplification
ggatccagctagcaaaatggcaagaccaatcgatgttagt

SEQ ID NO: 9114 - DNA, 40 bp, Artificial Sequence
  PCR primer for ORF amplification
ggatccagctagcaaaatgtcaacacttagcgatagtgat

SEQ ID NO: 9115 - DNA, 40 bp, Artificial Sequence
  PCR primer for ORF amplification
ggatccagctagcaaaatgtcaagcttatacatcaaaaca

SEQ ID NO: 9116 - DNA, 40 bp, Artificial Sequence
  PCR primer for ORF amplification
ggatccagctagcaaaatgactatttcttctgcacatcca

SEQ ID NO: 9117 - DNA, 40 bp, Artificial Sequence; identical to SEQ ID NO: 9116
  PCR primer for ORF amplification

SEQ ID NO: 9118 - DNA, 40 bp, Artificial Sequence
  PCR primer for ORF amplification
ggatccagctagcaaaatgagtggagtatcaaataaaaca

SEQ ID NO: 9119 - DNA, 40 bp, Artificial Sequence
  PCR primer for ORF amplification
ggatccagctagcaaaatgtcattgacagccgatgaatac

SEQ ID NO: 9120 - DNA, 40 bp, Artificial Sequence
  PCR primer for ORF amplification
ggatccagctagcaaaatgtttgatcatgacgtcgaatat

SEQ ID NO: 9121 - DNA, 40 bp, Artificial Sequence
  PCR primer for ORF amplification
ggatccagctagcaaaatgaagacctgctactatgagctt

SEQ ID NO: 9122 - DNA, 40 bp, Artificial Sequence
  PCR primer for ORF amplification
ggatccagctagcaaaatgacaaattcaaaagaagacgcc

SEQ ID NO: 9123 - DNA, 40 bp, Artificial Sequence
  PCR primer for ORF amplification
ggatccagctagcaaaatgccccccgtaccaatatacgtg

SEQ ID NO: 9124 - DNA, 40 bp, Artificial Sequence
  PCR primer for ORF amplification
ggatccagctagcaaaatgccgaagagaaaaattgctcct

SEQ ID NO: 9125 - DNA, 40 bp, Artificial Sequence
  PCR primer for ORF amplification
ggatccagctagcaaaatggctgttataagaattaaaaaa

SEQ ID NO: 9126 - DNA, 40 bp, Artificial Sequence
  PCR primer for ORF amplification
ggatccagctagcaaaatgccaagaaaaaagtctgccgct

SEQ ID NO: 9127 - DNA, 40 bp, Artificial Sequence
  PCR primer for ORF amplification
ggatccagctagcaaaatgctaaaatacaaacctttacta

SEQ ID NO: 9128 - DNA, 40 bp, Artificial Sequence
  PCR primer for ORF amplification
ggatccagctagcaaaatggaggactctaataatgaagcc

SEQ ID NO: 9129 - DNA, 40 bp, Artificial Sequence
  PCR primer for ORF amplification
ggatccagctagcaaaatgggcaaatataccaagactgcg

SEQ ID NO: 9130 - DNA, 40 bp, Artificial Sequence
  PCR primer for ORF amplification
ggatccagctagcaaaatgtctcaacaagataatgtcaaa

SEQ ID NO: 9131 - DNA, 40 bp, Artificial Sequence
  PCR primer for ORF amplification
ggatccagctagcaaaatgtctcacaaacaattcaaatca

SEQ ID NO: 9132 - DNA, 40 bp, Artificial Sequence
  PCR primer for ORF amplification
ggatccagctagcaaaatgaccgaagactttatttcttct

SEQ ID NO: 9133 - DNA, 40 bp, Artificial Sequence
  PCR primer for ORF amplification
ggatccagctagcaaaatggccaattacacaaaaaccgca

SEQ ID NO: 9134 - DNA, 40 bp, Artificial Sequence
  PCR primer for ORF amplification
ggatccagctagcaaaatggctttggaacctattgattat

SEQ ID NO: 9135 - DNA, 40 bp, Artificial Sequence
  PCR primer for ORF amplification
ggatccagctagcaaaatgtcggaacttgaaaacgctcat

SEQ ID NO: 9136 - DNA, 40 bp, Artificial Sequence
  PCR primer for ORF amplification
ggatccagctagcaaaatgttatcactgtctgccaaaaat

SEQ ID NO: 9137 - DNA, 40 bp, Artificial Sequence
  PCR primer for ORF amplification
ggatccagctagcaaaatgacaatttcgaataaatcgtgg

SEQ ID NO: 9138 - DNA, 40 bp, Artificial Sequence
  PCR primer for ORF amplification
ggatccagctagcaaaatggctctagctatctcccacgag

SEQ ID NO: 9139 - DNA, 40 bp, Artificial Sequence
  PCR primer for ORF amplification
ggatccagctagcaaaatggtacgagacttagtgacattg

SEQ ID NO: 9140 - DNA, 40 bp, Artificial Sequence
  PCR primer for ORF amplification
ggatccagctagcaaaatgtattcaattgttaaagagatt

SEQ ID NO: 9141 - DNA, 40 bp, Artificial Sequence
  PCR primer for ORF amplification
ggatccagctagcaaaatgtcagaactctttggagtattg

SEQ ID NO: 9142 - DNA, 40 bp, Artificial Sequence
  PCR primer for ORF amplification
ggatccagctagcaaaatgaataactccaaaattcctaaa

SEQ ID NO: 9143 - DNA, 40 bp, Artificial Sequence
  PCR primer for ORF amplification
ggatccagctagcaaaatgacaatggcaacaaccgcaatg

SEQ ID NO: 9144 - DNA, 40 bp, Artificial Sequence
  PCR primer for ORF amplification
ggatccagctagcaaaatgagctatgagaaaaagtctgtg

SEQ ID NO: 9145 - DNA, 40 bp, Artificial Sequence
  PCR primer for ORF amplification
ggatccagctagcaaaatgagtagtattgttaataaaagt

SEQ ID NO: 9146 - DNA, 40 bp, Artificial Sequence
  PCR primer for ORF amplification
ggatccagctagcaaaatgtctgtccgtacttcttcaaga

SEQ ID NO: 9147 - DNA, 40 bp, Artificial Sequence
  PCR primer for ORF amplification
ggatccagctagcaaaatgcctaccgtctccgtgaacaag

SEQ ID NO: 9148 - DNA, 40 bp, Artificial Sequence
  PCR primer for ORF amplification
ggatccagctagcaaaatgaaattatctgtcctcacattt

SEQ ID NO: 9149 - DNA, 40 bp, Artificial Sequence
  PCR primer for ORF amplification
ggatccagctagcaaaatgacaaaggaacgtatgaccatc

SEQ ID NO: 9150 - DNA, 40 bp, Artificial Sequence
  PCR primer for ORF amplification
ggatccagctagcaaaatgacatgcctaattttatggtat

SEQ ID NO: 9151 - DNA, 40 bp, Artificial Sequence
  PCR primer for ORF amplification
ggatccagctagcaaaatgccagtgtgtaagaactgtcac

SEQ ID NO: 9152 - DNA, 40 bp, Artificial Sequence
  PCR primer for ORF amplification
ggatccagctagcaaaatgaacaccggtatctcgcccaaa

SEQ ID NO: 9153 - DNA, 40 bp, Artificial Sequence
  PCR primer for ORF amplification
ggatccagctagcaaaatgctgcttaccaaaaggttttca

SEQ ID NO: 9154 - DNA, 40 bp, Artificial Sequence
  PCR primer for ORF amplification
ggatccagctagcaaaatgacaaagaggagaaacctcttt

SEQ ID NO: 9155 - DNA, 40 bp, Artificial Sequence
  PCR primer for ORF amplification
ggatccagctagcaaaatgagcttcagtagtatagtctct

SEQ ID NO: 9156 - DNA, 40 bp, Artificial Sequence
  PCR primer for ORF amplification
ggatccagctagcaaaatgagtttcggtagtaaagtctcc

SEQ ID NO: 9157 - DNA, 40 bp, Artificial Sequence
  PCR primer for ORF amplification
ggatccagctagcaaaatgaccgatgtgttgagaagccta

SEQ ID NO: 9158 - DNA, 40 bp, Artificial Sequence
  PCR primer for ORF amplification
ggatccagctagcaaaatgagcggatttcacaatgttgga

SEQ ID NO: 9159 - DNA, 40 bp, Artificial Sequence
  PCR primer for ORF amplification
ggatccagctagcaaaatgagtttcggtacgagaatctcc

SEQ ID NO: 9160 - DNA, 40 bp, Artificial Sequence
  PCR primer for ORF amplification
ggatccagctagcaaaatgatagatatcaacgttaataac

SEQ ID NO: 9161 - DNA, 40 bp, Artificial Sequence
  PCR primer for ORF amplification
ggatccagctagcaaaatggttgcctattctccaatcatt

SEQ ID NO: 9162 - DNA, 40 bp, Artificial Sequence
  PCR primer for ORF amplification
ggatccagctagcaaaatgaagatcacagaaaaattagag

SEQ ID NO: 9163 - DNA, 40 bp, Artificial Sequence
  PCR primer for ORF amplification
ggatccagctagcaaaatgattaacgataaactagtacat

SEQ ID NO: 9164 - DNA, 40 bp, Artificial Sequence
  PCR primer for ORF amplification
ggatccagctagcaaaatgttgtgttcagtaattcagaga

SEQ ID NO: 9165 - DNA, 40 bp, Artificial Sequence
  PCR primer for ORF amplification
ggatccagctagcaaaatgctcaaccatcccagccaaggc

SEQ ID NO: 9166 - DNA, 40 bp, Artificial Sequence
  PCR primer for ORF amplification
ggatccagctagcaaaatgagctacatagttgacctacaa

SEQ ID NO: 9167 - DNA, 40 bp, Artificial Sequence
  PCR primer for ORF amplification
ggatccagctagcaaaatgaaaaacttatcttttctcata

SEQ ID NO: 9168 - DNA, 40 bp, Artificial Sequence
  PCR primer for ORF amplification
ggatccagctagcaaaatgaacttgctaattgaccggatg

SEQ ID NO: 9169 - DNA, 40 bp, Artificial Sequence
  PCR primer for ORF amplification
ggatccagctagcaaaatgagtaatacttcttcgtacgag

SEQ ID NO: 9170 - DNA, 40 bp, Artificial Sequence
  PCR primer for ORF amplification
ggatccagctagcaaaatgatactaaagcttgtacactgt

SEQ ID NO: 9171 - DNA, 40 bp, Artificial Sequence
  PCR primer for ORF amplification
ggatccagctagcaaaatgcctgagcaagaaccattgagt

SEQ ID NO: 9172 - DNA, 40 bp, Artificial Sequence
  PCR primer for ORF amplification
ggatccagctagcaaaatgcgctcagtcactaatgcattt

SEQ ID NO: 9173 - DNA, 40 bp, Artificial Sequence
  PCR primer for ORF amplification
ggatccagctagcaaaatggacgaggttgacgatattcta

SEQ ID NO: 9174 - DNA, 40 bp, Artificial Sequence
  PCR primer for ORF amplification
ggatccagctagcaaaatgactggtatgaatgataataat

SEQ ID NO: 9175 - DNA, 40 bp, Artificial Sequence
  PCR primer for ORF amplification
ggatccagctagcaaaatgatacaatcagacgaagataat

SEQ ID NO: 9176 - DNA, 40 bp, Artificial Sequence
  PCR primer for ORF amplification
ggatccagctagcaaaatgcctagaaacccattgaaaaag

SEQ ID NO: 9177 - DNA, 40 bp, Artificial Sequence
  PCR primer for ORF amplification
ggatccagctagcaaaatgttaagtcctgaacgtagacca

SEQ ID NO: 9178 - DNA, 40 bp, Artificial Sequence
  PCR primer for ORF amplification
ggatccagctagcaaaatgagtgccaatagcccgacagga

SEQ ID NO: 9179 - DNA, 40 bp, Artificial Sequence
  PCR primer for ORF amplification
ggatccagctagcaaaatgagtggcacagctaatagtagg

SEQ ID NO: 9180 - DNA, 40 bp, Artificial Sequence
  PCR primer for ORF amplification
ggatccagctagcaaaatgcatttccccaaaaaaaagcat

SEQ ID NO: 9181 - DNA, 40 bp, Artificial Sequence
  PCR primer for ORF amplification
ggatccagctagcaaaatggctgaactgagcgaacaagtg

SEQ ID NO: 9182 - DNA, 40 bp, Artificial Sequence
  PCR primer for ORF amplification
ggatccagctagcaaaatggtaaaacattcgttcatagcg

SEQ ID NO: 9183 - DNA, 40 bp, Artificial Sequence
  PCR primer for ORF amplification
ggatccagctagcaaaatggtagaactggaaaaaagaaga

SEQ ID NO: 9184 - DNA, 40 bp, Artificial Sequence
  PCR primer for ORF amplification
ggatccagctagcaaaatgtcagatcctatagtaacgtct

SEQ ID NO: 9185 - DNA, 40 bp, Artificial Sequence
  PCR primer for ORF amplification
ggatccagctagcaaaatgtcttcagacgctataagaaat

SEQ ID NO: 9186 - DNA, 40 bp, Artificial Sequence
  PCR primer for ORF amplification
ggatccagctagcaaaatgagaatcaagaagaaaaacacc

SEQ ID NO: 9187 - DNA, 40 bp, Artificial Sequence
  PCR primer for ORF amplification
ggatccagctagcaaaatgcagacgtcaatggtgagcgca

SEQ ID NO: 9188 - DNA, 40 bp, Artificial Sequence
  PCR primer for ORF amplification
ggatccagctagcaaaatggagacgccgcaaatgaacgct

SEQ ID NO: 9189 - DNA, 40 bp, Artificial Sequence
  PCR primer for ORF amplification
ggatccagctagcaaaatgtcgtcaagcctttttatcctg

SEQ ID NO: 9190 - DNA, 40 bp, Artificial Sequence
  PCR primer for ORF amplification
ggatccagctagcaaaatgtctaataaacaactagtaaag

SEQ ID NO: 9191 - DNA, 40 bp, Artificial Sequence
  PCR primer for ORF amplification
ggatccagctagcaaaatgaatacattaaggtgtttgaca

SEQ ID NO: 9192 - DNA, 40 bp, Artificial Sequence
  PCR primer for ORF amplification
ggatccagctagcaaaatgctggaaactgatcactctagg

SEQ ID NO: 9193 - DNA, 40 bp, Artificial Sequence
  PCR primer for ORF amplification
ggatccagctagcaaaatggagcaacatctcaaatcaatt

SEQ ID NO: 9194 - DNA, 40 bp, Artificial Sequence
  PCR primer for ORF amplification
ggatccagctagcaaaatgtcaaagtcattggaatgggat

SEQ ID NO: 9195 - DNA, 40 bp, Artificial Sequence
  PCR primer for ORF amplification
ggatccagctagcaaaatgagtaacgaagcttaccagcat

SEQ ID NO: 9196 - DNA, 40 bp, Artificial Sequence
  PCR primer for ORF amplification
ggatccagctagcaaaatggacagatctaaggacgctaga

SEQ ID NO: 9197 - DNA, 40 bp, Artificial Sequence
  PCR primer for ORF amplification
ggatccagctagcaaaatggagctgatactaaacagcctc

SEQ ID NO: 9198 - DNA, 40 bp, Artificial Sequence
  PCR primer for ORF amplification
ggatccagctagcaaaatggctagcacagcaaatatgatt

SEQ ID NO: 9199 - DNA, 40 bp, Artificial Sequence
  PCR primer for ORF amplification
ggatccagctagcaaaatgaagatgcctctaaagaagatg

SEQ ID NO: 9200 - DNA, 40 bp, Artificial Sequence
  PCR primer for ORF amplification
ggatccagctagcaaaatgaaggtcattctccttaagccg

SEQ ID NO: 9201 - DNA, 40 bp, Artificial Sequence
  PCR primer for ORF amplification
ggatccagctagcaaaatgagtgataaaaacagtcgtatc

SEQ ID NO: 9202 - DNA, 40 bp, Artificial Sequence
  PCR primer for ORF amplification
ggatccagctagcaaaatgcacactaactcacccttacga

SEQ ID NO: 9203 - DNA, 40 bp, Artificial Sequence
  PCR primer for ORF amplification
ggatccagctagcaaaatgtttaaccgtaccactcaactg

SEQ ID NO: 9204 - DNA, 40 bp, Artificial Sequence; identical to SEQ ID NO: 9167
  PCR primer for ORF amplification

SEQ ID NO: 9205 - DNA, 40 bp, Artificial Sequence
  PCR primer for ORF amplification
ggatccagctagcaaaatgaagaattcgacagctgctagt

SEQ ID NO: 9206 - DNA, 40 bp, Artificial Sequence
  PCR primer for ORF amplification
ggatccagctagcaaaatgaattctagctatacacagaga

SEQ ID NO: 9207 - DNA, 40 bp, Artificial Sequence
  PCR primer for ORF amplification
ggatccagctagcaaaatgccaaattacattttctggcca

SEQ ID NO: 9208 - DNA, 40 bp, Artificial Sequence
  PCR primer for ORF amplification
ggatccagctagcaaaatgctatcttcagaagattttgga

SEQ ID NO: 9209 - DNA, 40 bp, Artificial Sequence
  PCR primer for ORF amplification
ggatccagctagcaaaatggataatattttaaaggcatca

SEQ ID NO: 9210 - DNA, 40 bp, Artificial Sequence
  PCR primer for ORF amplification
ggatccagctagcaaaatgtccagcttagccgatacagta

SEQ ID NO: 9211 - DNA, 40 bp, Artificial Sequence
  PCR primer for ORF amplification
ggatccagctagcaaaatgtcgatgttaagaatctggagt

SEQ ID NO: 9212 - DNA, 40 bp, Artificial Sequence
  PCR primer for ORF amplification
ggatccagctagcaaaatgacggagactaaggatttgttg

SEQ ID NO: 9213 - DNA, 40 bp, Artificial Sequence
  PCR primer for ORF amplification
ggatccagctagcaaaatgagtgaaagtggtcaagaacaa

SEQ ID NO: 9214 - DNA, 40 bp, Artificial Sequence
  PCR primer for ORF amplification
ggatccagctagcaaaatgatcctcacactggcctatttc

SEQ ID NO: 9215 - DNA, 40 bp, Artificial Sequence
  PCR primer for ORF amplification
ggatccagctagcaaaatgccaccagtatctgcgtcaaag

SEQ ID NO: 9216 - DNA, 40 bp, Artificial Sequence
  PCR primer for ORF amplification
ggatccagctagcaaaatgccagaaagctctagagataag

SEQ ID NO: 9217 - DNA, 40 bp, Artificial Sequence
  PCR primer for ORF amplification
ggatccagctagcaaaatgcttaaaataaaggcccttttc

SEQ ID NO: 9218 - DNA, 40 bp, Artificial Sequence
  PCR primer for ORF amplification
ggatccagctagcaaaatggtacgcaaaggctcaaacaga

SEQ ID NO: 9219 - DNA, 40 bp, Artificial Sequence
  PCR primer for ORF amplification
ggatccagctagcaaaatggagatattcaaggaagaagaa

SEQ ID NO: 9220 - DNA, 40 bp, Artificial Sequence
  PCR primer for ORF amplification
ggatccagctagcaaaatggcgcgtcaaaagcttactttc

SEQ ID NO: 9221 - DNA, 40 bp, Artificial Sequence
  PCR primer for ORF amplification
ggatccagctagcaaaatggcttacagtgactacagcgat

SEQ ID NO: 9222 - DNA, 40 bp, Artificial Sequence
  PCR primer for ORF amplification
ggatccagctagcaaaatgggcaggtttagtaacataata

SEQ ID NO: 9223 - DNA, 40 bp, Artificial Sequence
  PCR primer for ORF amplification
ggatccagctagcaaaatgtattctatttcaaacaaaaaa

SEQ ID NO: 9224 - DNA, 40 bp, Artificial Sequence
  PCR primer for ORF amplification
ggatccagctagcaaaatgtctacatctttccaggagttc

SEQ ID NO: 9225 - DNA, 40 bp, Artificial Sequence
  PCR primer for ORF amplification
ggatccagctagcaaaatgaataaattctgtctactacct

SEQ ID NO: 9226 - DNA, 40 bp, Artificial Sequence
  PCR primer for ORF amplification
ggatccagctagcaaaatggacgtaggaagttgctcagtg

SEQ ID NO: 9227 - DNA, 40 bp, Artificial Sequence
  PCR primer for ORF amplification
ggatccagctagcaaaatggctagacaattattcactcct

SEQ ID NO: 9228 - DNA, 40 bp, Artificial Sequence
  PCR primer for ORF amplification
ggatccagctagcaaaatggtggtttcttataacaataat

SEQ ID NO: 9229 - DNA, 40 bp, Artificial Sequence
  PCR primer for ORF amplification
ggatccagctagcaaaatgtcatttaaggcaactatcacc

SEQ ID NO: 9230 - DNA, 40 bp, Artificial Sequence
  PCR primer for ORF amplification
ggatccagctagcaaaatggctgaaggtgttttccaaggt

SEQ ID NO: 9231 - DNA, 40 bp, Artificial Sequence; identical to SEQ ID NO: 9230
  PCR primer for ORF amplification

SEQ ID NO: 9232 - DNA, 40 bp, Artificial Sequence
  PCR primer for ORF amplification
ggatccagctagcaaaatgaaaggcgaacctaagacttac

SEQ ID NO: 9233 - DNA, 40 bp, Artificial Sequence
  PCR primer for ORF amplification
ggatccagctagcaaaatgacacacatcacactgggacaa

SEQ ID NO: 9234 - DNA, 40 bp, Artificial Sequence
  PCR primer for ORF amplification
ggatccagctagcaaaatgtctaagcagtttgttcgttct

SEQ ID NO: 9235 - DNA, 40 bp, Artificial Sequence
  PCR primer for ORF amplification
ggatccagctagcaaaatgaagggattatcctcattaata

SEQ ID NO: 9236 - DNA, 40 bp, Artificial Sequence
  PCR primer for ORF amplification
ggatccagctagcaaaatgagtgatcaagaatctgttgtt

SEQ ID NO: 9237 - DNA, 40 bp, Artificial Sequence
  PCR primer for ORF amplification
ggatccagctagcaaaatggccttattggagaagttgcat

SEQ ID NO: 9238 - DNA, 40 bp, Artificial Sequence
  PCR primer for ORF amplification
ggatccagctagcaaaatgagttctagtgttgttggtgcc

SEQ ID NO: 9239 - DNA, 40 bp, Artificial Sequence; identical to SEQ ID NO: 9238
  PCR primer for ORF amplification

SEQ ID NO: 9240 - DNA, 40 bp, Artificial Sequence
  PCR primer for ORF amplification
ggatccagctagcaaaatgagactttcgtttggtaaacag

SEQ ID NO: 9241 - DNA, 40 bp, Artificial Sequence
  PCR primer for ORF amplification
ggatccagctagcaaaatgctaagctatttccaagggttt

SEQ ID NO: 9242 - DNA, 40 bp, Artificial Sequence
  PCR primer for ORF amplification
ggatccagctagcaaaatgtcatctatctctttgaaggaa

SEQ ID NO: 9243 - DNA, 40 bp, Artificial Sequence
  PCR primer for ORF amplification
ggatccagctagcaaaatgaaaaatatcatttcattggta

SEQ ID NO: 9244 - DNA, 40 bp, Artificial Sequence
  PCR primer for ORF amplification
ggatccagctagcaaaatgagcgaccttaaccaatccaaa

SEQ ID NO: 9245 - DNA, 40 bp, Artificial Sequence
  PCR primer for ORF amplification
ggatccagctagcaaaatgatcatcaataggcgtattttg

SEQ ID NO: 9246 - DNA, 40 bp, Artificial Sequence
  PCR primer for ORF amplification
ggatccagctagcaaaatggctcacgaggttcatagaata

SEQ ID NO: 9247 - DNA, 40 bp, Artificial Sequence
  PCR primer for ORF amplification
ggatccagctagcaaaatgtataagaagctggctattgcc

SEQ ID NO: 9248 - DNA, 40 bp, Artificial Sequence
  PCR primer for ORF amplification
ggatccagctagcaaaatgtcgtcgtcaattacagatgag

SEQ ID NO: 9249 - DNA, 40 bp, Artificial Sequence
  PCR primer for ORF amplification
ggatccagctagcaaaatgaagagcttcattacaaggaac

SEQ ID NO: 9250 - DNA, 40 bp, Artificial Sequence
  PCR primer for ORF amplification
ggatccagctagcaaaatggcagacttgccacagaaggta

SEQ ID NO: 9251 - DNA, 40 bp, Artificial Sequence
  PCR primer for ORF amplification
ggatccagctagcaaaatgaccaaaaaactaccttcagag

SEQ ID NO: 9252 - DNA, 40 bp, Artificial Sequence
  PCR primer for ORF amplification
ggatccagctagcaaaatgccagagtatacgctactggct

SEQ ID NO: 9253 - DNA, 40 bp, Artificial Sequence
  PCR primer for ORF amplification
ggatccagctagcaaaatgccgttaatgtccaattcggaa

SEQ ID NO: 9254 - DNA, 40 bp, Artificial Sequence
  PCR primer for ORF amplification
ggatccagctagcaaaatgggtagtagacgtcataagaac

SEQ ID NO: 9255 - DNA, 40 bp, Artificial Sequence
  PCR primer for ORF amplification
ggatccagctagcaaaatgatcataagattgcatttttac

SEQ ID NO: 9256 - DNA, 40 bp, Artificial Sequence
  PCR primer for ORF amplification
ggatccagctagcaaaatgcatagcgatactaacggtcga

SEQ ID NO: 9257 - DNA, 40 bp, Artificial Sequence
  PCR primer for ORF amplification
ggatccagctagcaaaatggacgatagtgtcagtttcatt

SEQ ID NO: 9258 - DNA, 40 bp, Artificial Sequence
  PCR primer for ORF amplification
ggatccagctagcaaaatggttaaagagagtattattgct

SEQ ID NO: 9259 - DNA, 40 bp, Artificial Sequence
  PCR primer for ORF amplification
ggatccagctagcaaaatgtacaatcctgtggacgctgtt

SEQ ID NO: 9260 - DNA, 40 bp, Artificial Sequence
  PCR primer for ORF amplification
ggatccagctagcaaaatgagagactctaatcatcgatca

SEQ ID NO: 9261 - DNA, 40 bp, Artificial Sequence
  PCR primer for ORF amplification
ggatccagctagcaaaatgagggatattgtatttgtatca

SEQ ID NO: 9262 - DNA, 40 bp, Artificial Sequence
  PCR primer for ORF amplification
ggatccagctagcaaaatgatcgaagtcccagaagacaat

SEQ ID NO: 9263 - DNA, 40 bp, Artificial Sequence
  PCR primer for ORF amplification
ggatccagctagcaaaatgattgaagaaagagatttggtt

SEQ ID NO: 9264 - DNA, 40 bp, Artificial Sequence
  PCR primer for ORF amplification
ggatccagctagcaaaatgctaaatggggaagactttgta

SEQ ID NO: 9265 - DNA, 40 bp, Artificial Sequence
  PCR primer for ORF amplification
ggatccagctagcaaaatggagggctcatatctatctgca

SEQ ID NO: 9266 - DNA, 40 bp, Artificial Sequence
  PCR primer for ORF amplification
ggatccagctagcaaaatgggcagatcaaagaaaagatca

SEQ ID NO: 9267 - DNA, 40 bp, Artificial Sequence
  PCR primer for ORF amplification
ggatccagctagcaaaatggttaaggaaactccattacac

SEQ ID NO: 9268 - DNA, 40 bp, Artificial Sequence
  PCR primer for ORF amplification
ggatccagctagcaaaatgagcagtgttcaactttcgagg

SEQ ID NO: 9269 - DNA, 40 bp, Artificial Sequence
  PCR primer for ORF amplification
ggatccagctagcaaaatgtcagttgaagtagataagcac

SEQ ID NO: 9270 - DNA, 40 bp, Artificial Sequence
  PCR primer for ORF amplification
ggatccagctagcaaaatgttcgaccaattagcagtcttt

SEQ ID NO: 9271 - DNA, 40 bp, Artificial Sequence
  PCR primer for ORF amplification
ggatccagctagcaaaatgaacagacaggaatccataaat

SEQ ID NO: 9272 - DNA, 40 bp, Artificial Sequence
  PCR primer for ORF amplification
ggatccagctagcaaaatgagattacattatagaagaaga

SEQ ID NO: 9273 - DNA, 40 bp, Artificial Sequence
  PCR primer for ORF amplification
ggatccagctagcaaaatgagcttttccaccataaatagc

SEQ ID NO: 9274 - DNA, 40 bp, Artificial Sequence
  PCR primer for ORF amplification
ggatccagctagcaaaatgctaatcacacgtttacgggtc

SEQ ID NO: 9275 - DNA, 40 bp, Artificial Sequence
  PCR primer for ORF amplification
ggatccagctagcaaaatggtacgtcgatggattcctagt

SEQ ID NO: 9276 - DNA, 40 bp, Artificial Sequence
  PCR primer for ORF amplification
ggatccagctagcaaaatgtccgttagcacgccaagtgag

SEQ ID NO: 9277 - DNA, 40 bp, Artificial Sequence
  PCR primer for ORF amplification
ggatccagctagcaaaatgttgcaaggaattttagaaacc

SEQ ID NO: 9278 - DNA, 40 bp, Artificial Sequence
  PCR primer for ORF amplification
ggatccagctagcaaaatgttgttctactcgttcgtgtgg

SEQ ID NO: 9279 - DNA, 40 bp, Artificial Sequence
  PCR primer for ORF amplification
ggatccagctagcaaaatgtttagtcactaccgctataaa

SEQ ID NO: 9280 - DNA, 40 bp, Artificial Sequence
  PCR primer for ORF amplification
ggatccagctagcaaaatgacaggtccaatagtgtacgtt

SEQ ID NO: 9281 - DNA, 40 bp, Artificial Sequence
  PCR primer for ORF amplification
ggatccagctagcaaaatgcccgctgaaattgacattgat

SEQ ID NO: 9282 - DNA, 40 bp, Artificial Sequence
  PCR primer for ORF amplification
ggatccagctagcaaaatgcttggcgaagatgaagggaat

SEQ ID NO: 9283 - DNA, 40 bp, Artificial Sequence
  PCR primer for ORF amplification
ggatccagctagcaaaatggttaatcagggccaaccgcaa

SEQ ID NO: 9284 - DNA, 40 bp, Artificial Sequence
  PCR primer for ORF amplification
ggatccagctagcaaaatgtcatcgagcaagaaaatcgtc

SEQ ID NO: 9285 - DNA, 40 bp, Artificial Sequence
  PCR primer for ORF amplification
ggatccagctagcaaaatggacttgaatcaaagaaaggaa

SEQ ID NO: 9286 - DNA, 40 bp, Artificial Sequence
  PCR primer for ORF amplification
ggatccagctagcaaaatgaactcttccacttcttcagaa

SEQ ID NO: 9287 - DNA, 40 bp, Artificial Sequence
  PCR primer for ORF amplification
ggatccagctagcaaaatgagattccaccgtcaaggtacc

SEQ ID NO: 9288 - DNA, 40 bp, Artificial Sequence
  PCR primer for ORF amplification
ggatccagctagcaaaatggaaaatcttggcgacaaactt

SEQ ID NO: 9289 - DNA, 40 bp, Artificial Sequence
  PCR primer for ORF amplification
ggatccagctagcaaaatggctactccccatttatatcac

SEQ ID NO: 9290 - DNA, 40 bp, Artificial Sequence
  PCR primer for ORF amplification
ggatccagctagcaaaatggtggtgcagaaaaaacttagg

SEQ ID NO: 9291 - DNA, 40 bp, Artificial Sequence
  PCR primer for ORF amplification
ggatccagctagcaaaatgttatcaaggtacaaccgcgtt

SEQ ID NO: 9292 - DNA, 40 bp, Artificial Sequence
  PCR primer for ORF amplification
ggatccagctagcaaaatgcctgctgtcttgagaaccagg

SEQ ID NO: 9293 - DNA, 40 bp, Artificial Sequence
  PCR primer for ORF amplification
ggatccagctagcaaaatggactacaacatatttgaggcg

SEQ ID NO: 9294 - DNA, 40 bp, Artificial Sequence
  PCR primer for ORF amplification
ggatccagctagcaaaatggtagttaagaagcgtaagttg

SEQ ID NO: 9295 - DNA, 40 bp, Artificial Sequence
  PCR primer for ORF amplification
ggatccagctagcaaaatggtgccattggaagatctgctt

SEQ ID NO: 9296 - DNA, 40 bp, Artificial Sequence
  PCR primer for ORF amplification
ggatccagctagcaaaatgaatgacgacagccaggataaa

SEQ ID NO: 9297 - DNA, 40 bp, Artificial Sequence
  PCR primer for ORF amplification
ggatccagctagcaaaatggatcacgacacagaagttata

SEQ ID NO: 9298 - DNA, 40 bp, Artificial Sequence
  PCR primer for ORF amplification
ggatccagctagcaaaatgaatgaaatggaaaacacagat

SEQ ID NO: 9299 - DNA, 40 bp, Artificial Sequence
  PCR primer for ORF amplification
ggatccagctagcaaaatgactctagaaccacactatagt

SEQ ID NO: 9300 - DNA, 40 bp, Artificial Sequence
  PCR primer for ORF amplification
ggatccagctagcaaaatgatggcttttgagaatacaagt

SEQ ID NO: 9301 - DNA, 40 bp, Artificial Sequence
  PCR primer for ORF amplification
ggatccagctagcaaaatgattaggtacactgttgctggc

SEQ ID NO: 9302 - DNA, 40 bp, Artificial Sequence
  PCR primer for ORF amplification
ggatccagctagcaaaatggagtctgttcactctcgcgat

SEQ ID NO: 9303 - DNA, 40 bp, Artificial Sequence
  PCR primer for ORF amplification
ggatccagctagcaaaatggtaaatatactgcccttccac

SEQ ID NO: 9304 - DNA, 40 bp, Artificial Sequence
  PCR primer for ORF amplification
ggatccagctagcaaaatggttgacgactcaaactatctt

SEQ ID NO: 9305 - DNA, 40 bp, Artificial Sequence
  PCR primer for ORF amplification
ggatccagctagcaaaatgatgaaaagatgcttcagtatc

SEQ ID NO: 9306 - DNA, 40 bp, Artificial Sequence
  PCR primer for ORF amplification
ggatccagctagcaaaatggaccctggtattgctaatcat

SEQ ID NO: 9307 - DNA, 40 bp, Artificial Sequence
  PCR primer for ORF amplification
ggatccagctagcaaaatggagctgccttcaataaatagc

SEQ ID NO: 9308 - DNA, 40 bp, Artificial Sequence
  PCR primer for ORF amplification
ggatccagctagcaaaatggctggagagaacccaaagaag

SEQ ID NO: 9309 - DNA, 40 bp, Artificial Sequence
  PCR primer for ORF amplification
ggatccagctagcaaaatgggtgtcgcagatttgatcaag

SEQ ID NO: 9310 - DNA, 40 bp, Artificial Sequence
  PCR primer for ORF amplification
ggatccagctagcaaaatgccagatgaaacaaattttaca

SEQ ID NO: 9311 - DNA, 40 bp, Artificial Sequence
  PCR primer for ORF amplification
ggatccagctagcaaaatggataaaagcatgatcaaaaaa

SEQ ID NO: 9312 - DNA, 40 bp, Artificial Sequence
  PCR primer for ORF amplification
ggatccagctagcaaaatgtcaagtgagtcaacaactttc

SEQ ID NO: 9313 - DNA, 40 bp, Artificial Sequence
  PCR primer for ORF amplification
ggatccagctagcaaaatgtttgcatcgagatttgaccct

SEQ ID NO: 9314 - DNA, 40 bp, Artificial Sequence
  PCR primer for ORF amplification
ggatccagctagcaaaatgctagtcttcggacctaatagt

SEQ ID NO: 9315 - DNA, 40 bp, Artificial Sequence
  PCR primer for ORF amplification
ggatccagctagcaaaatgctcatagaaaacactaatgat

SEQ ID NO: 9316 - DNA, 40 bp, Artificial Sequence
  PCR primer for ORF amplification
ggatccagctagcaaaatgcttaaatcattaaaatccaga

SEQ ID NO: 9317 - DNA, 40 bp, Artificial Sequence
  PCR primer for ORF amplification
ggatccagctagcaaaatggtgaattggcaaacattgttc

SEQ ID NO: 9318 - DNA, 40 bp, Artificial Sequence
  PCR primer for ORF amplification
ggatccagctagcaaaatgtcgtcagaaagggtcttaagt

SEQ ID NO: 9319 - DNA, 40 bp, Artificial Sequence
  PCR primer for ORF amplification
ggatccagctagcaaaatgtgttctccaactaatttctta

SEQ ID NO: 9320 - DNA, 40 bp, Artificial Sequence
  PCR primer for ORF amplification
ggatccagctagcaaaatgattaagttcactaacgagaac

SEQ ID NO: 9321 - DNA, 40 bp, Artificial Sequence
  PCR primer for ORF amplification
ggatccagctagcaaaatggtgcgttttgtttcaatttta

SEQ ID NO: 9322 - DNA, 40 bp, Artificial Sequence
  PCR primer for ORF amplification
ggatccagctagcaaaatgaattcacaaaaggcgagtaaa

SEQ ID NO: 9323 - DNA, 40 bp, Artificial Sequence
  PCR primer for ORF amplification
ggatccagctagcaaaatggaactcaacgacccttcaatt

SEQ ID NO: 9324 - DNA, 40 bp, Artificial Sequence
  PCR primer for ORF amplification
ggatccagctagcaaaatggaactctcatcaaacttaaaa

SEQ ID NO: 9325 - DNA, 40 bp, Artificial Sequence
  PCR primer for ORF amplification
ggatccagctagcaaaatggtgatagattccaaacaggat

SEQ ID NO: 9326 - DNA, 40 bp, Artificial Sequence
  PCR primer for ORF amplification
ggatccagctagcaaaatgtcaaaatttacttggaaggag

SEQ ID NO: 9327 - DNA, 40 bp, Artificial Sequence
  PCR primer for ORF amplification
ggatccagctagcaaaatgagcagtaacaacaacacaaac

SEQ ID NO: 9328 - DNA, 40 bp, Artificial Sequence
  PCR primer for ORF amplification
ggatccagctagcaaaatgagtgcagatttatcgattggt

SEQ ID NO: 9329 - DNA, 40 bp, Artificial Sequence
  PCR primer for ORF amplification
ggatccagctagcaaaatgcagaacgatcaacagaggttc

SEQ ID NO: 9330 - DNA, 40 bp, Artificial Sequence
  PCR primer for ORF amplification
ggatccagctagcaaaatgccagacaatctatcattacat

SEQ ID NO: 9331 - DNA, 40 bp, Artificial Sequence
  PCR primer for ORF amplification
ggatccagctagcaaaatgctatccaaggtattgctgaat

SEQ ID NO: 9332 - DNA, 40 bp, Artificial Sequence
  PCR primer for ORF amplification
ggatccagctagcaaaatggattacgaagaaattttattt

SEQ ID NO: 9333 - DNA, 40 bp, Artificial Sequence
  PCR primer for ORF amplification
ggatccagctagcaaaatgggactcctaaactcttcagat

SEQ ID NO: 9334 - DNA, 40 bp, Artificial Sequence
  PCR primer for ORF amplification
ggatccagctagcaaaatggtgcaaatgagatccaaaaac

SEQ ID NO: 9335 - DNA, 40 bp, Artificial Sequence
  PCR primer for ORF amplification
ggatccagctagcaaaatgtcgtcgtcgaagtctctatac

SEQ ID NO: 9336 - DNA, 40 bp, Artificial Sequence
  PCR primer for ORF amplification
ggatccagctagcaaaatgttatctttgaaaaaaggaata

SEQ ID NO: 9337 - DNA, 40 bp, Artificial Sequence
  PCR primer for ORF amplification
ggatccagctagcaaaatgaagttagaaaatactctattt

SEQ ID NO: 9338 - DNA, 40 bp, Artificial Sequence
  PCR primer for ORF amplification
ggatccagctagcaaaatgactgcgttgcatagtgtgtcc

SEQ ID NO: 9339 - DNA, 40 bp, Artificial Sequence
  PCR primer for ORF amplification
ggatccagctagcaaaatggcacctgttacaattgaaaag

SEQ ID NO: 9340 - DNA, 40 bp, Artificial Sequence
  PCR primer for ORF amplification
ggatccagctagcaaaatggctaacgacgctctaagtgct

SEQ ID NO: 9341 - DNA, 40 bp, Artificial Sequence
  PCR primer for ORF amplification
ggatccagctagcaaaatgtctggagcaagatcaacaacg

SEQ ID NO: 9342 - DNA, 40 bp, Artificial Sequence
  PCR primer for ORF amplification
ggatccagctagcaaaatgaactccaatagtaccatcgga

SEQ ID NO: 9343 - DNA, 40 bp, Artificial Sequence
  PCR primer for ORF amplification
ggatccagctagcaaaatgactaacgctttgctctctata

SEQ ID NO: 9344 - DNA, 40 bp, Artificial Sequence
  PCR primer for ORF amplification
ggatccagctagcaaaatgccaagggaaacaagtttggta

SEQ ID NO: 9345 - DNA, 40 bp, Artificial Sequence
  PCR primer for ORF amplification
ggatccagctagcaaaatggataggaaaaggtcttttgaa

SEQ ID NO: 9346 - DNA, 40 bp, Artificial Sequence
  PCR primer for ORF amplification
ggatccagctagcaaaatgacaacatatttcaagttggta

SEQ ID NO: 9347 - DNA, 40 bp, Artificial Sequence
  PCR primer for ORF amplification
ggatccagctagcaaaatgagtgaagttgagagcagagaa

SEQ ID NO: 9348 - DNA, 40 bp, Artificial Sequence
  PCR primer for ORF amplification
ggatccagctagcaaaatgggtgtgagatccgctgcaaag

SEQ ID NO: 9349 - DNA, 40 bp, Artificial Sequence
  PCR primer for ORF amplification
ggatccagctagcaaaatgaatcaacctcaaattggcact

SEQ ID NO: 9350 - DNA, 40 bp, Artificial Sequence
  PCR primer for ORF amplification
ggatccagctagcaaaatgtctcgtactaacatggataca

SEQ ID NO: 9351 - DNA, 40 bp, Artificial Sequence
  PCR primer for ORF amplification
ggatccagctagcaaaatgagcgaatcagtgaaagaaaac

SEQ ID NO: 9352 - DNA, 40 bp, Artificial Sequence
  PCR primer for ORF amplification
ggatccagctagcaaaatgatatctagaaccattggtgaa

SEQ ID NO: 9353 - DNA, 40 bp, Artificial Sequence
  PCR primer for ORF amplification
ggatccagctagcaaaatgccggtatctgattctggattc

SEQ ID NO: 9354 - DNA, 40 bp, Artificial Sequence
  PCR primer for ORF amplification
ggatccagctagcaaaatggaaactattttgcagccaaag

SEQ ID NO: 9355 - DNA, 40 bp, Artificial Sequence
  PCR primer for ORF amplification
ggatccagctagcaaaatggccgaaaactccctcctgagg

SEQ ID NO: 9356 - DNA, 40 bp, Artificial Sequence
  PCR primer for ORF amplification
ggatccagctagcaaaatgtacgaacagtttgaattttct

SEQ ID NO: 9357 - DNA, 40 bp, Artificial Sequence
  PCR primer for ORF amplification
ggatccagctagcaaaatgtctaaagctgtcggtattgat

SEQ ID NO: 9358 - DNA, 40 bp, Artificial Sequence
  PCR primer for ORF amplification
ggatccagctagcaaaatgaacggtcctccaacattcact

SEQ ID NO: 9359 - DNA, 40 bp, Artificial Sequence
  PCR primer for ORF amplification
ggatccagctagcaaaatgaggagagagaggcaaaggatg

SEQ ID NO: 9360 - DNA, 40 bp, Artificial Sequence
  PCR primer for ORF amplification
ggatccagctagcaaaatgccaccaaaagaagctcccaag

SEQ ID NO: 9361 - DNA, 40 bp, Artificial Sequence
  PCR primer for ORF amplification
ggatccagctagcaaaatgctaaatcagcacacaagttca

SEQ ID NO: 9362 - DNA, 40 bp, Artificial Sequence
  PCR primer for ORF amplification
ggatccagctagcaaaatgctatcgctaaaaaaatcagcg

SEQ ID NO: 9363 - DNA, 40 bp, Artificial Sequence
  PCR primer for ORF amplification
ggatccagctagcaaaatggctaaagataatttaactaat

SEQ ID NO: 9364 - DNA, 40 bp, Artificial Sequence
  PCR primer for ORF amplification
ggatccagctagcaaaatgtcacctcgacagcttataccg

SEQ ID NO: 9365 - DNA, 40 bp, Artificial Sequence
  PCR primer for ORF amplification
ggatccagctagcaaaatgtcagacttaaatgatgtccaa

SEQ ID NO: 9366 - DNA, 40 bp, Artificial Sequence
  PCR primer for ORF amplification
ggatccagctagcaaaatggatgttctcaaagaggtgttg

SEQ ID NO: 9367 - DNA, 40 bp, Artificial Sequence
  PCR primer for ORF amplification
ggatccagctagcaaaatgtacaacgagcaggtgaactct

SEQ ID NO: 9368 - DNA, 40 bp, Artificial Sequence
  PCR primer for ORF amplification
ggatccagctagcaaaatgaaggaaacggcgcaggaatac

SEQ ID NO: 9369 - DNA, 40 bp, Artificial Sequence
  PCR primer for ORF amplification
ggatccagctagcaaaatgacaaggctcaaagcaaaatat

SEQ ID NO: 9370 - DNA, 40 bp, Artificial Sequence
  PCR primer for ORF amplification
ggatccagctagcaaaatgagcccgaaaaacaaatatgta

SEQ ID NO: 9371 - DNA, 40 bp, Artificial Sequence
  PCR primer for ORF amplification
ggatccagctagcaaaatggacaagaagaaggatctactg

SEQ ID NO: 9372 - DNA, 40 bp, Artificial Sequence
  PCR primer for ORF amplification
ggatccagctagcaaaatggtgcacattactctgggtcaa

SEQ ID NO: 9373 - DNA, 40 bp, Artificial Sequence
  PCR primer for ORF amplification
ggatccagctagcaaaatgtcaaaagctgtcggtattgat

SEQ ID NO: 9374 - DNA, 40 bp, Artificial Sequence
  PCR primer for ORF amplification
ggatccagctagcaaaatgtcaaaagctgttggtattgat

SEQ ID NO: 9375 - DNA, 40 bp, Artificial Sequence
  PCR primer for ORF amplification
ggatccagctagcaaaatgtcacattccggagctgccatt

SEQ ID NO: 9376 - DNA, 40 bp, Artificial Sequence
  PCR primer for ORF amplification
ggatccagctagcaaaatgtcatctcagtttttcctgaaa

SEQ ID NO: 9377 - DNA, 40 bp, Artificial Sequence
  PCR primer for ORF amplification
ggatccagctagcaaaatggattctcctgttctacagtcc

SEQ ID NO: 9378 - DNA, 40 bp, Artificial Sequence
  PCR primer for ORF amplification
ggatccagctagcaaaatgggttcgggcgatactagagga

SEQ ID NO: 9379 - DNA, 40 bp, Artificial Sequence
  PCR primer for ORF amplification
ggatccagctagcaaaatgtggaaattcaacaaaaagctc

SEQ ID NO: 9380 - DNA, 40 bp, Artificial Sequence
  PCR primer for ORF amplification
ggatccagctagcaaaatgttcgggatagtttatctgaag

SEQ ID NO: 9381 - DNA, 40 bp, Artificial Sequence
  PCR primer for ORF amplification
ggatccagctagcaaaatgaagagaaaaactgctgaagtt

SEQ ID NO: 9382 - DNA, 40 bp, Artificial Sequence
  PCR primer for ORF amplification
ggatccagctagcaaaatgaaggctaatggtttagataat

SEQ ID NO: 9383 - DNA, 40 bp, Artificial Sequence
  PCR primer for ORF amplification
ggatccagctagcaaaatgaatctcaatgaaagctaccta

SEQ ID NO: 9384 - DNA, 40 bp, Artificial Sequence
  PCR primer for ORF amplification
ggatccagctagcaaaatggataatgatggacccagatct

SEQ ID NO: 9385 - DNA, 40 bp, Artificial Sequence
  PCR primer for ORF amplification
ggatccagctagcaaaatgtccaaggtctatctgaattca

SEQ ID NO: 9386 - DNA, 40 bp, Artificial Sequence
  PCR primer for ORF amplification
ggatccagctagcaaaatgttaccatcatggaaagccttt

SEQ ID NO: 9387 - DNA, 40 bp, Artificial Sequence
  PCR primer for ORF amplification
ggatccagctagcaaaatgatactgatctcgggatactgt

SEQ ID NO: 9388 - DNA, 40 bp, Artificial Sequence
  PCR primer for ORF amplification
ggatccagctagcaaaatgctgaaatttagaattaggcca

SEQ ID NO: 9389 - DNA, 40 bp, Artificial Sequence
  PCR primer for ORF amplification
ggatccagctagcaaaatggttgaaaaacgtagtagacag

SEQ ID NO: 9390 - DNA, 40 bp, Artificial Sequence
  PCR primer for ORF amplification
ggatccagctagcaaaatgtctgatgaagataacaattat

SEQ ID NO: 9391 - DNA, 40 bp, Artificial Sequence
  PCR primer for ORF amplification
ggatccagctagcaaaatgagttacgaatctgggaggtca

SEQ ID NO: 9392 - DNA, 40 bp, Artificial Sequence
  PCR primer for ORF amplification
ggatccagctagcaaaatgatgcttagaagaaatgcggtg

SEQ ID NO: 9393 - DNA, 40 bp, Artificial Sequence
  PCR primer for ORF amplification
ggatccagctagcaaaatgattggtgcctttaagaggaac

SEQ ID NO: 9394 - DNA, 40 bp, Artificial Sequence
  PCR primer for ORF amplification
ggatccagctagcaaaatgaaatatcccgcttttagcatt

SEQ ID NO: 9395 - DNA, 40 bp, Artificial Sequence
  PCR primer for ORF amplification
ggatccagctagcaaaatgagagcatatggaaagaggggc

SEQ ID NO: 9396 - DNA, 40 bp, Artificial Sequence
  PCR primer for ORF amplification
ggatccagctagcaaaatgcaactttcatggaaggatatc

SEQ ID NO: 9397 - DNA, 40 bp, Artificial Sequence
  PCR primer for ORF amplification
ggatccagctagcaaaatggaagctggcaggagtgctgat

SEQ ID NO: 9398 - DNA, 40 bp, Artificial Sequence
  PCR primer for ORF amplification
ggatccagctagcaaaatggcgtcacagcaaaacaaacac

SEQ ID NO: 9399 - DNA, 40 bp, Artificial Sequence
  PCR primer for ORF amplification
ggatccagctagcaaaatgtcaagcgaggaacgctcgaga

SEQ ID NO: 9400 - DNA, 40 bp, Artificial Sequence
  PCR primer for ORF amplification
ggatccagctagcaaaatgatgttggagccttcacctcca

SEQ ID NO: 9401 - DNA, 40 bp, Artificial Sequence
  PCR primer for ORF amplification
ggatccagctagcaaaatgccttacagccatggtaagaag

SEQ ID NO: 9402 - DNA, 40 bp, Artificial Sequence
  PCR primer for ORF amplification
ggatccagctagcaaaatgccagtggaggagcctcttgct

SEQ ID NO: 9403 - DNA, 40 bp, Artificial Sequence
  PCR primer for ORF amplification
ggatccagctagcaaaatggtttcagcgcaagtggctacc

SEQ ID NO: 9404 - DNA, 40 bp, Artificial Sequence
  PCR primer for ORF amplification
ggatccagctagcaaaatgtcattagtgcataatcagacg

SEQ ID NO: 9405 - DNA, 40 bp, Artificial Sequence
  PCR primer for ORF amplification
ggatccagctagcaaaatgtctagagcagttggtattgat

SEQ ID NO: 9406 - DNA, 40 bp, Artificial Sequence
  PCR primer for ORF amplification
ggatccagctagcaaaatgttttcggtaacgagaagaaga

SEQ ID NO: 9407 - DNA, 40 bp, Artificial Sequence
  PCR primer for ORF amplification
ggatccagctagcaaaatgagtgtgtctaccgccaagagg

SEQ ID NO: 9408 - DNA, 40 bp, Artificial Sequence
  PCR primer for ORF amplification
ggatccagctagcaaaatgtattatggaatcagccagttt

SEQ ID NO: 9409 - DNA, 40 bp, Artificial Sequence
  PCR primer for ORF amplification
ggatccagctagcaaaatgttcacttttctcaaaattatt

SEQ ID NO: 9410 - DNA, 40 bp, Artificial Sequence
  PCR primer for ORF amplification
ggatccagctagcaaaatgagcgaatcggaagccaaatct

SEQ ID NO: 9411 - DNA, 40 bp, Artificial Sequence
  PCR primer for ORF amplification
ggatccagctagcaaaatgagtggaaaatttgttcgtgct

SEQ ID NO: 9412 - DNA, 40 bp, Artificial Sequence
  PCR primer for ORF amplification
ggatccagctagcaaaatggcaaagaagaataagaaggat

SEQ ID NO: 9413 - DNA, 40 bp, Artificial Sequence
  PCR primer for ORF amplification
ggatccagctagcaaaatgggattaaagaaattttttaag

SEQ ID NO: 9414 - DNA, 40 bp, Artificial Sequence
  PCR primer for ORF amplification
ggatccagctagcaaaatgtcgtctcctattaatgattat

SEQ ID NO: 9415 - DNA, 40 bp, Artificial Sequence
  PCR primer for ORF amplification
ggatccagctagcaaaatggaccaaaaaggtatgttctgg

SEQ ID NO: 9416 - DNA, 40 bp, Artificial Sequence
  PCR primer for ORF amplification
ggatccagctagcaaaatgccaaataatactcttaaacaa

SEQ ID NO: 9417 - DNA, 40 bp, Artificial Sequence
  PCR primer for ORF amplification
ggatccagctagcaaaatgctacagatcaactccaggctt

SEQ ID NO: 9418 - DNA, 40 bp, Artificial Sequence
  PCR primer for ORF amplification
ggatccagctagcaaaatgcttgctgctaaaaacatacta

SEQ ID NO: 9419 - DNA, 40 bp, Artificial Sequence
  PCR primer for ORF amplification
ggatccagctagcaaaatggacgagttactgggagaagcg

SEQ ID NO: 9420 - DNA, 40 bp, Artificial Sequence
  PCR primer for ORF amplification
ggatccagctagcaaaatgtttttacctcgtctcgttcgg

SEQ ID NO: 9421 - DNA, 40 bp, Artificial Sequence
  PCR primer for ORF amplification
ggatccagctagcaaaatgaagggcgtaaaaaaggaagga

SEQ ID NO: 9422 - DNA, 40 bp, Artificial Sequence
  PCR primer for ORF amplification
ggatccagctagcaaaatgatacagacgccaagggagttg

SEQ ID NO: 9423 - DNA, 40 bp, Artificial Sequence
  PCR primer for ORF amplification
ggatccagctagcaaaatggatttactacgcattttagac

SEQ ID NO: 9424 - DNA, 40 bp, Artificial Sequence
  PCR primer for ORF amplification
ggatccagctagcaaaatgaaagtgctatgtgtcgcagag

SEQ ID NO: 9425 - DNA, 40 bp, Artificial Sequence
  PCR primer for ORF amplification
ggatccagctagcaaaatgaacaatgtacacataattaaa

SEQ ID NO: 9426 - DNA, 40 bp, Artificial Sequence
  PCR primer for ORF amplification
ggatccagctagcaaaatgatggcaactccggctactgat

SEQ ID NO: 9427 - DNA, 40 bp, Artificial Sequence
  PCR primer for ORF amplification
ggatccagctagcaaaatgcactggaatataatttcgaaa

SEQ ID NO: 9428 - DNA, 40 bp, Artificial Sequence
  PCR primer for ORF amplification
ggatccagctagcaaaatggcacctttaaccaagaagaca

SEQ ID NO: 9429 - DNA, 40 bp, Artificial Sequence
  PCR primer for ORF amplification
ggatccagctagcaaaatgtcttaccaacggaacagtgca

SEQ ID NO: 9430 - DNA, 40 bp, Artificial Sequence
  PCR primer for ORF amplification
ggatccagctagcaaaatgaggtcaggcgatgcagagatt

SEQ ID NO: 9431 - DNA, 40 bp, Artificial Sequence
  PCR primer for ORF amplification
ggatccagctagcaaaatgagtgataatggttcccccgcg

SEQ ID NO: 9432 - DNA, 40 bp, Artificial Sequence
  PCR primer for ORF amplification
ggatccagctagcaaaatgcttaaatctggtagactcaac

SEQ ID NO: 9433 - DNA, 40 bp, Artificial Sequence
  PCR primer for ORF amplification
ggatccagctagcaaaatgtccatcagagatttatatcat

SEQ ID NO: 9434 - DNA, 40 bp, Artificial Sequence
  PCR primer for ORF amplification
ggatccagctagcaaaatgttggcccgttccagggtgtgc

SEQ ID NO: 9435 - DNA, 40 bp, Artificial Sequence
  PCR primer for ORF amplification
ggatccagctagcaaaatgcaaaaactcctctttgtcttt

SEQ ID NO: 9436 - DNA, 40 bp, Artificial Sequence
  PCR primer for ORF amplification
ggatccagctagcaaaatgccaaactctcatggtaatgta

SEQ ID NO: 9437 - DNA, 40 bp, Artificial Sequence
  PCR primer for ORF amplification
ggatccagctagcaaaatgccttcttctttgacaaaaacc

SEQ ID NO: 9438 - DNA, 40 bp, Artificial Sequence
  PCR primer for ORF amplification
ggatccagctagcaaaatggatagtacgaatttgaacaaa

SEQ ID NO: 9439 - DNA, 40 bp, Artificial Sequence
  PCR primer for ORF amplification
ggatccagctagcaaaatgagcttgcacattagtaaactg

SEQ ID NO: 9440 - DNA, 40 bp, Artificial Sequence
  PCR primer for ORF amplification
ggatccagctagcaaaatgagtgctgctccattggattac

SEQ ID NO: 9441 - DNA, 40 bp, Artificial Sequence
  PCR primer for ORF amplification
ggatccagctagcaaaatgctgttgtgtaatagaaaagtc

SEQ ID NO: 9442 - DNA, 40 bp, Artificial Sequence
  PCR primer for ORF amplification
ggatccagctagcaaaatgagcggttttaaatgctatttg

SEQ ID NO: 9443 - DNA, 40 bp, Artificial Sequence
  PCR primer for ORF amplification
ggatccagctagcaaaatgagtgaactgcttgccattcca

SEQ ID NO: 9444 - DNA, 40 bp, Artificial Sequence
  PCR primer for ORF amplification
ggatccagctagcaaaatgcaaagttcagtttattttgac

SEQ ID NO: 9445 - DNA, 40 bp, Artificial Sequence
  PCR primer for ORF amplification
ggatccagctagcaaaatgggcacactgtttcgaagaaat

SEQ ID NO: 9446 - DNA, 40 bp, Artificial Sequence
  PCR primer for ORF amplification
ggatccagctagcaaaatgtcaaggaaatctatagtgcaa

SEQ ID NO: 9447 - DNA, 40 bp, Artificial Sequence
  PCR primer for ORF amplification
ggatccagctagcaaaatgaaggacttgagattacagggg

SEQ ID NO: 9448 - DNA, 40 bp, Artificial Sequence
  PCR primer for ORF amplification
ggatccagctagcaaaatgacagtctcacacaatcattct

SEQ ID NO: 9449 - DNA, 40 bp, Artificial Sequence
  PCR primer for ORF amplification
ggatccagctagcaaaatgactaaagaaacgattcgggta

SEQ ID NO: 9450 - DNA, 40 bp, Artificial Sequence
  PCR primer for ORF amplification
ggatccagctagcaaaatgagttataaggctaaccaacca

SEQ ID NO: 9451 - DNA, 40 bp, Artificial Sequence
  PCR primer for ORF amplification
ggatccagctagcaaaatgaagttactttttaaaagatat

SEQ ID NO: 9452 - DNA, 40 bp, Artificial Sequence
  PCR primer for ORF amplification
ggatccagctagcaaaatgacgcttggtaatagacgccat

SEQ ID NO: 9453 - DNA, 40 bp, Artificial Sequence
  PCR primer for ORF amplification
ggatccagctagcaaaatgccatttcaagattattttcag

SEQ ID NO: 9454 - DNA, 40 bp, Artificial Sequence
  PCR primer for ORF amplification
ggatccagctagcaaaatgcctacaaattacgagtatgat

SEQ ID NO: 9455 - DNA, 40 bp, Artificial Sequence
  PCR primer for ORF amplification
ggatccagctagcaaaatgcgtgcgcacagaatcgataca

SEQ ID NO: 9456 - DNA, 40 bp, Artificial Sequence
  PCR primer for ORF amplification
ggatccagctagcaaaatggatcacagaaaccttgatccg

SEQ ID NO: 9457 - DNA, 40 bp, Artificial Sequence
  PCR primer for ORF amplification
ggatccagctagcaaaatggctaagagaaatagatctcaa

SEQ ID NO: 9458 - DNA, 40 bp, Artificial Sequence
  PCR primer for ORF amplification
ggatccagctagcaaaatgggtactggtaagaaagagaaa

SEQ ID NO: 9459 - DNA, 40 bp, Artificial Sequence
  PCR primer for ORF amplification
ggatccagctagcaaaatgaagttgcagagtttgttggtt

SEQ ID NO: 9460 - DNA, 40 bp, Artificial Sequence
  PCR primer for ORF amplification
ggatccagctagcaaaatggtcacgactccattgcattcc

SEQ ID NO: 9461 - DNA, 40 bp, Artificial Sequence
  PCR primer for ORF amplification
ggatccagctagcaaaatgttgacctctatattgataaaa

SEQ ID NO: 9462 - DNA, 40 bp, Artificial Sequence
  PCR primer for ORF amplification
ggatccagctagcaaaatgaagcataacaggcagatgcca

SEQ ID NO: 9463 - DNA, 40 bp, Artificial Sequence
  PCR primer for ORF amplification
ggatccagctagcaaaatggaagagactgcgaagaaacca

SEQ ID NO: 9464 - DNA, 40 bp, Artificial Sequence
  PCR primer for ORF amplification
ggatccagctagcaaaatggatatcgagcctactttcaaa

SEQ ID NO: 9465 - DNA, 40 bp, Artificial Sequence
  PCR primer for ORF amplification
ggatccagctagcaaaatggctgtggaggaaattgcgtcc

SEQ ID NO: 9466 - DNA, 40 bp, Artificial Sequence
  PCR primer for ORF amplification
ggatccagctagcaaaatgggaaagactaaaacaagaggc

SEQ ID NO: 9467 - DNA, 40 bp, Artificial Sequence
  PCR primer for ORF amplification
ggatccagctagcaaaatgagtgtagaagatatcaagaag

SEQ ID NO: 9468 - DNA, 40 bp, Artificial Sequence
  PCR primer for ORF amplification
ggatccagctagcaaaatgagtttagtaccatatgaagaa

SEQ ID NO: 9469 - DNA, 40 bp, Artificial Sequence
  PCR primer for ORF amplification
ggatccagctagcaaaatgatttacaaaatggcacacgta

SEQ ID NO: 9470 - DNA, 40 bp, Artificial Sequence
  PCR primer for ORF amplification
ggatccagctagcaaaatggaaacatgggaagtcatagca

SEQ ID NO: 9471 - DNA, 40 bp, Artificial Sequence
  PCR primer for ORF amplification
ggatccagctagcaaaatggaagacaagtttgctaacctc

SEQ ID NO: 9472 - DNA, 40 bp, Artificial Sequence
  PCR primer for ORF amplification
ggatccagctagcaaaatggagaccagttcttttgagaat

SEQ ID NO: 9473 - DNA, 40 bp, Artificial Sequence
  PCR primer for ORF amplification
ggatccagctagcaaaatggagcaaaacgctgaaaaacgc

SEQ ID NO: 9474 - DNA, 40 bp, Artificial Sequence
  PCR primer for ORF amplification
ggatccagctagcaaaatggagcggcctggcttggtattg

SEQ ID NO: 9475 - DNA, 40 bp, Artificial Sequence
  PCR primer for ORF amplification
ggatccagctagcaaaatgtcagatccatttgcacattta

SEQ ID NO: 9476 - DNA, 40 bp, Artificial Sequence
  PCR primer for ORF amplification
ggatccagctagcaaaatgagctacagttatgaagcttgt

SEQ ID NO: 9477 - DNA, 40 bp, Artificial Sequence
  PCR primer for ORF amplification
ggatccagctagcaaaatgagtaatcctcaaaaagctcta

SEQ ID NO: 9478 - DNA, 40 bp, Artificial Sequence
  PCR primer for ORF amplification
ggatccagctagcaaaatgctgcgtgtaacaaccttggcg

SEQ ID NO: 9479 - DNA, 40 bp, Artificial Sequence
  PCR primer for ORF amplification
ggatccagctagcaaaatgcttagaaccagactatccgtt

SEQ ID NO: 9480 - DNA, 40 bp, Artificial Sequence
  PCR primer for ORF amplification
ggatccagctagcaaaatgtctcccatacaggttgttgtc

SEQ ID NO: 9481 - DNA, 40 bp, Artificial Sequence
  PCR primer for ORF amplification
ggatccagctagcaaaatgaggatctgtcattcgagaact

SEQ ID NO: 9482 - DNA, 40 bp, Artificial Sequence
  PCR primer for ORF amplification
ggatccagctagcaaaatggtagaaccggacatgcagaag

SEQ ID NO: 9483 - DNA, 40 bp, Artificial Sequence
  PCR primer for ORF amplification
ggatccagctagcaaaatgtccatttcaaccagtttgaac

SEQ ID NO: 9484 - DNA, 40 bp, Artificial Sequence
  PCR primer for ORF amplification
ggatccagctagcaaaatgatggataatcaggctgtaaag

SEQ ID NO: 9485 - DNA, 40 bp, Artificial Sequence
  PCR primer for ORF amplification
ggatccagctagcaaaatgtcttcagttgatgtactgtta

SEQ ID NO: 9486 - DNA, 40 bp, Artificial Sequence
  PCR primer for ORF amplification
ggatccagctagcaaaatgttcttgcttccatttgtcatt

SEQ ID NO: 9487 - DNA, 40 bp, Artificial Sequence
  PCR primer for ORF amplification
ggatccagctagcaaaatgaaacgaggtgtttggttgctg

SEQ ID NO: 9488 - DNA, 40 bp, Artificial Sequence
  PCR primer for ORF amplification
ggatccagctagcaaaatgaagcaggagcagtcccacgaa

SEQ ID NO: 9489 - DNA, 40 bp, Artificial Sequence
  PCR primer for ORF amplification
ggatccagctagcaaaatgatgtctaacgttgctaacgcc

SEQ ID NO: 9490 - DNA, 40 bp, Artificial Sequence
  PCR primer for ORF amplification
ggatccagctagcaaaatggcagtaataccggcaaagaaa

SEQ ID NO: 9491 - DNA, 40 bp, Artificial Sequence
  PCR primer for ORF amplification
ggatccagctagcaaaatgtcaacgcactcaaacgactac

SEQ ID NO: 9492 - DNA, 40 bp, Artificial Sequence
  PCR primer for ORF amplification
ggatccagctagcaaaatgacaaacaaatctagcctgaag

SEQ ID NO: 9493 - DNA, 40 bp, Artificial Sequence
  PCR primer for ORF amplification
ggatccagctagcaaaatgagtaggaaaaattctaagaaa

SEQ ID NO: 9494 - DNA, 40 bp, Artificial Sequence
  PCR primer for ORF amplification
ggatccagctagcaaaatggaaccaattgatgacatactt

SEQ ID NO: 9495 - DNA, 40 bp, Artificial Sequence
  PCR primer for ORF amplification
ggatccagctagcaaaatggttgtagtgggtaagagtgaa

SEQ ID NO: 9496 - DNA, 40 bp, Artificial Sequence
  PCR primer for ORF amplification
ggatccagctagcaaaatgtcggatgtagataactgggaa

SEQ ID NO: 9497 - DNA, 40 bp, Artificial Sequence
  PCR primer for ORF amplification
ggatccagctagcaaaatgaattttaaaatactcctcccg

SEQ ID NO: 9498 - DNA, 40 bp, Artificial Sequence
  PCR primer for ORF amplification
ggatccagctagcaaaatggactacgaggataatctagaa

SEQ ID NO: 9499 - DNA, 40 bp, Artificial Sequence
  PCR primer for ORF amplification
ggatccagctagcaaaatggtatcagccaacggcgacttg

SEQ ID NO: 9500 - DNA, 40 bp, Artificial Sequence
  PCR primer for ORF amplification
ggatccagctagcaaaatgaattttgatgcggtagcagat

SEQ ID NO: 9501 - DNA, 40 bp, Artificial Sequence
  PCR primer for ORF amplification
ggatccagctagcaaaatgctcagaagacacggattattc

SEQ ID NO: 9502 - DNA, 40 bp, Artificial Sequence
  PCR primer for ORF amplification
ggatccagctagcaaaatgggtagacggaagattgaaatc

SEQ ID NO: 9503 - DNA, 40 bp, Artificial Sequence
  PCR primer for ORF amplification
ggatccagctagcaaaatgtctacaaatatattgcaacat

SEQ ID NO: 9504 - DNA, 40 bp, Artificial Sequence
  PCR primer for ORF amplification
ggatccagctagcaaaatgtctgactcctcagaagccact

SEQ ID NO: 9505 - DNA, 40 bp, Artificial Sequence
  PCR primer for ORF amplification
ggatccagctagcaaaatgcattcctggcgaatatccaag

SEQ ID NO: 9506 - DNA, 40 bp, Artificial Sequence
  PCR primer for ORF amplification
ggatccagctagcaaaatgtccagctctacgactcctgat

SEQ ID NO: 9507 - DNA, 40 bp, Artificial Sequence
  PCR primer for ORF amplification
ggatccagctagcaaaatgtttaagacttcatataacttg

SEQ ID NO: 9508 - DNA, 40 bp, Artificial Sequence
  PCR primer for ORF amplification
ggatccagctagcaaaatgcactctcatagacaaaagtgg

SEQ ID NO: 9509 - DNA, 40 bp, Artificial Sequence
  PCR primer for ORF amplification
ggatccagctagcaaaatgggactcttagctttgggcacg

SEQ ID NO: 9510 - DNA, 40 bp, Artificial Sequence
  PCR primer for ORF amplification
ggatccagctagcaaaatgggtgtgcattttgatgataat

SEQ ID NO: 9511 - DNA, 40 bp, Artificial Sequence
  PCR primer for ORF amplification
ggatccagctagcaaaatgtcattcagcaacggaaatatg

SEQ ID NO: 9512 - DNA, 40 bp, Artificial Sequence
  PCR primer for ORF amplification
ggatccagctagcaaaatgaatattgtcaaattacaagta

SEQ ID NO: 9513 - DNA, 40 bp, Artificial Sequence
  PCR primer for ORF amplification
ggatccagctagcaaaatgcacgacaagaagtcgcccatg

SEQ ID NO: 9514 - DNA, 40 bp, Artificial Sequence
  PCR primer for ORF amplification
ggatccagctagcaaaatgccatcggaagttacgccaaaa

SEQ ID NO: 9515 - DNA, 40 bp, Artificial Sequence
  PCR primer for ORF amplification
ggatccagctagcaaaatggacaaaatcaatcctgattgg

SEQ ID NO: 9516 - DNA, 40 bp, Artificial Sequence
  PCR primer for ORF amplification
ggatccagctagcaaaatggatacgtcagtatattctcat

SEQ ID NO: 9517 - DNA, 40 bp, Artificial Sequence
  PCR primer for ORF amplification
ggatccagctagcaaaatggcatttagaaaatcaaatgtg

SEQ ID NO: 9518 - DNA, 40 bp, Artificial Sequence
  PCR primer for ORF amplification
ggatccagctagcaaaatgactcaattcactgacattgat

SEQ ID NO: 9519 - DNA, 40 bp, Artificial Sequence
  PCR primer for ORF amplification
ggatccagctagcaaaatggcacctctttcgttgaacttt

SEQ ID NO: 9520 - DNA, 40 bp, Artificial Sequence
  PCR primer for ORF amplification
ggatccagctagcaaaatgtattcttggaagtcaaagttt

SEQ ID NO: 9521 - DNA, 40 bp, Artificial Sequence
  PCR primer for ORF amplification
ggatccagctagcaaaatggcacagttctccgacattgat

SEQ ID NO: 9522 - DNA, 40 bp, Artificial Sequence
  PCR primer for ORF amplification
ggatccagctagcaaaatgaataactcaaatgagcatagg

SEQ ID NO: 9523 - DNA, 40 bp, Artificial Sequence
  PCR primer for ORF amplification
ggatccagctagcaaaatggatagcttcaattatattcat

SEQ ID NO: 9524 - DNA, 40 bp, Artificial Sequence
  PCR primer for ORF amplification
ggatccagctagcaaaatgtttttcaacagactaagcgct

SEQ ID NO: 9525 - DNA, 40 bp, Artificial Sequence
  PCR primer for ORF amplification
ggatccagctagcaaaatgaacaaagaattggcttctaag

SEQ ID NO: 9526 - DNA, 40 bp, Artificial Sequence
  PCR primer for ORF amplification
ggatccagctagcaaaatgacaatcaaggaacataaagta

SEQ ID NO: 9527 - DNA, 40 bp, Artificial Sequence
  PCR primer for ORF amplification
ggatccagctagcaaaatggattttacaacaatgactatg

SEQ ID NO: 9528 - DNA, 40 bp, Artificial Sequence
  PCR primer for ORF amplification
ggatccagctagcaaaatggacaccagcaagaaagatact

SEQ ID NO: 9529 - DNA, 40 bp, Artificial Sequence
  PCR primer for ORF amplification
ggatccagctagcaaaatggctagaagaaagaatttcaaa

SEQ ID NO: 9530 - DNA, 40 bp, Artificial Sequence
  PCR primer for ORF amplification
ggatccagctagcaaaatgttaaaatgtatatgccgtgtc

SEQ ID NO: 9531 - DNA, 40 bp, Artificial Sequence
  PCR primer for ORF amplification
ggatccagctagcaaaatgaagtttatagcattaatatca

SEQ ID NO: 9532 - DNA, 40 bp, Artificial Sequence
  PCR primer for ORF amplification
ggatccagctagcaaaatgagtaagtatggtccattgggt

SEQ ID NO: 9533 - DNA, 40 bp, Artificial Sequence
  PCR primer for ORF amplification
ggatccagctagcaaaatggaagaaacaatagaaaatgtt

SEQ ID NO: 9534 - DNA, 40 bp, Artificial Sequence
  PCR primer for ORF amplification
ggatccagctagcaaaatgtcggattcaaaccaaggcaac

SEQ ID NO: 9535 - DNA, 40 bp, Artificial Sequence
  PCR primer for ORF amplification
ggatccagctagcaaaatgtctctgacaccaactaatgaa

SEQ ID NO: 9536 - DNA, 40 bp, Artificial Sequence
  PCR primer for ORF amplification
ggatccagctagcaaaatgaatttaaagtccatcgttagc

SEQ ID NO: 9537 - DNA, 40 bp, Artificial Sequence
  PCR primer for ORF amplification
ggatccagctagcaaaatgaccgatatcacacccgtacag

SEQ ID NO: 9538 - DNA, 40 bp, Artificial Sequence
  PCR primer for ORF amplification
ggatccagctagcaaaatgatacgtccattatgttcaaaa

SEQ ID NO: 9539 - DNA, 40 bp, Artificial Sequence
  PCR primer for ORF amplification
ggatccagctagcaaaatggttagaacccgtgtattattc

SEQ ID NO: 9540 - DNA, 40 bp, Artificial Sequence
  PCR primer for ORF amplification
ggatccagctagcaaaatgtcgaaaaacaacacaatgacc

SEQ ID NO: 9541 - DNA, 40 bp, Artificial Sequence
  PCR primer for ORF amplification
ggatccagctagcaaaatgaaacctccgttaaacatgtca

SEQ ID NO: 9542 - DNA, 40 bp, Artificial Sequence
  PCR primer for ORF amplification
ggatccagctagcaaaatgacaacggaagatccagattca

SEQ ID NO: 9543 - DNA, 40 bp, Artificial Sequence
  PCR primer for ORF amplification
ggatccagctagcaaaatgactttgaaaccttcaaagaga

SEQ ID NO: 9544 - DNA, 40 bp, Artificial Sequence
  PCR primer for ORF amplification
ggatccagctagcaaaatgatcagacaatctacgctaaaa

SEQ ID NO: 9545 - DNA, 40 bp, Artificial Sequence
  PCR primer for ORF amplification
ggatccagctagcaaaatgccaaacttaaagagactaccc

SEQ ID NO: 9546 - DNA, 40 bp, Artificial Sequence
  PCR primer for ORF amplification
ggatccagctagcaaaatgccttacaaaatcaaccgaatg

SEQ ID NO: 9547 - DNA, 40 bp, Artificial Sequence
  PCR primer for ORF amplification
ggatccagctagcaaaatggacactttagagccaacagcc

SEQ ID NO: 9548 - DNA, 40 bp, Artificial Sequence
  PCR primer for ORF amplification
ggatccagctagcaaaatgtgcgccagtttaaacgaggta

SEQ ID NO: 9549 - DNA, 40 bp, Artificial Sequence
  PCR primer for ORF amplification
ggatccagctagcaaaatgaaagtccaaataaccaatagt

SEQ ID NO: 9550 - DNA, 40 bp, Artificial Sequence
  PCR primer for ORF amplification
ggatccagctagcaaaatgcctgtttcggaagcgtttgcc

SEQ ID NO: 9551 - DNA, 40 bp, Artificial Sequence
  PCR primer for ORF amplification
ggatccagctagcaaaatggagtacatcaagattgccaaa

SEQ ID NO: 9552 - DNA, 40 bp, Artificial Sequence
  PCR primer for ORF amplification
ggatccagctagcaaaatgggggaaaaaaggacaataatc

SEQ ID NO: 9553 - DNA, 40 bp, Artificial Sequence
  PCR primer for ORF amplification
ggatccagctagcaaaatgggtctaaaaattacaaaagga

SEQ ID NO: 9554 - DNA, 40 bp, Artificial Sequence
  PCR primer for ORF amplification
ggatccagctagcaaaatggttttagaaacgctgaaacaa

SEQ ID NO: 9555 - DNA, 40 bp, Artificial Sequence
  PCR primer for ORF amplification
ggatccagctagcaaaatgtccattgacgaggctgttgcc

SEQ ID NO: 9556 - DNA, 40 bp, Artificial Sequence
  PCR primer for ORF amplification
ggatccagctagcaaaatgacctcaacactagccactaga

SEQ ID NO: 9557 - DNA, 40 bp, Artificial Sequence
  PCR primer for ORF amplification
ggatccagctagcaaaatgcaagcccaaggttcacaatcg

SEQ ID NO: 9558 - DNA, 40 bp, Artificial Sequence
  PCR primer for ORF amplification
ggatccagctagcaaaatgtttggctctgggaatgttctg

SEQ ID NO: 9559 - DNA, 40 bp, Artificial Sequence
  PCR primer for ORF amplification
ggatccagctagcaaaatgaatgtattagtctataatggc

SEQ ID NO: 9560 - DNA, 40 bp, Artificial Sequence
  PCR primer for ORF amplification
ggatccagctagcaaaatgctgcttcttccaagatgtcct

SEQ ID NO: 9561 - DNA, 40 bp, Artificial Sequence
  PCR primer for ORF amplification
ggatccagctagcaaaatggaaggcttcaatccggctgac

SEQ ID NO: 9562 - DNA, 40 bp, Artificial Sequence
  PCR primer for ORF amplification
ggatccagctagcaaaatgaatagattttggaatactaag

SEQ ID NO: 9563 - DNA, 40 bp, Artificial Sequence
  PCR primer for ORF amplification
ggatccagctagcaaaatgacaaggttcatgaacagcttt

SEQ ID NO: 9564 - DNA, 40 bp, Artificial Sequence
  PCR primer for ORF amplification
ggatccagctagcaaaatgagccagatcgttgattttgtt

SEQ ID NO: 9565 - DNA, 40 bp, Artificial Sequence
  PCR primer for ORF amplification
ggatccagctagcaaaatgcaaagctcaacaagtactgat

SEQ ID NO: 9566 - DNA, 40 bp, Artificial Sequence
  PCR primer for ORF amplification
ggatccagctagcaaaatgccgtttggaatagacaacacc

SEQ ID NO: 9567 - DNA, 40 bp, Artificial Sequence
  PCR primer for ORF amplification
ggatccagctagcaaaatgaatggaaaagaggtttcaagt

SEQ ID NO: 9568 - DNA, 40 bp, Artificial Sequence
  PCR primer for ORF amplification
ggatccagctagcaaaatgctttcccataatgctttaagg

SEQ ID NO: 9569 - DNA, 40 bp, Artificial Sequence
  PCR primer for ORF amplification
ggatccagctagcaaaatggactatcctgatccagacaca

SEQ ID NO: 9570 - DNA, 40 bp, Artificial Sequence
  PCR primer for ORF amplification
ggatccagctagcaaaatggccaagagactgttagaatca

SEQ ID NO: 9571 - DNA, 40 bp, Artificial Sequence
  PCR primer for ORF amplification
ggatccagctagcaaaatggggaagagagtatacgatcca

SEQ ID NO: 9572 - DNA, 40 bp, Artificial Sequence
  PCR primer for ORF amplification
ggatccagctagcaaaatgggtaattcaagttcaaaatct

SEQ ID NO: 9573 - DNA, 40 bp, Artificial Sequence
  PCR primer for ORF amplification
ggatccagctagcaaaatgagcactccatttggcttagat

SEQ ID NO: 9574 - DNA, 40 bp, Artificial Sequence
  PCR primer for ORF amplification
ggatccagctagcaaaatgagtactccatttggtttagat

SEQ ID NO: 9575 - DNA, 40 bp, Artificial Sequence
  PCR primer for ORF amplification
ggatccagctagcaaaatgctacgatcaaccacatttact

SEQ ID NO: 9576 - DNA, 40 bp, Artificial Sequence
  PCR primer for ORF amplification
ggatccagctagcaaaatgtggggggatagtatgcgcgag

SEQ ID NO: 9577 - DNA, 40 bp, Artificial Sequence
  PCR primer for ORF amplification
ggatccagctagcaaaatgaccgaacaatattccgttgca

SEQ ID NO: 9578 - DNA, 40 bp, Artificial Sequence
  PCR primer for ORF amplification
ggatccagctagcaaaatgactcatacaaatgagcacgac

SEQ ID NO: 9579 - DNA, 40 bp, Artificial Sequence
  PCR primer for ORF amplification
ggatccagctagcaaaatgcttttcgctagattagtgctg

SEQ ID NO: 9580 - DNA, 40 bp, Artificial Sequence
  PCR primer for ORF amplification
ggatccagctagcaaaatggtcttgataaatggcataaag

SEQ ID NO: 9581 - DNA, 40 bp, Artificial Sequence
  PCR primer for ORF amplification
ggatccagctagcaaaatgtccgaacaacactctgtcgca

SEQ ID NO: 9582 - DNA, 40 bp, Artificial Sequence
  PCR primer for ORF amplification
ggatccagctagcaaaatgaagaatctgaccactataaag

SEQ ID NO: 9583 - DNA, 40 bp, Artificial Sequence
  PCR primer for ORF amplification
ggatccagctagcaaaatgactatacatcagttatctcca

SEQ ID NO: 9584 - DNA, 40 bp, Artificial Sequence
  PCR primer for ORF amplification
ggatccagctagcaaaatgattgtaagaatgatacgtctt

SEQ ID NO: 9585 - DNA, 40 bp, Artificial Sequence
  PCR primer for ORF amplification
ggatccagctagcaaaatggctggaattttgtcaaagact

SEQ ID NO: 9586 - DNA, 40 bp, Artificial Sequence
  PCR primer for ORF amplification
ggatccagctagcaaaatggcaagttcaccgcaggtacat

SEQ ID NO: 9587 - DNA, 40 bp, Artificial Sequence
  PCR primer for ORF amplification
ggatccagctagcaaaatggtaggctcgaaggatattgat

SEQ ID NO: 9588 - DNA, 40 bp, Artificial Sequence
  PCR primer for ORF amplification
ggatccagctagcaaaatgtcttccaagcattcagatcca

SEQ ID NO: 9589 - DNA, 40 bp, Artificial Sequence
  PCR primer for ORF amplification
ggatccagctagcaaaatggactgggcaatcaaagcagct

SEQ ID NO: 9590 - DNA, 40 bp, Artificial Sequence
  PCR primer for ORF amplification
ggatccagctagcaaaatggtggataaaaataggacgttg

SEQ ID NO: 9591 - DNA, 40 bp, Artificial Sequence
  PCR primer for ORF amplification
ggatccagctagcaaaatggttttttcttatgagcactat

SEQ ID NO: 9592 - DNA, 40 bp, Artificial Sequence
  PCR primer for ORF amplification
ggatccagctagcaaaatgtatcgtacaagaagctctgac

SEQ ID NO: 9593 - DNA, 40 bp, Artificial Sequence
  PCR primer for ORF amplification
ggatccagctagcaaaatgacagctcagttacaaagtgaa

SEQ ID NO: 9594 - DNA, 40 bp, Artificial Sequence
  PCR primer for ORF amplification
ggatccagctagcaaaatggataatgaagaagttaacgaa

SEQ ID NO: 9595 - DNA, 40 bp, Artificial Sequence
  PCR primer for ORF amplification
ggatccagctagcaaaatggtcagattttttggtttaaac

SEQ ID NO: 9596 - DNA, 40 bp, Artificial Sequence
  PCR primer for ORF amplification
ggatccagctagcaaaatgtcgttgtctagaatcctgcga

SEQ ID NO: 9597 - DNA, 40 bp, Artificial Sequence; identical to SEQ ID NO: 5422
  PCR primer for ORF amplification

SEQ ID NO: 9598 - DNA, 40 bp, Artificial Sequence
  PCR primer for ORF amplification
ggatccagctagcaaaatgacggccgagcctgctactaag

SEQ ID NO: 9599 - DNA, 40 bp, Artificial Sequence
  PCR primer for ORF amplification
ggatccagctagcaaaatggttgctcaatataccgttcca

SEQ ID NO: 9600 - DNA, 40 bp, Artificial Sequence
  PCR primer for ORF amplification
ggatccagctagcaaaatgtccgatcaaaaagtttttgcc

SEQ ID NO: 9601 - DNA, 40 bp, Artificial Sequence
  PCR primer for ORF amplification
ggatccagctagcaaaatgaaaatgaatctgaaaaggctc

SEQ ID NO: 9602 - DNA, 40 bp, Artificial Sequence
  PCR primer for ORF amplification
ggatccagctagcaaaatgaacggtattgatgatctccta

SEQ ID NO: 9603 - DNA, 40 bp, Artificial Sequence
  PCR primer for ORF amplification
ggatccagctagcaaaatgcatgctacaaactggttcgac

SEQ ID NO: 9604 - DNA, 40 bp, Artificial Sequence
  PCR primer for ORF amplification
ggatccagctagcaaaatggatggatcccattttcctatg

SEQ ID NO: 9605 - DNA, 40 bp, Artificial Sequence
  PCR primer for ORF amplification
ggatccagctagcaaaatgcctagacatggaagaagagga

SEQ ID NO: 9606 - DNA, 40 bp, Artificial Sequence
  PCR primer for ORF amplification
ggatccagctagcaaaatgggtatccaaggtcttcttcct

SEQ ID NO: 9607 - DNA, 40 bp, Artificial Sequence
  PCR primer for ORF amplification
ggatccagctagcaaaatggtgagcatgttctcattattt

SEQ ID NO: 9608 - DNA, 40 bp, Artificial Sequence
  PCR primer for ORF amplification
ggatccagctagcaaaatgcttcccattaaagtcttctct

SEQ ID NO: 9609 - DNA, 40 bp, Artificial Sequence
  PCR primer for ORF amplification
ggatccagctagcaaaatgacggtcgaccatgatttcaat

SEQ ID NO: 9610 - DNA, 40 bp, Artificial Sequence
  PCR primer for ORF amplification
ggatccagctagcaaaatgagactacactatattacggtt

SEQ ID NO: 9611 - DNA, 40 bp, Artificial Sequence
  PCR primer for ORF amplification
ggatccagctagcaaaatgattattgaacgttgggaagta

SEQ ID NO: 9612 - DNA, 40 bp, Artificial Sequence
  PCR primer for ORF amplification
ggatccagctagcaaaatggatgagcatttaatttctact

SEQ ID NO: 9613 - DNA, 40 bp, Artificial Sequence
  PCR primer for ORF amplification
ggatccagctagcaaaatggtttctccaacgaaaatgata

SEQ ID NO: 9614 - DNA, 40 bp, Artificial Sequence
  PCR primer for ORF amplification
ggatccagctagcaaaatgtacaacattccagataatgtc

SEQ ID NO: 9615 - DNA, 40 bp, Artificial Sequence
  PCR primer for ORF amplification
ggatccagctagcaaaatgaagaatacggaacttagtcaa

SEQ ID NO: 9616 - DNA, 40 bp, Artificial Sequence
  PCR primer for ORF amplification
ggatccagctagcaaaatgacaacaaactcacgtccatcc

SEQ ID NO: 9617 - DNA, 40 bp, Artificial Sequence
  PCR primer for ORF amplification
ggatccagctagcaaaatgagcggatctatcgatgtcatc

SEQ ID NO: 9618 - DNA, 40 bp, Artificial Sequence
  PCR primer for ORF amplification
ggatccagctagcaaaatggctggtgaaacttttgaattt

SEQ ID NO: 9619 - DNA, 40 bp, Artificial Sequence
  PCR primer for ORF amplification
ggatccagctagcaaaatgtcccgtgacctacaaaaccat

SEQ ID NO: 9620 - DNA, 40 bp, Artificial Sequence
  PCR primer for ORF amplification
ggatccagctagcaaaatgtcgttgggtcctcttaaagct

SEQ ID NO: 9621 - DNA, 40 bp, Artificial Sequence
  PCR primer for ORF amplification
ggatccagctagcaaaatgagagtaagaccaaagaggtcg

SEQ ID NO: 9622 - DNA, 40 bp, Artificial Sequence
  PCR primer for ORF amplification
ggatccagctagcaaaatgattcaaaaaatgagcccaagc

SEQ ID NO: 9623 - DNA, 40 bp, Artificial Sequence
  PCR primer for ORF amplification
ggatccagctagcaaaatgcaattacggaacatattacag

SEQ ID NO: 9624 - DNA, 40 bp, Artificial Sequence
  PCR primer for ORF amplification
ggatccagctagcaaaatggacaagctaactccatctcaa

SEQ ID NO: 9625 - DNA, 40 bp, Artificial Sequence
  PCR primer for ORF amplification
ggatccagctagcaaaatggattctgtaatggttaagaaa

SEQ ID NO: 9626 - DNA, 40 bp, Artificial Sequence
  PCR primer for ORF amplification
ggatccagctagcaaaatgtataactcaatctacgggtcc

SEQ ID NO: 9627 - DNA, 40 bp, Artificial Sequence
  PCR primer for ORF amplification
ggatccagctagcaaaatgtcgtttttgccactaaggtct

SEQ ID NO: 9628 - DNA, 40 bp, Artificial Sequence
  PCR primer for ORF amplification
ggatccagctagcaaaatgagtaaaaaattatcgttggaa

SEQ ID NO: 9629 - DNA, 40 bp, Artificial Sequence
  PCR primer for ORF amplification
ggatccagctagcaaaatggttttgaaatctacttccgca

SEQ ID NO: 9630 - DNA, 40 bp, Artificial Sequence
  PCR primer for ORF amplification
ggatccagctagcaaaatgtcagaacaactcagacaaaca

SEQ ID NO: 9631 - DNA, 40 bp, Artificial Sequence
  PCR primer for ORF amplification
ggatccagctagcaaaatgtcatttttaaagttcgcttat

SEQ ID NO: 9632 - DNA, 40 bp, Artificial Sequence
  PCR primer for ORF amplification
ggatccagctagcaaaatgccatctaccttgactattaat

SEQ ID NO: 9633 - DNA, 40 bp, Artificial Sequence
  PCR primer for ORF amplification
ggatccagctagcaaaatggaggattcggactccaacaca

SEQ ID NO: 9634 - DNA, 40 bp, Artificial Sequence
  PCR primer for ORF amplification
ggatccagctagcaaaatggctactggcaggattcaattt

SEQ ID NO: 9635 - DNA, 40 bp, Artificial Sequence
  PCR primer for ORF amplification
ggatccagctagcaaaatggctcgtgacttacaaaatcat

SEQ ID NO: 9636 - DNA, 40 bp, Artificial Sequence
  PCR primer for ORF amplification
ggatccagctagcaaaatgagtaataaggaagagcatgtt

SEQ ID NO: 9637 - DNA, 40 bp, Artificial Sequence
  PCR primer for ORF amplification
ggatccagctagcaaaatggatacatcaaactcttggttt

SEQ ID NO: 9638 - DNA, 40 bp, Artificial Sequence
  PCR primer for ORF amplification
ggatccagctagcaaaatggctagtgaaacttttgaattt

SEQ ID NO: 9639 - DNA, 40 bp, Artificial Sequence
  PCR primer for ORF amplification
ggatccagctagcaaaatgttggaagagcaactatatttg

SEQ ID NO: 9640 - DNA, 40 bp, Artificial Sequence
  PCR primer for ORF amplification
ggatccagctagcaaaatgtttccctctctcttccgactt

SEQ ID NO: 9641 - DNA, 40 bp, Artificial Sequence
  PCR primer for ORF amplification
ggatccagctagcaaaatgggtaaagtttctaaatcgacc

SEQ ID NO: 9642 - DNA, 40 bp, Artificial Sequence
  PCR primer for ORF amplification
ggatccagctagcaaaatgggtaattccggttcgaaacaa

SEQ ID NO: 9643 - DNA, 40 bp, Artificial Sequence
  PCR primer for ORF amplification
ggatccagctagcaaaatgagccactttttcgccgatcat

SEQ ID NO: 9644 - DNA, 40 bp, Artificial Sequence
  PCR primer for ORF amplification
ggatccagctagcaaaatgcattggacgtccatcttgagc

SEQ ID NO: 9645 - DNA, 40 bp, Artificial Sequence
  PCR primer for ORF amplification
ggatccagctagcaaaatgtattgggtcctcctttgtggt

SEQ ID NO: 9646 - DNA, 40 bp, Artificial Sequence
  PCR primer for ORF amplification
ggatccagctagcaaaatgcatagaacgcttctgttttta

SEQ ID NO: 9647 - DNA, 40 bp, Artificial Sequence
  PCR primer for ORF amplification
ggatccagctagcaaaatgcgattgttgctgtgcaagaat

SEQ ID NO: 9648 - DNA, 40 bp, Artificial Sequence
  PCR primer for ORF amplification
ggatccagctagcaaaatgctcaattctgcgttactgtgg

SEQ ID NO: 9649 - DNA, 40 bp, Artificial Sequence
  PCR primer for ORF amplification
ggatccagctagcaaaatggctggaaaaaagggacaaaag

SEQ ID NO: 9650 - DNA, 40 bp, Artificial Sequence
  PCR primer for ORF amplification
ggatccagctagcaaaatgaaaaccgaaatcagcactgcg

SEQ ID NO: 9651 - DNA, 40 bp, Artificial Sequence
  PCR primer for ORF amplification
ggatccagctagcaaaatgactgccagcgtttcgaatacg

SEQ ID NO: 9652 - DNA, 40 bp, Artificial Sequence
  PCR primer for ORF amplification
ggatccagctagcaaaatgccatccctgtctcaaccattt

SEQ ID NO: 9653 - DNA, 40 bp, Artificial Sequence
  PCR primer for ORF amplification
ggatccagctagcaaaatggtcactaacaatggagatggt

SEQ ID NO: 9654 - DNA, 40 bp, Artificial Sequence
  PCR primer for ORF amplification
ggatccagctagcaaaatgtcccaatctagtaggttaagt

SEQ ID NO: 9655 - DNA, 40 bp, Artificial Sequence
  PCR primer for ORF amplification
ggatccagctagcaaaatgtcgccctctgccgtacaatca

SEQ ID NO: 9656 - DNA, 40 bp, Artificial Sequence
  PCR primer for ORF amplification
ggatccagctagcaaaatgggtatgtgcctcggtttttct

SEQ ID NO: 9657 - DNA, 40 bp, Artificial Sequence
  PCR primer for ORF amplification
ggatccagctagcaaaatgacagaaattattgatttagac

SEQ ID NO: 9658 - DNA, 40 bp, Artificial Sequence
  PCR primer for ORF amplification
ggatccagctagcaaaatgctatcattttgcgactatttt

SEQ ID NO: 9659 - DNA, 40 bp, Artificial Sequence
  PCR primer for ORF amplification
ggatccagctagcaaaatgtcacatcttatcactttagct

SEQ ID NO: 9660 - DNA, 40 bp, Artificial Sequence
  PCR primer for ORF amplification
ggatccagctagcaaaatgtcagtgaacgaccaaataact

SEQ ID NO: 9661 - DNA, 40 bp, Artificial Sequence
  PCR primer for ORF amplification
ggatccagctagcaaaatgaaaagcaggaaacgccaaaac

SEQ ID NO: 9662 - DNA, 40 bp, Artificial Sequence
  PCR primer for ORF amplification
ggatccagctagcaaaatgagccagcatattaggaaatta

SEQ ID NO: 9663 - DNA, 40 bp, Artificial Sequence
  PCR primer for ORF amplification
ggatccagctagcaaaatgctacggtttactcatcgaggc

SEQ ID NO: 9664 - DNA, 40 bp, Artificial Sequence
  PCR primer for ORF amplification
ggatccagctagcaaaatgggatatcaattgagtgcaaca

SEQ ID NO: 9665 - DNA, 40 bp, Artificial Sequence
  PCR primer for ORF amplification
ggatccagctagcaaaatggaacagacacaaacagcagag

SEQ ID NO: 9666 - DNA, 40 bp, Artificial Sequence
  PCR primer for ORF amplification
ggatccagctagcaaaatgtgtggtatctttggttactgc

SEQ ID NO: 9667 - DNA, 40 bp, Artificial Sequence
  PCR primer for ORF amplification
ggatccagctagcaaaatgttattaaacccagatcaaatt

SEQ ID NO: 9668 - DNA, 40 bp, Artificial Sequence
  PCR primer for ORF amplification
ggatccagctagcaaaatgggatccgaccggtcgtgtgtt

SEQ ID NO: 9669 - DNA, 40 bp, Artificial Sequence
  PCR primer for ORF amplification
ggatccagctagcaaaatgcactatgtggtactagagctg

SEQ ID NO: 9670 - DNA, 40 bp, Artificial Sequence
  PCR primer for ORF amplification
ggatccagctagcaaaatgtctggaatgggtattgcgatt

SEQ ID NO: 9671 - DNA, 40 bp, Artificial Sequence
  PCR primer for ORF amplification
ggatccagctagcaaaatgttgttggtacatattatatct

SEQ ID NO: 9672 - DNA, 40 bp, Artificial Sequence
  PCR primer for ORF amplification
ggatccagctagcaaaatgaattcgaatgaagatatacat

SEQ ID NO: 9673 - DNA, 40 bp, Artificial Sequence
  PCR primer for ORF amplification
ggatccagctagcaaaatgactcagcaagaataccgttcc

SEQ ID NO: 9674 - DNA, 40 bp, Artificial Sequence
  PCR primer for ORF amplification
ggatccagctagcaaaatgcctttgagaaatctaactgaa

SEQ ID NO: 9675 - DNA, 40 bp, Artificial Sequence
  PCR primer for ORF amplification
ggatccagctagcaaaatggccaaaagagttgccgatgcg

SEQ ID NO: 9676 - DNA, 40 bp, Artificial Sequence
  PCR primer for ORF amplification
ggatccagctagcaaaatgaagtttggtgagcacttgagc

SEQ ID NO: 9677 - DNA, 40 bp, Artificial Sequence
  PCR primer for ORF amplification
ggatccagctagcaaaatgagtgacagttctgtgagggaa

SEQ ID NO: 9678 - DNA, 40 bp, Artificial Sequence
  PCR primer for ORF amplification
ggatccagctagcaaaatgaagggaaactttaggaaaaga

SEQ ID NO: 9679 - DNA, 40 bp, Artificial Sequence
  PCR primer for ORF amplification
ggatccagctagcaaaatgagctctagagcattaaggaga

SEQ ID NO: 9680 - DNA, 40 bp, Artificial Sequence
  PCR primer for ORF amplification
ggatccagctagcaaaatgttcaggtcgcatgcctccggt

SEQ ID NO: 9681 - DNA, 40 bp, Artificial Sequence
  PCR primer for ORF amplification
ggatccagctagcaaaatgaatctgcaagaactattagcg

SEQ ID NO: 9682 - DNA, 40 bp, Artificial Sequence
  PCR primer for ORF amplification
ggatccagctagcaaaatggtaatgcaggaggagaagaag

SEQ ID NO: 9683 - DNA, 40 bp, Artificial Sequence
  PCR primer for ORF amplification
ggatccagctagcaaaatgtctgatttaattgaattacag

SEQ ID NO: 9684 - DNA, 40 bp, Artificial Sequence
  PCR primer for ORF amplification
ggatccagctagcaaaatgttgtctcaaacctccataccg

SEQ ID NO: 9685 - DNA, 40 bp, Artificial Sequence
  PCR primer for ORF amplification
ggatccagctagcaaaatgacattatctttcgctcatttt

SEQ ID NO: 9686 - DNA, 40 bp, Artificial Sequence
  PCR primer for ORF amplification
ggatccagctagcaaaatgcctcaatctactccaagtcaa

SEQ ID NO: 9687 - DNA, 40 bp, Artificial Sequence
  PCR primer for ORF amplification
ggatccagctagcaaaatggactgggcaatcaatgtcgcc

SEQ ID NO: 9688 - DNA, 40 bp, Artificial Sequence
  PCR primer for ORF amplification
ggatccagctagcaaaatgtttaaagtgtttggttttggt

SEQ ID NO: 9689 - DNA, 40 bp, Artificial Sequence
  PCR primer for ORF amplification
ggatccagctagcaaaatgccaccattggataaaagaatc

SEQ ID NO: 9690 - DNA, 40 bp, Artificial Sequence
  PCR primer for ORF amplification
ggatccagctagcaaaatggaattatcccctacttatcaa

SEQ ID NO: 9691 - DNA, 40 bp, Artificial Sequence
  PCR primer for ORF amplification
ggatccagctagcaaaatggcaagtgtcatgtcaaataat

SEQ ID NO: 9692 - DNA, 40 bp, Artificial Sequence
  PCR primer for ORF amplification
ggatccagctagcaaaatgaatgattggcatgagttcaat

SEQ ID NO: 9693 - DNA, 40 bp, Artificial Sequence
  PCR primer for ORF amplification
ggatccagctagcaaaatggaggaaattcctgccctgtat

SEQ ID NO: 9694 - DNA, 40 bp, Artificial Sequence
  PCR primer for ORF amplification
ggatccagctagcaaaatggtatttggttttacaaagagg

SEQ ID NO: 9695 - DNA, 40 bp, Artificial Sequence
  PCR primer for ORF amplification
ggatccagctagcaaaatggaatcacttccacgtactccc

SEQ ID NO: 9696 - DNA, 40 bp, Artificial Sequence
  PCR primer for ORF amplification
ggatccagctagcaaaatgttttacaataggtggctcgga

SEQ ID NO: 9697 - DNA, 40 bp, Artificial Sequence
  PCR primer for ORF amplification
ggatccagctagcaaaatgaccattgatggcacggggcaa

SEQ ID NO: 9698 - DNA, 40 bp, Artificial Sequence
  PCR primer for ORF amplification
ggatccagctagcaaaatgatttctgtttgcccacaaaat

SEQ ID NO: 9699 - DNA, 40 bp, Artificial Sequence
  PCR primer for ORF amplification
ggatccagctagcaaaatgcaagacgaccccgaaaattcg

SEQ ID NO: 9700 - DNA, 40 bp, Artificial Sequence
  PCR primer for ORF amplification
ggatccagctagcaaaatgacagaattttattctgacaca

SEQ ID NO: 9701 - DNA, 40 bp, Artificial Sequence
  PCR primer for ORF amplification
ggatccagctagcaaaatgatccgtttagctcagcaaaca

SEQ ID NO: 9702 - DNA, 40 bp, Artificial Sequence
  PCR primer for ORF amplification
ggatccagctagcaaaatggacaaattagtcgtgaattat

SEQ ID NO: 9703 - DNA, 40 bp, Artificial Sequence
  PCR primer for ORF amplification
ggatccagctagcaaaatgtttagagtatttggttcattt

SEQ ID NO: 9704 - DNA, 40 bp, Artificial Sequence
  PCR primer for ORF amplification
ggatccagctagcaaaatgaccacacaaataaggtctccc

SEQ ID NO: 9705 - DNA, 40 bp, Artificial Sequence
  PCR primer for ORF amplification
ggatccagctagcaaaatgtcttccccagggaattcaggc

SEQ ID NO: 9706 - DNA, 40 bp, Artificial Sequence
  PCR primer for ORF amplification
ggatccagctagcaaaatgacttctgaaaatccggatgta

SEQ ID NO: 9707 - DNA, 40 bp, Artificial Sequence
  PCR primer for ORF amplification
ggatccagctagcaaaatgagtcttatactagatgatatc

SEQ ID NO: 9708 - DNA, 40 bp, Artificial Sequence
  PCR primer for ORF amplification
ggatccagctagcaaaatggaagtagacagtatattaggt

SEQ ID NO: 9709 - DNA, 40 bp, Artificial Sequence
  PCR primer for ORF amplification
ggatccagctagcaaaatgggcttcagtagcggtaaatca

SEQ ID NO: 9710 - DNA, 40 bp, Artificial Sequence
  PCR primer for ORF amplification
ggatccagctagcaaaatgtcgaagaaccaaagtgtgagt

SEQ ID NO: 9711 - DNA, 40 bp, Artificial Sequence
  PCR primer for ORF amplification
ggatccagctagcaaaatgagtgctagtgaagcaggtgtc

SEQ ID NO: 9712 - DNA, 40 bp, Artificial Sequence
  PCR primer for ORF amplification
ggatccagctagcaaaatgtaccacacccatatgcatgaa

SEQ ID NO: 9713 - DNA, 40 bp, Artificial Sequence
  PCR primer for ORF amplification
ggatccagctagcaaaatggcagcaaatagcaatagtaga

SEQ ID NO: 9714 - DNA, 40 bp, Artificial Sequence
  PCR primer for ORF amplification
ggatccagctagcaaaatgggagaatttaaacctccgcta

SEQ ID NO: 9715 - DNA, 40 bp, Artificial Sequence
  PCR primer for ORF amplification
ggatccagctagcaaaatgtccagacgcaatccaccaggc

SEQ ID NO: 9716 - DNA, 40 bp, Artificial Sequence
  PCR primer for ORF amplification
ggatccagctagcaaaatgaatcaaaatttaaaaaacact

SEQ ID NO: 9717 - DNA, 40 bp, Artificial Sequence
  PCR primer for ORF amplification
ggatccagctagcaaaatggattcacatcaactagaacta

SEQ ID NO: 9718 - DNA, 40 bp, Artificial Sequence
  PCR primer for ORF amplification
ggatccagctagcaaaatggcacttgtcaaatacagcaca

SEQ ID NO: 9719 - DNA, 40 bp, Artificial Sequence
  PCR primer for ORF amplification
ggatccagctagcaaaatgtcacagaatattcaaattggc

SEQ ID NO: 9720 - DNA, 40 bp, Artificial Sequence
  PCR primer for ORF amplification
ggatccagctagcaaaatggttgccgaagaggacatcgag

SEQ ID NO: 9721 - DNA, 40 bp, Artificial Sequence
  PCR primer for ORF amplification
ggatccagctagcaaaatgtctacacaatttaggaagtct

SEQ ID NO: 9722 - DNA, 40 bp, Artificial Sequence
  PCR primer for ORF amplification
ggatccagctagcaaaatgatagcaccagactcgcaaaga

SEQ ID NO: 9723 - DNA, 40 bp, Artificial Sequence
  PCR primer for ORF amplification
ggatccagctagcaaaatgtcctccagcatctttgaaatg

SEQ ID NO: 9724 - DNA, 40 bp, Artificial Sequence
  PCR primer for ORF amplification
ggatccagctagcaaaatggttgataccgcaccatacatt

SEQ ID NO: 9725 - DNA, 40 bp, Artificial Sequence
  PCR primer for ORF amplification
ggatccagctagcaaaatgagcgatgaagattctatgctg

SEQ ID NO: 9726 - DNA, 40 bp, Artificial Sequence
  PCR primer for ORF amplification
ggatccagctagcaaaatggaacttcagaatgatttagag

SEQ ID NO: 9727 - DNA, 40 bp, Artificial Sequence
  PCR primer for ORF amplification
ggatccagctagcaaaatgggttcatcaattaactatcct

SEQ ID NO: 9728 - DNA, 40 bp, Artificial Sequence
  PCR primer for ORF amplification
ggatccagctagcaaaatgaataaagagcatttgctgaag

SEQ ID NO: 9729 - DNA, 40 bp, Artificial Sequence
  PCR primer for ORF amplification
ggatccagctagcaaaatggatggtcccaattttgcacat

SEQ ID NO: 9730 - DNA, 40 bp, Artificial Sequence
  PCR primer for ORF amplification
ggatccagctagcaaaatgtctgctcccgctgccgatcat

SEQ ID NO: 9731 - DNA, 40 bp, Artificial Sequence
  PCR primer for ORF amplification
ggatccagctagcaaaatgacaatcgatgattcaaatcga

SEQ ID NO: 9732 - DNA, 40 bp, Artificial Sequence
  PCR primer for ORF amplification
ggatccagctagcaaaatgataactaataagaaaataaag

SEQ ID NO: 9733 - DNA, 40 bp, Artificial Sequence
  PCR primer for ORF amplification
ggatccagctagcaaaatggccgctccagattatgcactt

SEQ ID NO: 9734 - DNA, 40 bp, Artificial Sequence
  PCR primer for ORF amplification
ggatccagctagcaaaatggaattatttaacaaggaagaa

SEQ ID NO: 9735 - DNA, 40 bp, Artificial Sequence
  PCR primer for ORF amplification
ggatccagctagcaaaatgtcacacactaataagatcgca

SEQ ID NO: 9736 - DNA, 40 bp, Artificial Sequence
  PCR primer for ORF amplification
ggatccagctagcaaaatgaatttgttttggccatcggaa

SEQ ID NO: 9737 - DNA, 40 bp, Artificial Sequence
  PCR primer for ORF amplification
ggatccagctagcaaaatgagtaagatactattctgcaaa

SEQ ID NO: 9738 - DNA, 40 bp, Artificial Sequence
  PCR primer for ORF amplification
ggatccagctagcaaaatgattacgcagaattctatacca

SEQ ID NO: 9739 - DNA, 40 bp, Artificial Sequence
  PCR primer for ORF amplification
ggatccagctagcaaaatgaacgtttcaaaaatacttgtg

SEQ ID NO: 9740 - DNA, 40 bp, Artificial Sequence
  PCR primer for ORF amplification
ggatccagctagcaaaatgagacgagaaacggtgggtgaa

SEQ ID NO: 9741 - DNA, 40 bp, Artificial Sequence
  PCR primer for ORF amplification
ggatccagctagcaaaatgatcagaagatggctaactata

SEQ ID NO: 9742 - DNA, 40 bp, Artificial Sequence
  PCR primer for ORF amplification
ggatccagctagcaaaatgtcgttattagagcaattagca

SEQ ID NO: 9743 - DNA, 40 bp, Artificial Sequence
  PCR primer for ORF amplification
ggatccagctagcaaaatgaataggggatcattagatgat

SEQ ID NO: 9744 - DNA, 40 bp, Artificial Sequence
  PCR primer for ORF amplification
ggatccagctagcaaaatgacgagacgtactactattaat

SEQ ID NO: 9745 - DNA, 40 bp, Artificial Sequence
  PCR primer for ORF amplification
ggatccagctagcaaaatggaacttcagagggcacaacgg

SEQ ID NO: 9746 - DNA, 40 bp, Artificial Sequence
  PCR primer for ORF amplification
ggatccagctagcaaaatgaccagtatgtcaattattgat

SEQ ID NO: 9747 - DNA, 40 bp, Artificial Sequence
  PCR primer for ORF amplification
ggatccagctagcaaaatgacttcgaaaccatccaccagt

SEQ ID NO: 9748 - DNA, 40 bp, Artificial Sequence
  PCR primer for ORF amplification
ggatccagctagcaaaatggatgtgagagcggcattgcaa

SEQ ID NO: 9749 - DNA, 40 bp, Artificial Sequence
  PCR primer for ORF amplification
ggatccagctagcaaaatgtctaataccttgccagtaaca

SEQ ID NO: 9750 - DNA, 40 bp, Artificial Sequence
  PCR primer for ORF amplification
ggatccagctagcaaaatgaggatcgaaaagcaccgtacc

SEQ ID NO: 9751 - DNA, 40 bp, Artificial Sequence
  PCR primer for ORF amplification
ggatccagctagcaaaatgagtataattagttcttggtta

SEQ ID NO: 9752 - DNA, 40 bp, Artificial Sequence
  PCR primer for ORF amplification
ggatccagctagcaaaatggatcgcatagcacagcaatat

SEQ ID NO: 9753 - DNA, 40 bp, Artificial Sequence
  PCR primer for ORF amplification
ggatccagctagcaaaatgagtcaagttaatacaagccaa

SEQ ID NO: 9754 - DNA, 40 bp, Artificial Sequence
  PCR primer for ORF amplification
ggatccagctagcaaaatgtcagtacctaattccaaagag

SEQ ID NO: 9755 - DNA, 40 bp, Artificial Sequence
  PCR primer for ORF amplification
ggatccagctagcaaaatgtctttcctcatttcctttgat

SEQ ID NO: 9756 - DNA, 40 bp, Artificial Sequence
  PCR primer for ORF amplification
ggatccagctagcaaaatggcaagcatcggttcgcaagtg

SEQ ID NO: 9757 - DNA, 40 bp, Artificial Sequence
  PCR primer for ORF amplification
ggatccagctagcaaaatggtggtaggaactaaaaaatac

SEQ ID NO: 9758 - DNA, 40 bp, Artificial Sequence
  PCR primer for ORF amplification
ggatccagctagcaaaatgtctaataccgaggaattgatc

SEQ ID NO: 9759 - DNA, 40 bp, Artificial Sequence
  PCR primer for ORF amplification
ggatccagctagcaaaatgccgtacagagtggcgacgggc

SEQ ID NO: 9760 - DNA, 40 bp, Artificial Sequence
  PCR primer for ORF amplification
ggatccagctagcaaaatgcgggttttaataactaacgat

SEQ ID NO: 9761 - DNA, 40 bp, Artificial Sequence
  PCR primer for ORF amplification
ggatccagctagcaaaatggaagaaaaccaattaacgtgc

SEQ ID NO: 9762 - DNA, 40 bp, Artificial Sequence
  PCR primer for ORF amplification
ggatccagctagcaaaatggttgagttttctttgaagaag

SEQ ID NO: 9763 - DNA, 40 bp, Artificial Sequence
  PCR primer for ORF amplification
ggatccagctagcaaaatgaatgaagacctgcccaaggaa

SEQ ID NO: 9764 - DNA, 40 bp, Artificial Sequence
  PCR primer for ORF amplification
ggatccagctagcaaaatgacatcaaataattcgttattg

SEQ ID NO: 9765 - DNA, 40 bp, Artificial Sequence
  PCR primer for ORF amplification
ggatccagctagcaaaatgactacacaactaaggtatgaa

SEQ ID NO: 9766 - DNA, 40 bp, Artificial Sequence
  PCR primer for ORF amplification
ggatccagctagcaaaatgataaaaagatggttatctgtg

SEQ ID NO: 9767 - DNA, 40 bp, Artificial Sequence
  PCR primer for ORF amplification
ggatccagctagcaaaatggagtctctttttcctaacaaa

SEQ ID NO: 9768 - DNA, 40 bp, Artificial Sequence
  PCR primer for ORF amplification
ggatccagctagcaaaatggcacatgaaaagtttagtata

SEQ ID NO: 9769 - DNA, 40 bp, Artificial Sequence
  PCR primer for ORF amplification
ggatccagctagcaaaatgcgcagattactgaccggttgc

SEQ ID NO: 9770 - DNA, 40 bp, Artificial Sequence
  PCR primer for ORF amplification
ggatccagctagcaaaatgtctagcagagacgcctctttg

SEQ ID NO: 9771 - DNA, 40 bp, Artificial Sequence
  PCR primer for ORF amplification
ggatccagctagcaaaatgtataatagcagcaccaatcat

SEQ ID NO: 9772 - DNA, 40 bp, Artificial Sequence
  PCR primer for ORF amplification
ggatccagctagcaaaatgatgcgtggtttcaagcaaaga

SEQ ID NO: 9773 - DNA, 40 bp, Artificial Sequence
  PCR primer for ORF amplification
ggatccagctagcaaaatggctagtttagaagatcttatt

SEQ ID NO: 9774 - DNA, 40 bp, Artificial Sequence
  PCR primer for ORF amplification
ggatccagctagcaaaatgacgccgaaagaatctggaaag

SEQ ID NO: 9775 - DNA, 40 bp, Artificial Sequence
  PCR primer for ORF amplification
ggatccagctagcaaaatgatcatcagagctccaataagg

SEQ ID NO: 9776 - DNA, 40 bp, Artificial Sequence
  PCR primer for ORF amplification
ggatccagctagcaaaatggaaatcgatggcaacactctg

SEQ ID NO: 9777 - DNA, 40 bp, Artificial Sequence
  PCR primer for ORF amplification
ggatccagctagcaaaatggataacacgaccaatattaat

SEQ ID NO: 9778 - DNA, 40 bp, Artificial Sequence
  PCR primer for ORF amplification
ggatccagctagcaaaatggcggtaaatcctgagttagca

SEQ ID NO: 9779 - DNA, 40 bp, Artificial Sequence
  PCR primer for ORF amplification
ggatccagctagcaaaatgtctgaactctctcaaatgaca

SEQ ID NO: 9780 - DNA, 40 bp, Artificial Sequence
  PCR primer for ORF amplification
ggatccagctagcaaaatgttcaagatacctggttttgga

SEQ ID NO: 9781 - DNA, 40 bp, Artificial Sequence
  PCR primer for ORF amplification
ggatccagctagcaaaatgacagcgccattgtggccaaac

SEQ ID NO: 9782 - DNA, 40 bp, Artificial Sequence
  PCR primer for ORF amplification
ggatccagctagcaaaatgagtaaagccaagggaacggga

SEQ ID NO: 9783 - DNA, 40 bp, Artificial Sequence
  PCR primer for ORF amplification
ggatccagctagcaaaatgcctaatctattgtcgagaaac

SEQ ID NO: 9784 - DNA, 40 bp, Artificial Sequence
  PCR primer for ORF amplification
ggatccagctagcaaaatgcctgcaccaaaactcacggag

SEQ ID NO: 9785 - DNA, 40 bp, Artificial Sequence
  PCR primer for ORF amplification
ggatccagctagcaaaatggatgcttctgaggaagcaaaa

SEQ ID NO: 9786 - DNA, 40 bp, Artificial Sequence
  PCR primer for ORF amplification
ggatccagctagcaaaatgggtgtctcacaaatatgggaa

SEQ ID NO: 9787 - DNA, 40 bp, Artificial Sequence
  PCR primer for ORF amplification
ggatccagctagcaaaatgtcctcgtcttcgtctaccggg

SEQ ID NO: 9788 - DNA, 40 bp, Artificial Sequence
  PCR primer for ORF amplification
ggatccagctagcaaaatgaagataacgtgtacagacttg

SEQ ID NO: 9789 - DNA, 40 bp, Artificial Sequence
  PCR primer for ORF amplification
ggatccagctagcaaaatgctacttcattttgacattgta

SEQ ID NO: 9790 - DNA, 40 bp, Artificial Sequence
  PCR primer for ORF amplification
ggatccagctagcaaaatggtagatgtgcaaaagagaaaa

SEQ ID NO: 9791 - DNA, 40 bp, Artificial Sequence
  PCR primer for ORF amplification
ggatccagctagcaaaatgaatttttccagcattttcaaa

SEQ ID NO: 9792 - DNA, 40 bp, Artificial Sequence
  PCR primer for ORF amplification
ggatccagctagcaaaatgagtgtccagaaaatgatgtgg

SEQ ID NO: 9793 - DNA, 40 bp, Artificial Sequence
  PCR primer for ORF amplification
ggatccagctagcaaaatgatgatgtggcaacgatatgca

SEQ ID NO: 9794 - DNA, 40 bp, Artificial Sequence
  PCR primer for ORF amplification
ggatccagctagcaaaatggaacaccaagatagttcgcca

SEQ ID NO: 9795 - DNA, 40 bp, Artificial Sequence
  PCR primer for ORF amplification
ggatccagctagcaaaatgcataaacctttaagatggcta

SEQ ID NO: 9796 - DNA, 40 bp, Artificial Sequence
  PCR primer for ORF amplification
ggatccagctagcaaaatgtctgtgcccaaaaaacgtaac

SEQ ID NO: 9797 - DNA, 40 bp, Artificial Sequence
  PCR primer for ORF amplification
ggatccagctagcaaaatgttggcactccggagatttata

SEQ ID NO: 9798 - DNA, 40 bp, Artificial Sequence
  PCR primer for ORF amplification
ggatccagctagcaaaatgaaaaattttcttccacgcaca

SEQ ID NO: 9799 - DNA, 40 bp, Artificial Sequence
  PCR primer for ORF amplification
ggatccagctagcaaaatgaaacggttgcaattgtttggt

SEQ ID NO: 9800 - DNA, 40 bp, Artificial Sequence
  PCR primer for ORF amplification
ggatccagctagcaaaatgaacgatagccaaaactgccta

SEQ ID NO: 9801 - DNA, 40 bp, Artificial Sequence
  PCR primer for ORF amplification
ggatccagctagcaaaatgtcagaggaatttatcgcagtt

SEQ ID NO: 9802 - DNA, 40 bp, Artificial Sequence
  PCR primer for ORF amplification
ggatccagctagcaaaatgaagccctttcaaggaataaca

SEQ ID NO: 9803 - DNA, 40 bp, Artificial Sequence
  PCR primer for ORF amplification
ggatccagctagcaaaatgcctgccaaaatacacatttct

SEQ ID NO: 9804 - DNA, 40 bp, Artificial Sequence
  PCR primer for ORF amplification
ggatccagctagcaaaatggatgaacacgaggaagcagtc

SEQ ID NO: 9805 - DNA, 40 bp, Artificial Sequence
  PCR primer for ORF amplification
ggatccagctagcaaaatggtgaacgaattagagaatgtg

SEQ ID NO: 9806 - DNA, 40 bp, Artificial Sequence
  PCR primer for ORF amplification
ggatccagctagcaaaatgtcaacaaactcattccatgat

SEQ ID NO: 9807 - DNA, 40 bp, Artificial Sequence
  PCR primer for ORF amplification
ggatccagctagcaaaatgagttttttatgggggtctaca

SEQ ID NO: 9808 - DNA, 40 bp, Artificial Sequence
  PCR primer for ORF amplification
ggatccagctagcaaaatgagtgaagaggaaacggtctca

SEQ ID NO: 9809 - DNA, 40 bp, Artificial Sequence
  PCR primer for ORF amplification
ggatccagctagcaaaatgcaactggaagccactcatcag

SEQ ID NO: 9810 - DNA, 40 bp, Artificial Sequence
  PCR primer for ORF amplification
ggatccagctagcaaaatgggaaataggtctttgacagag

SEQ ID NO: 9811 - DNA, 40 bp, Artificial Sequence
  PCR primer for ORF amplification
ggatccagctagcaaaatgaatatcttcataaaagccctg

SEQ ID NO: 9812 - DNA, 40 bp, Artificial Sequence
  PCR primer for ORF amplification
ggatccagctagcaaaatggcaaaaaggcatagtcattat

SEQ ID NO: 9813 - DNA, 40 bp, Artificial Sequence
  PCR primer for ORF amplification
ggatccagctagcaaaatgggtagaagaagtagagcagct

SEQ ID NO: 9814 - DNA, 40 bp, Artificial Sequence
  PCR primer for ORF amplification
ggatccagctagcaaaatgggttccaaaagaagattctcg

SEQ ID NO: 9815 - DNA, 40 bp, Artificial Sequence
  PCR primer for ORF amplification
ggatccagctagcaaaatggttcaatctgctgtcttaggg

SEQ ID NO: 9816 - DNA, 40 bp, Artificial Sequence
  PCR primer for ORF amplification
ggatccagctagcaaaatggacttcgagactaatgaagac

SEQ ID NO: 9817 - DNA, 40 bp, Artificial Sequence
  PCR primer for ORF amplification
ggatccagctagcaaaatggggaagaaggatagacagcgc

SEQ ID NO: 9818 - DNA, 40 bp, Artificial Sequence
  PCR primer for ORF amplification
ggatccagctagcaaaatgactattgctgatgcttccaaa

SEQ ID NO: 9819 - DNA, 40 bp, Artificial Sequence
  PCR primer for ORF amplification
ggatccagctagcaaaatgtctctcagaataaaagcactt

SEQ ID NO: 9820 - DNA, 40 bp, Artificial Sequence
  PCR primer for ORF amplification
ggatccagctagcaaaatggataacgttgtagatccgtgg

SEQ ID NO: 9821 - DNA, 40 bp, Artificial Sequence
  PCR primer for ORF amplification
ggatccagctagcaaaatggccaaaaaaaatagattgaac

SEQ ID NO: 9822 - DNA, 40 bp, Artificial Sequence
  PCR primer for ORF amplification
ggatccagctagcaaaatggctagcttgaaggtatttctc

SEQ ID NO: 9823 - DNA, 40 bp, Artificial Sequence
  PCR primer for ORF amplification
ggatccagctagcaaaatgataaaaatgtggaggttacag

SEQ ID NO: 9824 - DNA, 40 bp, Artificial Sequence
  PCR primer for ORF amplification
ggatccagctagcaaaatgtctgtgcgaaacctcaccaat

SEQ ID NO: 9825 - DNA, 40 bp, Artificial Sequence
  PCR primer for ORF amplification
ggatccagctagcaaaatgcttcgcacgataatattgaaa

SEQ ID NO: 9826 - DNA, 40 bp, Artificial Sequence
  PCR primer for ORF amplification
ggatccagctagcaaaatggatataaactcaaatgcctca

SEQ ID NO: 9827 - DNA, 40 bp, Artificial Sequence
  PCR primer for ORF amplification
ggatccagctagcaaaatgggtaagaaaagggctcctcaa

SEQ ID NO: 9828 - DNA, 40 bp, Artificial Sequence
  PCR primer for ORF amplification
ggatccagctagcaaaatgttgaatggtcgtttaccactt

SEQ ID NO: 9829 - DNA, 40 bp, Artificial Sequence
  PCR primer for ORF amplification
ggatccagctagcaaaatgcaaaaatccgttagagtgggc

SEQ ID NO: 9830 - DNA, 40 bp, Artificial Sequence
  PCR primer for ORF amplification
ggatccagctagcaaaatgtcatttgatagaccggaaata

SEQ ID NO: 9831 - DNA, 40 bp, Artificial Sequence
  PCR primer for ORF amplification
ggatccagctagcaaaatgagctcatcgctactttcagtt

SEQ ID NO: 9832 - DNA, 40 bp, Artificial Sequence
  PCR primer for ORF amplification
ggatccagctagcaaaatggctgatagacctgctattcag

SEQ ID NO: 9833 - DNA, 40 bp, Artificial Sequence
  PCR primer for ORF amplification
ggatccagctagcaaaatgaagttttatatagatgattta

SEQ ID NO: 9834 - DNA, 40 bp, Artificial Sequence
  PCR primer for ORF amplification
ggatccagctagcaaaatgctgtctgcacgttctgccatc

SEQ ID NO: 9835 - DNA, 40 bp, Artificial Sequence
  PCR primer for ORF amplification
ggatccagctagcaaaatgccaacaacttatgtgccaata

SEQ ID NO: 9836 - DNA, 40 bp, Artificial Sequence
  PCR primer for ORF amplification
ggatccagctagcaaaatggagcgaacaaatacaacaaca

SEQ ID NO: 9837 - DNA, 40 bp, Artificial Sequence
  PCR primer for ORF amplification
ggatccagctagcaaaatggggtcgtttcccttagctgag

SEQ ID NO: 9838 - DNA, 40 bp, Artificial Sequence
  PCR primer for ORF amplification
ggatccagctagcaaaatggtttacactccatccaagggt

SEQ ID NO: 9839 - DNA, 40 bp, Artificial Sequence
  PCR primer for ORF amplification
ggatccagctagcaaaatgtcagtcttgcgatcacaacct

SEQ ID NO: 9840 - DNA, 40 bp, Artificial Sequence
  PCR primer for ORF amplification
ggatccagctagcaaaatgtgttacagtaggcaagccatt

SEQ ID NO: 9841 - DNA, 40 bp, Artificial Sequence
  PCR primer for ORF amplification
ggatccagctagcaaaatggctcctaaatctagttcttcc

SEQ ID NO: 9842 - DNA, 40 bp, Artificial Sequence
  PCR primer for ORF amplification
ggatccagctagcaaaatggtagattttttaccaaaagta

SEQ ID NO: 9843 - DNA, 40 bp, Artificial Sequence
  PCR primer for ORF amplification
ggatccagctagcaaaatgaatattgcagaagaaccatca

SEQ ID NO: 9844 - DNA, 40 bp, Artificial Sequence
  PCR primer for ORF amplification
ggatccagctagcaaaatggcagaagcagtactagaaaac

SEQ ID NO: 9845 - DNA, 40 bp, Artificial Sequence
  PCR primer for ORF amplification
ggatccagctagcaaaatgaacattttgaagaagtttatg

SEQ ID NO: 9846 - DNA, 40 bp, Artificial Sequence
  PCR primer for ORF amplification
ggatccagctagcaaaatgacatcatatatcgaaaggctc

SEQ ID NO: 9847 - DNA, 40 bp, Artificial Sequence
  PCR primer for ORF amplification
ggatccagctagcaaaatgcagttgtctatgcggatgatg

SEQ ID NO: 9848 - DNA, 40 bp, Artificial Sequence
  PCR primer for ORF amplification
ggatccagctagcaaaatgatcttcctaaacaccttcgca

SEQ ID NO: 9849 - DNA, 40 bp, Artificial Sequence
  PCR primer for ORF amplification
ggatccagctagcaaaatggtgaatactaggggctacact

SEQ ID NO: 9850 - DNA, 40 bp, Artificial Sequence
  PCR primer for ORF amplification
ggatccagctagcaaaatgcccatcggtaacccaatcaat

SEQ ID NO: 9851 - DNA, 40 bp, Artificial Sequence
  PCR primer for ORF amplification
ggatccagctagcaaaatgtcatctgcaaagacatttact

SEQ ID NO: 9852 - DNA, 40 bp, Artificial Sequence
  PCR primer for ORF amplification
ggatccagctagcaaaatgtcatctgcagagatggaacaa

SEQ ID NO: 9853 - DNA, 40 bp, Artificial Sequence
  PCR primer for ORF amplification
ggatccagctagcaaaatgtctgttaaagagcataacgaa

SEQ ID NO: 9854 - DNA, 40 bp, Artificial Sequence
  PCR primer for ORF amplification
ggatccagctagcaaaatgagtaagcggggtagtttacag

SEQ ID NO: 9855 - DNA, 40 bp, Artificial Sequence
  PCR primer for ORF amplification
ggatccagctagcaaaatgctgtccgatacaattgacaca

SEQ ID NO: 9856 - DNA, 40 bp, Artificial Sequence
  PCR primer for ORF amplification
ggatccagctagcaaaatggattctccatccaattctatc

SEQ ID NO: 9857 - DNA, 40 bp, Artificial Sequence
  PCR primer for ORF amplification
ggatccagctagcaaaatgtttgatggctttagcaacaat

SEQ ID NO: 9858 - DNA, 40 bp, Artificial Sequence
  PCR primer for ORF amplification
ggatccagctagcaaaatgaagatggccgtggatgaccct

SEQ ID NO: 9859 - DNA, 40 bp, Artificial Sequence
  PCR primer for ORF amplification
ggatccagctagcaaaatggcaggtcattcacacaggtca

SEQ ID NO: 9860 - DNA, 40 bp, Artificial Sequence
  PCR primer for ORF amplification
ggatccagctagcaaaatggtggaatgtatcactcccgaa

SEQ ID NO: 9861 - DNA, 40 bp, Artificial Sequence
  PCR primer for ORF amplification
ggatccagctagcaaaatgccactgtgtgagaaagggaat

SEQ ID NO: 9862 - DNA, 40 bp, Artificial Sequence
  PCR primer for ORF amplification
ggatccagctagcaaaatgctatcttcagctaataggttt

SEQ ID NO: 9863 - DNA, 40 bp, Artificial Sequence
  PCR primer for ORF amplification
ggatccagctagcaaaatgaatcattggttagcatttttg

SEQ ID NO: 9864 - DNA, 40 bp, Artificial Sequence
  PCR primer for ORF amplification
ggatccagctagcaaaatgcaagaagggggctttatccgt

SEQ ID NO: 9865 - DNA, 40 bp, Artificial Sequence
  PCR primer for ORF amplification
ggatccagctagcaaaatgtcttcattaactcgattgcta

SEQ ID NO: 9866 - DNA, 40 bp, Artificial Sequence
  PCR primer for ORF amplification
ggatccagctagcaaaatgttcgaatctgtcaatttggat

SEQ ID NO: 9867 - DNA, 40 bp, Artificial Sequence
  PCR primer for ORF amplification
ggatccagctagcaaaatgaaaaggcacgtgtctttatct

SEQ ID NO: 9868 - DNA, 40 bp, Artificial Sequence
  PCR primer for ORF amplification
ggatccagctagcaaaatggtagcgacatcttcaaagagg

SEQ ID NO: 9869 - DNA, 40 bp, Artificial Sequence; identical to SEQ ID NO: 9285
  PCR primer for ORF amplification

SEQ ID NO: 9870 - DNA, 40 bp, Artificial Sequence
  PCR primer for ORF amplification
ggatccagctagcaaaatgaccactcaagaatcgatcaaa

SEQ ID NO: 9871 - DNA, 40 bp, Artificial Sequence
  PCR primer for ORF amplification
ggatccagctagcaaaatgcaagtactagtgacgctctgg

SEQ ID NO: 9872 - DNA, 40 bp, Artificial Sequence
  PCR primer for ORF amplification
ggatccagctagcaaaatggtaatacaaactgctactacg

SEQ ID NO: 9873 - DNA, 40 bp, Artificial Sequence
  PCR primer for ORF amplification
ggatccagctagcaaaatggcagcaaaaagaggattagcc

SEQ ID NO: 9874 - DNA, 40 bp, Artificial Sequence
  PCR primer for ORF amplification
ggatccagctagcaaaatgagtgatgaaggtgctgataaa

SEQ ID NO: 9875 - DNA, 40 bp, Artificial Sequence
  PCR primer for ORF amplification
ggatccagctagcaaaatgacgaaactaatcgctccttca

SEQ ID NO: 9876 - DNA, 40 bp, Artificial Sequence
  PCR primer for ORF amplification
ggatccagctagcaaaatggatttgttagcggccagcgta

SEQ ID NO: 9877 - DNA, 40 bp, Artificial Sequence
  PCR primer for ORF amplification
ggatccagctagcaaaatggtttgctgcttatgggtgctt

SEQ ID NO: 9878 - DNA, 40 bp, Artificial Sequence
  PCR primer for ORF amplification
ggatccagctagcaaaatgtccgacaagatacaggaggag

SEQ ID NO: 9879 - DNA, 40 bp, Artificial Sequence
  PCR primer for ORF amplification
ggatccagctagcaaaatgtccttctttgggttagaaaat

SEQ ID NO: 9880 - DNA, 40 bp, Artificial Sequence
  PCR primer for ORF amplification
ggatccagctagcaaaatggtacagaacaatgaatcggtt

SEQ ID NO: 9881 - DNA, 40 bp, Artificial Sequence
  PCR primer for ORF amplification
ggatccagctagcaaaatgaaaaaccctagcttcgactgg

SEQ ID NO: 9882 - DNA, 40 bp, Artificial Sequence
  PCR primer for ORF amplification
ggatccagctagcaaaatgtcacagaagcaaagtacgaat

SEQ ID NO: 9883 - DNA, 40 bp, Artificial Sequence
  PCR primer for ORF amplification
ggatccagctagcaaaatgagtaccatttatagggagagc

SEQ ID NO: 9884 - DNA, 40 bp, Artificial Sequence
  PCR primer for ORF amplification
ggatccagctagcaaaatgagttataaagtgaatagttcg

SEQ ID NO: 9885 - DNA, 40 bp, Artificial Sequence
  PCR primer for ORF amplification
ggatccagctagcaaaatggttcatcgaggaaggactttg

SEQ ID NO: 9886 - DNA, 40 bp, Artificial Sequence
  PCR primer for ORF amplification
ggatccagctagcaaaatggttttgccgattctaccgtta

SEQ ID NO: 9887 - DNA, 40 bp, Artificial Sequence
  PCR primer for ORF amplification
ggatccagctagcaaaatggcttctgtacctaaacgccat

SEQ ID NO: 9888 - DNA, 40 bp, Artificial Sequence
  PCR primer for ORF amplification
ggatccagctagcaaaatggggttctacaactgtagattc

SEQ ID NO: 9889 - DNA, 40 bp, Artificial Sequence
  PCR primer for ORF amplification
ggatccagctagcaaaatgttacaacggagatttatatcc

SEQ ID NO: 9890 - DNA, 40 bp, Artificial Sequence
  PCR primer for ORF amplification
ggatccagctagcaaaatggcgagaagtagaaagaattca

SEQ ID NO: 9891 - DNA, 40 bp, Artificial Sequence
  PCR primer for ORF amplification
ggatccagctagcaaaatgagatttcttcaggtttataaa

SEQ ID NO: 9892 - DNA, 40 bp, Artificial Sequence
  PCR primer for ORF amplification
ggatccagctagcaaaatgctcaacattctcgttttagga

SEQ ID NO: 9893 - DNA, 40 bp, Artificial Sequence
  PCR primer for ORF amplification
ggatccagctagcaaaatgtcagatgaaaaccataacagt

SEQ ID NO: 9894 - DNA, 40 bp, Artificial Sequence
  PCR primer for ORF amplification
ggatccagctagcaaaatggcgttggaagaagtggtacga

SEQ ID NO: 9895 - DNA, 40 bp, Artificial Sequence
  PCR primer for ORF amplification
ggatccagctagcaaaatgatgttttggtcctcaaagacg

SEQ ID NO: 9896 - DNA, 40 bp, Artificial Sequence
  PCR primer for ORF amplification
ggatccagctagcaaaatggctgcgggtcaaaaaaaatat

SEQ ID NO: 9897 - DNA, 40 bp, Artificial Sequence
  PCR primer for ORF amplification
ggatccagctagcaaaatgaacgtgcctgaaacaagacaa

SEQ ID NO: 9898 - DNA, 40 bp, Artificial Sequence
  PCR primer for ORF amplification
ggatccagctagcaaaatgggctcagaacaagccttaagt

SEQ ID NO: 9899 - DNA, 40 bp, Artificial Sequence
  PCR primer for ORF amplification
ggatccagctagcaaaatgtcttcagatcccttgcagcaa

SEQ ID NO: 9900 - DNA, 40 bp, Artificial Sequence
  PCR primer for ORF amplification
ggatccagctagcaaaatgaactcatccaataataacgac

SEQ ID NO: 9901 - DNA, 40 bp, Artificial Sequence
  PCR primer for ORF amplification
ggatccagctagcaaaatgatggctaagaacaacaaaact

SEQ ID NO: 9902 - DNA, 40 bp, Artificial Sequence
  PCR primer for ORF amplification
ggatccagctagcaaaatgccagatttgaagtccaagacc

SEQ ID NO: 9903 - DNA, 40 bp, Artificial Sequence
  PCR primer for ORF amplification
ggatccagctagcaaaatggttttggaagtgccctcaatc

SEQ ID NO: 9904 - DNA, 40 bp, Artificial Sequence
  PCR primer for ORF amplification
ggatccagctagcaaaatgaggagcagttatcaaccagtg

SEQ ID NO: 9905 - DNA, 40 bp, Artificial Sequence
  PCR primer for ORF amplification
ggatccagctagcaaaatgccttcatccatatccgtcaag

SEQ ID NO: 9906 - DNA, 40 bp, Artificial Sequence
  PCR primer for ORF amplification
ggatccagctagcaaaatggatttgtttattgaaagcaag

SEQ ID NO: 9907 - DNA, 40 bp, Artificial Sequence
  PCR primer for ORF amplification
ggatccagctagcaaaatggtagattcaattcaccgtatt

SEQ ID NO: 9908 - DNA, 40 bp, Artificial Sequence
  PCR primer for ORF amplification
ggatccagctagcaaaatgtcttctgtagaagaattgact

SEQ ID NO: 9909 - DNA, 40 bp, Artificial Sequence
  PCR primer for ORF amplification
ggatccagctagcaaaatgaaaagaagaagcgatgctttg

SEQ ID NO: 9910 - DNA, 40 bp, Artificial Sequence
  PCR primer for ORF amplification
ggatccagctagcaaaatgaatactccacagattagtctg

SEQ ID NO: 9911 - DNA, 40 bp, Artificial Sequence
  PCR primer for ORF amplification
ggatccagctagcaaaatgccttcaggtcataacgataaa

SEQ ID NO: 9912 - DNA, 40 bp, Artificial Sequence
  PCR primer for ORF amplification
ggatccagctagcaaaatggacaatcaggctacacagagg

SEQ ID NO: 9913 - DNA, 40 bp, Artificial Sequence
  PCR primer for ORF amplification
ggatccagctagcaaaatggatggttttcgtgtagctggt

SEQ ID NO: 9914 - DNA, 40 bp, Artificial Sequence
  PCR primer for ORF amplification
ggatccagctagcaaaatggccggttcacaacttaagaat

SEQ ID NO: 9915 - DNA, 40 bp, Artificial Sequence
  PCR primer for ORF amplification
ggatccagctagcaaaatgagaatgatacagagagagaga

SEQ ID NO: 9916 - DNA, 40 bp, Artificial Sequence
  PCR primer for ORF amplification
ggatccagctagcaaaatggtaatcttcaaagaacgcaaa

SEQ ID NO: 9917 - DNA, 40 bp, Artificial Sequence
  PCR primer for ORF amplification
ggatccagctagcaaaatgtcgaatataagtaccaaagat

SEQ ID NO: 9918 - DNA, 40 bp, Artificial Sequence
  PCR primer for ORF amplification
ggatccagctagcaaaatgttaagacaagctacaaaagca

SEQ ID NO: 9919 - DNA, 40 bp, Artificial Sequence
  PCR primer for ORF amplification
ggatccagctagcaaaatgagaacgaagagaactaggggt

SEQ ID NO: 9920 - DNA, 40 bp, Artificial Sequence
  PCR primer for ORF amplification
ggatccagctagcaaaatgtcccgtttcttttcgtctaat

SEQ ID NO: 9921 - DNA, 40 bp, Artificial Sequence
  PCR primer for ORF amplification
ggatccagctagcaaaatgaaagtgaggaaatatattact

SEQ ID NO: 9922 - DNA, 40 bp, Artificial Sequence
  PCR primer for ORF amplification
ggatccagctagcaaaatgacatccgatgatgggaatgct

SEQ ID NO: 9923 - DNA, 40 bp, Artificial Sequence
  PCR primer for ORF amplification
ggatccagctagcaaaatgggaaacagtccttctactcag

SEQ ID NO: 9924 - DNA, 40 bp, Artificial Sequence
  PCR primer for ORF amplification
ggatccagctagcaaaatgtctgagactctgcctagatct

SEQ ID NO: 9925 - DNA, 40 bp, Artificial Sequence
  PCR primer for ORF amplification
ggatccagctagcaaaatgctattcaatatcaaccgtcaa

SEQ ID NO: 9926 - DNA, 40 bp, Artificial Sequence
  PCR primer for ORF amplification
ggatccagctagcaaaatggatgttgtgcagcagaaacag

SEQ ID NO: 9927 - DNA, 40 bp, Artificial Sequence
  PCR primer for ORF amplification
ggatccagctagcaaaatgagcactgaacaggtcggtaga

SEQ ID NO: 9928 - DNA, 40 bp, Artificial Sequence
  PCR primer for ORF amplification
ggatccagctagcaaaatgcctaactcaaatgttcggatt

SEQ ID NO: 9929 - DNA, 40 bp, Artificial Sequence
  PCR primer for ORF amplification
ggatccagctagcaaaatggatctgaaaacctcatataaa

SEQ ID NO: 9930 - DNA, 40 bp, Artificial Sequence
  PCR primer for ORF amplification
ggatccagctagcaaaatggcaggtgctccagctcctcct

SEQ ID NO: 9931 - DNA, 40 bp, Artificial Sequence
  PCR primer for ORF amplification
ggatccagctagcaaaatgtcggaagagaaaacgtacaaa

SEQ ID NO: 9932 - DNA, 40 bp, Artificial Sequence
  PCR primer for ORF amplification
ggatccagctagcaaaatggaaggtggcgaagaagaagtt

SEQ ID NO: 9933 - DNA, 40 bp, Artificial Sequence
  PCR primer for ORF amplification
ggatccagctagcaaaatggcattttcacgtcttacatct

SEQ ID NO: 9934 - DNA, 40 bp, Artificial Sequence
  PCR primer for ORF amplification
ggatccagctagcaaaatggcgggaaacggtaaggacaaa

SEQ ID NO: 9935 - DNA, 40 bp, Artificial Sequence
  PCR primer for ORF amplification
ggatccagctagcaaaatgtcactatggccctttggagag

SEQ ID NO: 9936 - DNA, 40 bp, Artificial Sequence
  PCR primer for ORF amplification
ggatccagctagcaaaatgagttctttggacgaggatgaa

SEQ ID NO: 9937 - DNA, 40 bp, Artificial Sequence
  PCR primer for ORF amplification
ggatccagctagcaaaatgtggaaatggaatgtgcgcaga

SEQ ID NO: 9938 - DNA, 40 bp, Artificial Sequence
  PCR primer for ORF amplification
ggatccagctagcaaaatgaacgaagttcctaccactcca

SEQ ID NO: 9939 - DNA, 40 bp, Artificial Sequence
  PCR primer for ORF amplification
ggatccagctagcaaaatggaaaatattacacaacccaca

SEQ ID NO: 9940 - DNA, 40 bp, Artificial Sequence
  PCR primer for ORF amplification
ggatccagctagcaaaatgctggaaggtacggtagattat

SEQ ID NO: 9941 - DNA, 40 bp, Artificial Sequence
  PCR primer for ORF amplification
ggatccagctagcaaaatgtgccataattctgttaggagc

SEQ ID NO: 9942 - DNA, 40 bp, Artificial Sequence
  PCR primer for ORF amplification
ggatccagctagcaaaatgacacagcttcagatttcatta

SEQ ID NO: 9943 - DNA, 40 bp, Artificial Sequence
  PCR primer for ORF amplification
ggatccagctagcaaaatggaaatcaaagaggtagatgac

SEQ ID NO: 9944 - DNA, 40 bp, Artificial Sequence
  PCR primer for ORF amplification
ggatccagctagcaaaatgatgaatttttttacatcaaaa

SEQ ID NO: 9945 - DNA, 40 bp, Artificial Sequence
  PCR primer for ORF amplification
ggatccagctagcaaaatgtcaaagctattttctactgtc

SEQ ID NO: 9946 - DNA, 40 bp, Artificial Sequence
  PCR primer for ORF amplification
ggatccagctagcaaaatggagaatacactgggtgagggg

SEQ ID NO: 9947 - DNA, 40 bp, Artificial Sequence
  PCR primer for ORF amplification
ggatccagctagcaaaatggataacttcaaaatttacagt

SEQ ID NO: 9948 - DNA, 40 bp, Artificial Sequence
  PCR primer for ORF amplification
ggatccagctagcaaaatgtcgtcttcctcacttcgagtt

SEQ ID NO: 9949 - DNA, 40 bp, Artificial Sequence
  PCR primer for ORF amplification
ggatccagctagcaaaatgttgctactttcttggtcaaga

SEQ ID NO: 9950 - DNA, 40 bp, Artificial Sequence
  PCR primer for ORF amplification
ggatccagctagcaaaatgcatagcaacgtatttgttggt

SEQ ID NO: 9951 - DNA, 40 bp, Artificial Sequence
  PCR primer for ORF amplification
ggatccagctagcaaaatgcctagcccatatgacggtaaa

SEQ ID NO: 9952 - DNA, 40 bp, Artificial Sequence
  PCR primer for ORF amplification
ggatccagctagcaaaatggaaggtttgaagaaaaagatt

SEQ ID NO: 9953 - DNA, 40 bp, Artificial Sequence
  PCR primer for ORF amplification
ggatccagctagcaaaatgtctagtccagatgattttgaa

SEQ ID NO: 9954 - DNA, 40 bp, Artificial Sequence
  PCR primer for ORF amplification
ggatccagctagcaaaatgttcaaaccagtagacttctct

SEQ ID NO: 9955 - DNA, 40 bp, Artificial Sequence
  PCR primer for ORF amplification
ggatccagctagcaaaatgctgtttggagtgaagttggct

SEQ ID NO: 9956 - DNA, 40 bp, Artificial Sequence
  PCR primer for ORF amplification
ggatccagctagcaaaatgttgggtaatttactgagaaat

SEQ ID NO: 9957 - DNA, 40 bp, Artificial Sequence
  PCR primer for ORF amplification
ggatccagctagcaaaatggccaagaggaaatatggcagg

SEQ ID NO: 9958 - DNA, 40 bp, Artificial Sequence
  PCR primer for ORF amplification
ggatccagctagcaaaatgaacttgaagcagttcacgtgc

SEQ ID NO: 9959 - DNA, 40 bp, Artificial Sequence
  PCR primer for ORF amplification
ggatccagctagcaaaatgaagacaccaacaagagtttcg

SEQ ID NO: 9960 - DNA, 40 bp, Artificial Sequence
  PCR primer for ORF amplification
ggatccagctagcaaaatgacatctgcattaagggttttg

SEQ ID NO: 9961 - DNA, 40 bp, Artificial Sequence
  PCR primer for ORF amplification
ggatccagctagcaaaatggcaatcaagtcattggaatcg

SEQ ID NO: 9962 - DNA, 40 bp, Artificial Sequence
  PCR primer for ORF amplification
ggatccagctagcaaaatgtcattaacagcaaacgacgaa

SEQ ID NO: 9963 - DNA, 40 bp, Artificial Sequence
  PCR primer for ORF amplification
ggatccagctagcaaaatgccgacaccttcaaacgctata

SEQ ID NO: 9964 - DNA, 40 bp, Artificial Sequence
  PCR primer for ORF amplification
ggatccagctagcaaaatggattcgattacagtaaaaaaa

SEQ ID NO: 9965 - DNA, 40 bp, Artificial Sequence
  PCR primer for ORF amplification
ggatccagctagcaaaatgggctcttcgttgagaagcttt

SEQ ID NO: 9966 - DNA, 40 bp, Artificial Sequence
  PCR primer for ORF amplification
ggatccagctagcaaaatgaataatgctgcaaatacaggg

SEQ ID NO: 9967 - DNA, 40 bp, Artificial Sequence
  PCR primer for ORF amplification
ggatccagctagcaaaatgataacactcttattatacctg

SEQ ID NO: 9968 - DNA, 40 bp, Artificial Sequence
  PCR primer for ORF amplification
ggatccagctagcaaaatgcttatttcaaaatctaagatg

SEQ ID NO: 9969 - DNA, 40 bp, Artificial Sequence
  PCR primer for ORF amplification
ggatccagctagcaaaatgtctaaccaaatatactcagcg

SEQ ID NO: 9970 - DNA, 40 bp, Artificial Sequence
  PCR primer for ORF amplification
ggatccagctagcaaaatgacgaatatggcggaggataaa

SEQ ID NO: 9971 - DNA, 40 bp, Artificial Sequence
  PCR primer for ORF amplification
ggatccagctagcaaaatggtacaaagatgattatattca

SEQ ID NO: 9972 - DNA, 40 bp, Artificial Sequence
  PCR primer for ORF amplification
ggatccagctagcaaaatgctatttggtattaaactggct

SEQ ID NO: 9973 - DNA, 40 bp, Artificial Sequence
  PCR primer for ORF amplification
ggatccagctagcaaaatgggtgaagaacataaaccactt

SEQ ID NO: 9974 - DNA, 40 bp, Artificial Sequence
  PCR primer for ORF amplification
ggatccagctagcaaaatgctagacaaggcgcgctctcaa

SEQ ID NO: 9975 - DNA, 40 bp, Artificial Sequence
  PCR primer for ORF amplification
ggatccagctagcaaaatggctcatagaaaattacagcag

SEQ ID NO: 9976 - DNA, 40 bp, Artificial Sequence
  PCR primer for ORF amplification
ggatccagctagcaaaatgaacgacccttctttactaggc

SEQ ID NO: 9977 - DNA, 40 bp, Artificial Sequence
  PCR primer for ORF amplification
ggatccagctagcaaaatggttaaagtaaagtcgaaaaag

SEQ ID NO: 9978 - DNA, 40 bp, Artificial Sequence
  PCR primer for ORF amplification
ggatccagctagcaaaatgttttcatcatcatctcgacct

SEQ ID NO: 9979 - DNA, 40 bp, Artificial Sequence
  PCR primer for ORF amplification
ggatccagctagcaaaatgtctgaatatctagctcagacg

SEQ ID NO: 9980 - DNA, 40 bp, Artificial Sequence
  PCR primer for ORF amplification
ggatccagctagcaaaatgttcacatttatacccatcacc

SEQ ID NO: 9981 - DNA, 40 bp, Artificial Sequence
  PCR primer for ORF amplification
ggatccagctagcaaaatgctggagacgttgcgcggaaat

SEQ ID NO: 9982 - DNA, 40 bp, Artificial Sequence
  PCR primer for ORF amplification
ggatccagctagcaaaatggatttcgttgtagactatcag

SEQ ID NO: 9983 - DNA, 40 bp, Artificial Sequence
  PCR primer for ORF amplification
ggatccagctagcaaaatgaaagtggtaaagtttccatgg

SEQ ID NO: 9984 - DNA, 40 bp, Artificial Sequence
  PCR primer for ORF amplification
ggatccagctagcaaaatgaagttttgtctttattgctgt

SEQ ID NO: 9985 - DNA, 40 bp, Artificial Sequence
  PCR primer for ORF amplification
ggatccagctagcaaaatggatgatctgctaaaagttccc

SEQ ID NO: 9986 - DNA, 40 bp, Artificial Sequence
  PCR primer for ORF amplification
ggatccagctagcaaaatggcagagaaggaggaagcgatt

SEQ ID NO: 9987 - DNA, 40 bp, Artificial Sequence
  PCR primer for ORF amplification
ggatccagctagcaaaatggacctcccaactgttaatagc

SEQ ID NO: 9988 - DNA, 40 bp, Artificial Sequence
  PCR primer for ORF amplification
ggatccagctagcaaaatgggtaagacacaaaagaagaat

SEQ ID NO: 9989 - DNA, 40 bp, Artificial Sequence
  PCR primer for ORF amplification
ggatccagctagcaaaatggttgctttcactgttgaccaa

SEQ ID NO: 9990 - DNA, 40 bp, Artificial Sequence
  PCR primer for ORF amplification
ggatccagctagcaaaatgataaatgagagcgtttccaag

SEQ ID NO: 9991 - DNA, 40 bp, Artificial Sequence
  PCR primer for ORF amplification
ggatccagctagcaaaatgtctctttcagctgcagcgaat

SEQ ID NO: 9992 - DNA, 40 bp, Artificial Sequence
  PCR primer for ORF amplification
ggatccagctagcaaaatgacggacgttgaaggctaccaa

SEQ ID NO: 9993 - DNA, 40 bp, Artificial Sequence
  PCR primer for ORF amplification
ggatccagctagcaaaatgagcattgcatctcagaaaaag

SEQ ID NO: 9994 - DNA, 40 bp, Artificial Sequence
  PCR primer for ORF amplification
ggatccagctagcaaaatgtctttaatttcagctgtagaa

SEQ ID NO: 9995 - DNA, 40 bp, Artificial Sequence
  PCR primer for ORF amplification
ggatccagctagcaaaatgaaaccttacttatttgaccta

SEQ ID NO: 9996 - DNA, 40 bp, Artificial Sequence
  PCR primer for ORF amplification
ggatccagctagcaaaatgagtgcggcacttccatcaatt

SEQ ID NO: 9997 - DNA, 40 bp, Artificial Sequence
  PCR primer for ORF amplification
ggatccagctagcaaaatggaactagagcccactcttttt

SEQ ID NO: 9998 - DNA, 40 bp, Artificial Sequence
  PCR primer for ORF amplification
ggatccagctagcaaaatgaatcctatcaactctctagcg

SEQ ID NO: 9999 - DNA, 40 bp, Artificial Sequence
  PCR primer for ORF amplification
ggatccagctagcaaaatggaaactattgattcgaagcaa

SEQ ID NO: 10000 - DNA, 40 bp, Artificial Sequence
  PCR primer for ORF amplification
ggatccagctagcaaaatgtccatagcgcgattagtatac

SEQ ID NO: 10001 - DNA, 40 bp, Artificial Sequence
  PCR primer for ORF amplification
ggatccagctagcaaaatggctctgccaatagagggcaaa

SEQ ID NO: 10002 - DNA, 40 bp, Artificial Sequence
  PCR primer for ORF amplification
ggatccagctagcaaaatggttatggcggatactattgcc

SEQ ID NO: 10003 - DNA, 40 bp, Artificial Sequence
  PCR primer for ORF amplification
ggatccagctagcaaaatgttgctagtacgaacgacttcc

SEQ ID NO: 10004 - DNA, 40 bp, Artificial Sequence
  PCR primer for ORF amplification
ggatccagctagcaaaatgccgaagaatagtcaccaccat

SEQ ID NO: 10005 - DNA, 40 bp, Artificial Sequence
  PCR primer for ORF amplification
ggatccagctagcaaaatggatatggatacgcaggaggca

SEQ ID NO: 10006 - DNA, 40 bp, Artificial Sequence
  PCR primer for ORF amplification
ggatccagctagcaaaatgacctcgattcaggagcgaggc

SEQ ID NO: 10007 - DNA, 40 bp, Artificial Sequence
  PCR primer for ORF amplification
ggatccagctagcaaaatgagttctgtcaaccaaatatat

SEQ ID NO: 10008 - DNA, 40 bp, Artificial Sequence
  PCR primer for ORF amplification
ggatccagctagcaaaatgttcaagtcgaaaacaagcact

SEQ ID NO: 10009 - DNA, 40 bp, Artificial Sequence
  PCR primer for ORF amplification
ggatccagctagcaaaatgagcagatgctcaaacgcggcg

SEQ ID NO: 10010 - DNA, 40 bp, Artificial Sequence
  PCR primer for ORF amplification
ggatccagctagcaaaatgatctcaacagcttctgcattt

SEQ ID NO: 10011 - DNA, 40 bp, Artificial Sequence
  PCR primer for ORF amplification
ggatccagctagcaaaatgtcatttcagattaccccaact

SEQ ID NO: 10012 - DNA, 40 bp, Artificial Sequence
  PCR primer for ORF amplification
ggatccagctagcaaaatggcgatccaaacccgttttgcc

SEQ ID NO: 10013 - DNA, 40 bp, Artificial Sequence
  PCR primer for ORF amplification
ggatccagctagcaaaatgtctaggaaaagaagtactaag

SEQ ID NO: 10014 - DNA, 40 bp, Artificial Sequence
  PCR primer for ORF amplification
ggatccagctagcaaaatgtgggtagtacgataccagaat

SEQ ID NO: 10015 - DNA, 40 bp, Artificial Sequence
  PCR primer for ORF amplification
ggatccagctagcaaaatgggagatgagaagctttcacgc

SEQ ID NO: 10016 - DNA, 40 bp, Artificial Sequence
  PCR primer for ORF amplification
ggatccagctagcaaaatgtctgaaggaaaacaacaattc

SEQ ID NO: 10017 - DNA, 40 bp, Artificial Sequence
  PCR primer for ORF amplification
ggatccagctagcaaaatgtcccgtgaagtactgccaaac

SEQ ID NO: 10018 - DNA, 40 bp, Artificial Sequence
  PCR primer for ORF amplification
ggatccagctagcaaaatgtcattaccgggtacacctact

SEQ ID NO: 10019 - DNA, 40 bp, Artificial Sequence
  PCR primer for ORF amplification
ggatccagctagcaaaatgtcgtccttatccacttcattt

SEQ ID NO: 10020 - DNA, 40 bp, Artificial Sequence
  PCR primer for ORF amplification
ggatccagctagcaaaatgacttataaatacaattgctgt

SEQ ID NO: 10021 - DNA, 40 bp, Artificial Sequence
  PCR primer for ORF amplification
ggatccagctagcaaaatgccaaagtggataagatcaaca

SEQ ID NO: 10022 - DNA, 40 bp, Artificial Sequence
  PCR primer for ORF amplification
ggatccagctagcaaaatgtcacgtaagagctcgactgaa

SEQ ID NO: 10023 - DNA, 40 bp, Artificial Sequence
  PCR primer for ORF amplification
ggatccagctagcaaaatgtcagcatacatcgcaatgaaa

SEQ ID NO: 10024 - DNA, 40 bp, Artificial Sequence
  PCR primer for ORF amplification
ggatccagctagcaaaatgtcatcatcctcaagttcatca

SEQ ID NO: 10025 - DNA, 40 bp, Artificial Sequence
  PCR primer for ORF amplification
ggatccagctagcaaaatgaacactgcattggatgattta

SEQ ID NO: 10026 - DNA, 40 bp, Artificial Sequence
  PCR primer for ORF amplification
ggatccagctagcaaaatggaagggcaaaaatcgaatgca

SEQ ID NO: 10027 - DNA, 40 bp, Artificial Sequence
  PCR primer for ORF amplification
ggatccagctagcaaaatggacaaaaaggaatattcggag

SEQ ID NO: 10028 - DNA, 40 bp, Artificial Sequence
  PCR primer for ORF amplification
ggatccagctagcaaaatggtcaatatttctgatttcttt

SEQ ID NO: 10029 - DNA, 40 bp, Artificial Sequence
  PCR primer for ORF amplification
ggatccagctagcaaaatgtccaccgctgaatttgctcaa

SEQ ID NO: 10030 - DNA, 40 bp, Artificial Sequence
  PCR primer for ORF amplification
ggatccagctagcaaaatgaacatggcaatccaaacaatt

SEQ ID NO: 10031 - DNA, 40 bp, Artificial Sequence
  PCR primer for ORF amplification
ggatccagctagcaaaatgcagtacgtaggcagagctctt

SEQ ID NO: 10032 - DNA, 40 bp, Artificial Sequence
  PCR primer for ORF amplification
ggatccagctagcaaaatgtccagcagcaattttaacgag

SEQ ID NO: 10033 - DNA, 40 bp, Artificial Sequence
  PCR primer for ORF amplification
ggatccagctagcaaaatgccatctgctagcttactcgtc

SEQ ID NO: 10034 - DNA, 40 bp, Artificial Sequence
  PCR primer for ORF amplification
ggatccagctagcaaaatgggatatgactcccaagttagg

SEQ ID NO: 10035 - DNA, 40 bp, Artificial Sequence
  PCR primer for ORF amplification
ggatccagctagcaaaatgagtatgtttctttccattgga

SEQ ID NO: 10036 - DNA, 40 bp, Artificial Sequence
  PCR primer for ORF amplification
ggatccagctagcaaaatgacagcacgtcgtttgattaat

SEQ ID NO: 10037 - DNA, 40 bp, Artificial Sequence
  PCR primer for ORF amplification
ggatccagctagcaaaatgtacatggccagatgtggcccc

SEQ ID NO: 10038 - DNA, 40 bp, Artificial Sequence
  PCR primer for ORF amplification
ggatccagctagcaaaatgtcgtacaccaataaacgtcat

SEQ ID NO: 10039 - DNA, 40 bp, Artificial Sequence
  PCR primer for ORF amplification
caggagctgcacttccagacgaaaaaagtaatggaacacc

SEQ ID NO: 10040 - DNA, 40 bp, Artificial Sequence
  PCR primer for ORF amplification
caggagctgcacttcctaatattaggtatgtagatatact

SEQ ID NO: 10041 - DNA, 40 bp, Artificial Sequence
  PCR primer for ORF amplification
caggagctgcacttccctcgcctctaaccccacgtaggac

SEQ ID NO: 10042 - DNA, 40 bp, Artificial Sequence
  PCR primer for ORF amplification
caggagctgcacttcctctatctaatgaaaccacagtatt

SEQ ID NO: 10043 - DNA, 40 bp, Artificial Sequence
  PCR primer for ORF amplification
caggagctgcacttccagcaattaggcttttggggcgaag

SEQ ID NO: 10044 - DNA, 40 bp, Artificial Sequence
  PCR primer for ORF amplification
caggagctgcacttcccacgtacatacacgaaaagatagc

SEQ ID NO: 10045 - DNA, 40 bp, Artificial Sequence
  PCR primer for ORF amplification
caggagctgcacttccgttcttaggagacatggtggagtc

SEQ ID NO: 10046 - DNA, 40 bp, Artificial Sequence
  PCR primer for ORF amplification
caggagctgcacttccagcaataacacatgctgggtccca

SEQ ID NO: 10047 - DNA, 40 bp, Artificial Sequence
  PCR primer for ORF amplification
caggagctgcacttccaataaagcctttccttgggggggg

SEQ ID NO: 10048 - DNA, 40 bp, Artificial Sequence
  PCR primer for ORF amplification
caggagctgcacttcctataaaaagcaatgaagaagttat

SEQ ID NO: 10049 - DNA, 40 bp, Artificial Sequence
  PCR primer for ORF amplification
caggagctgcacttccctgcaagtaaggaacatcgctctt

SEQ ID NO: 10050 - DNA, 40 bp, Artificial Sequence
  PCR primer for ORF amplification
caggagctgcacttccaatgatactataccaagacaagcg

SEQ ID NO: 10051 - DNA, 40 bp, Artificial Sequence
  PCR primer for ORF amplification
caggagctgcacttccgaaagccgggtaaggtatgacagc

SEQ ID NO: 10052 - DNA, 40 bp, Artificial Sequence
  PCR primer for ORF amplification
caggagctgcacttccatttgaggctaacctgtatggcat

SEQ ID NO: 10053 - DNA, 40 bp, Artificial Sequence
  PCR primer for ORF amplification
caggagctgcacttccagcgataacacaggcgggatccca

SEQ ID NO: 10054 - DNA, 40 bp, Artificial Sequence
  PCR primer for ORF amplification
caggagctgcacttccttttactagtttatggactctgat

SEQ ID NO: 10055 - DNA, 40 bp, Artificial Sequence
  PCR primer for ORF amplification
caggagctgcacttccatttttccaatctctgatctgact

SEQ ID NO: 10056 - DNA, 40 bp, Artificial Sequence
  PCR primer for ORF amplification
caggagctgcacttccaaaggcgcgagacagcaaacagga

SEQ ID NO: 10057 - DNA, 40 bp, Artificial Sequence
  PCR primer for ORF amplification
caggagctgcacttcctattgttcggatgcggaagatggc

SEQ ID NO: 10058 - DNA, 40 bp, Artificial Sequence
  PCR primer for ORF amplification
caggagctgcacttccagatgttggggtactataaatgtt

SEQ ID NO: 10059 - DNA, 40 bp, Artificial Sequence
  PCR primer for ORF amplification
caggagctgcacttccatagtatgttcctactataataca

SEQ ID NO: 10060 - DNA, 40 bp, Artificial Sequence
  PCR primer for ORF amplification
caggagctgcacttccgaatctttgcaatcctctttgtct

SEQ ID NO: 10061 - DNA, 40 bp, Artificial Sequence
  PCR primer for ORF amplification
caggagctgcacttccgtttgcgatagtgtagataccgtc

SEQ ID NO: 10062 - DNA, 40 bp, Artificial Sequence
  PCR primer for ORF amplification
caggagctgcacttccccagaaagcaccgtttcccgtccg

SEQ ID NO: 10063 - DNA, 40 bp, Artificial Sequence
  PCR primer for ORF amplification
caggagctgcacttccaaaaagggagggaaaaaaatttcg

SEQ ID NO: 10064 - DNA, 40 bp, Artificial Sequence
  PCR primer for ORF amplification
caggagctgcacttccgaatctttgtaaacctctttgtct

SEQ ID NO: 10065 - DNA, 40 bp, Artificial Sequence
  PCR primer for ORF amplification
caggagctgcacttccaaatcgctccacaatggtctcgcc

SEQ ID NO: 10066 - DNA, 40 bp, Artificial Sequence
  PCR primer for ORF amplification
caggagctgcacttcccactgacgcatgattaaaacgaat

SEQ ID NO: 10067 - DNA, 40 bp, Artificial Sequence
  PCR primer for ORF amplification
caggagctgcacttcccagtacaaggatctgagtgttaga

SEQ ID NO: 10068 - DNA, 40 bp, Artificial Sequence
  PCR primer for ORF amplification
caggagctgcacttcccattatcaatccttgcatttcagc

SEQ ID NO: 10069 - DNA, 40 bp, Artificial Sequence
  PCR primer for ORF amplification
caggagctgcacttccgtttccgacgaattgagctgaagc

SEQ ID NO: 10070 - DNA, 40 bp, Artificial Sequence
  PCR primer for ORF amplification
caggagctgcacttcctgtttgccgtccgtttaaataatt

SEQ ID NO: 10071 - DNA, 40 bp, Artificial Sequence
  PCR primer for ORF amplification
caggagctgcacttccgtgattaactggtttcctttcaga

SEQ ID NO: 10072 - DNA, 40 bp, Artificial Sequence
  PCR primer for ORF amplification
caggagctgcacttcccggccaaactatgttggtatcact

SEQ ID NO: 10073 - DNA, 40 bp, Artificial Sequence
  PCR primer for ORF amplification
caggagctgcacttccacctatataaattttcttacattt

SEQ ID NO: 10074 - DNA, 40 bp, Artificial Sequence
  PCR primer for ORF amplification
caggagctgcacttcctaatttagaaataaataatctaga

SEQ ID NO: 10075 - DNA, 40 bp, Artificial Sequence
  PCR primer for ORF amplification
caggagctgcacttcccaggatgtcgccgcgtatgtcgct

SEQ ID NO: 10076 - DNA, 40 bp, Artificial Sequence
  PCR primer for ORF amplification
caggagctgcacttccaggttgccgagtaaacggtttgta

SEQ ID NO: 10077 - DNA, 40 bp, Artificial Sequence
  PCR primer for ORF amplification
caggagctgcacttccaaaaaaaaacaacgaaaaaattga

SEQ ID NO: 10078 - DNA, 40 bp, Artificial Sequence
  PCR primer for ORF amplification
caggagctgcacttccatgatatagaaatagtggactatt

SEQ ID NO: 10079 - DNA, 40 bp, Artificial Sequence
  PCR primer for ORF amplification
caggagctgcacttcctttaaacggcactcctaaaaaatt

SEQ ID NO: 10080 - DNA, 40 bp, Artificial Sequence
  PCR primer for ORF amplification
caggagctgcacttccgtttctgccgtgcttgtttgagaa

SEQ ID NO: 10081 - DNA, 40 bp, Artificial Sequence
  PCR primer for ORF amplification
caggagctgcacttccagatatgagaacaatgagaaaagg

SEQ ID NO: 10082 - DNA, 40 bp, Artificial Sequence
  PCR primer for ORF amplification
caggagctgcacttcccgggccgtcacaagcgcaccggag

SEQ ID NO: 10083 - DNA, 40 bp, Artificial Sequence
  PCR primer for ORF amplification
caggagctgcacttcccaactggtaatatatagatgaata

SEQ ID NO: 10084 - DNA, 40 bp, Artificial Sequence
  PCR primer for ORF amplification
caggagctgcacttccaatatcagctggagccagccgtct

SEQ ID NO: 10085 - DNA, 40 bp, Artificial Sequence
  PCR primer for ORF amplification
caggagctgcacttcctttccattgctttttcaccaaatg

SEQ ID NO: 10086 - DNA, 40 bp, Artificial Sequence
  PCR primer for ORF amplification
caggagctgcacttcccttaaatggaatgcaacaacaaaa

SEQ ID NO: 10087 - DNA, 40 bp, Artificial Sequence
  PCR primer for ORF amplification
caggagctgcacttccaaaaacgtcacaacataggttaat

SEQ ID NO: 10088 - DNA, 40 bp, Artificial Sequence
  PCR primer for ORF amplification
caggagctgcacttccgtatacggtgtaaaatagtataac

SEQ ID NO: 10089 - DNA, 40 bp, Artificial Sequence
  PCR primer for ORF amplification
caggagctgcacttccccttttataaatcttgcataggaa

SEQ ID NO: 10090 - DNA, 40 bp, Artificial Sequence
  PCR primer for ORF amplification
caggagctgcacttcccagagtccagggcacaagggtctt

SEQ ID NO: 10091 - DNA, 40 bp, Artificial Sequence
  PCR primer for ORF amplification
caggagctgcacttccctgcacgtatttcgattgagctgc

SEQ ID NO: 10092 - DNA, 40 bp, Artificial Sequence
  PCR primer for ORF amplification
caggagctgcacttcccaaaacaaaagggccttgaaaaaa

SEQ ID NO: 10093 - DNA, 40 bp, Artificial Sequence
  PCR primer for ORF amplification
caggagctgcacttccagttttaacgaaggaatctaacct

SEQ ID NO: 10094 - DNA, 40 bp, Artificial Sequence
  PCR primer for ORF amplification
caggagctgcacttccgctatagaaacgcgtagcaccggc

SEQ ID NO: 10095 - DNA, 40 bp, Artificial Sequence
  PCR primer for ORF amplification
caggagctgcacttccgctaaagatcgtacaaacaagtgc

SEQ ID NO: 10096 - DNA, 40 bp, Artificial Sequence
  PCR primer for ORF amplification
caggagctgcacttccgaaactgatcttggtgctcacgct

SEQ ID NO: 10097 - DNA, 40 bp, Artificial Sequence
  PCR primer for ORF amplification
caggagctgcacttccggtgtggcagccgtacatatggaa

SEQ ID NO: 10098 - DNA, 40 bp, Artificial Sequence
  PCR primer for ORF amplification
caggagctgcacttcccaacctcatttctacattaaaaca

SEQ ID NO: 10099 - DNA, 40 bp, Artificial Sequence
  PCR primer for ORF amplification
caggagctgcacttccgcctgtcctatcgctaataaaata

SEQ ID NO: 10100 - DNA, 40 bp, Artificial Sequence
  PCR primer for ORF amplification
caggagctgcacttcctatataaacgttacagggcgtgtg

SEQ ID NO: 10101 - DNA, 40 bp, Artificial Sequence
  PCR primer for ORF amplification
caggagctgcacttccgaaagagtagtattcagccaaatg

SEQ ID NO: 10102 - DNA, 40 bp, Artificial Sequence
  PCR primer for ORF amplification
caggagctgcacttccgtactgatgaagtgagagatgggc

SEQ ID NO: 10103 - DNA, 40 bp, Artificial Sequence
  PCR primer for ORF amplification
caggagctgcacttccatcttgtaggacaatgtacaaggc

SEQ ID NO: 10104 - DNA, 40 bp, Artificial Sequence
  PCR primer for ORF amplification
caggagctgcacttccgtatatttcgtcatttcggtactg

SEQ ID NO: 10105 - DNA, 40 bp, Artificial Sequence
  PCR primer for ORF amplification
caggagctgcacttccgaaagccgggtaaggtgtgacagc

SEQ ID NO: 10106 - DNA, 40 bp, Artificial Sequence
  PCR primer for ORF amplification
caggagctgcacttccagtctcagaagtgatacaattttt

SEQ ID NO: 10107 - DNA, 40 bp, Artificial Sequence
  PCR primer for ORF amplification
caggagctgcacttcctctgaatttgttgaaaccaatgtc

SEQ ID NO: 10108 - DNA, 40 bp, Artificial Sequence
  PCR primer for ORF amplification
caggagctgcacttcctctgtacttgtggaaaccaatgtc

SEQ ID NO: 10109 - DNA, 40 bp, Artificial Sequence
  PCR primer for ORF amplification
caggagctgcacttccacaatcatttttatgtttgtaaac

SEQ ID NO: 10110 - DNA, 40 bp, Artificial Sequence
  PCR primer for ORF amplification
caggagctgcacttccaattaattcatttacaatcagagt

SEQ ID NO: 10111 - DNA, 40 bp, Artificial Sequence
  PCR primer for ORF amplification
caggagctgcacttccaaatgcaggggcggggtgacccgc

SEQ ID NO: 10112 - DNA, 40 bp, Artificial Sequence
  PCR primer for ORF amplification
caggagctgcacttcctgaggggcacttattgttgtagat

SEQ ID NO: 10113 - DNA, 40 bp, Artificial Sequence
  PCR primer for ORF amplification
caggagctgcacttccttggcctggtaccaaaccaaatct

SEQ ID NO: 10114 - DNA, 40 bp, Artificial Sequence
  PCR primer for ORF amplification
caggagctgcacttcctgttactagtatattatcatatac

SEQ ID NO: 10115 - DNA, 40 bp, Artificial Sequence
  PCR primer for ORF amplification
caggagctgcacttccaatcaaaaaggccaaagcaccagc

SEQ ID NO: 10116 - DNA, 40 bp, Artificial Sequence
  PCR primer for ORF amplification
caggagctgcacttccgttctcttgctttttcctctcagc

SEQ ID NO: 10117 - DNA, 40 bp, Artificial Sequence
  PCR primer for ORF amplification
caggagctgcacttcctttcttggcagcagccaaagcctt

SEQ ID NO: 10118 - DNA, 40 bp, Artificial Sequence
  PCR primer for ORF amplification
caggagctgcacttcctttatcattttttttcttactctt

SEQ ID NO: 10119 - DNA, 40 bp, Artificial Sequence
  PCR primer for ORF amplification
caggagctgcacttccatcaacttccacaaactttccacc

SEQ ID NO: 10120 - DNA, 40 bp, Artificial Sequence
  PCR primer for ORF amplification
caggagctgcacttccaacacttggtaacggagacagtaa

SEQ ID NO: 10121 - DNA, 40 bp, Artificial Sequence
  PCR primer for ORF amplification
caggagctgcacttcctgccttcttggctttgatacctct

SEQ ID NO: 10122 - DNA, 40 bp, Artificial Sequence
  PCR primer for ORF amplification
caggagctgcacttcctgcattaaatatggctcggtcaga

SEQ ID NO: 10123 - DNA, 40 bp, Artificial Sequence
  PCR primer for ORF amplification
caggagctgcacttccatggtggatgcatctaataatgta

SEQ ID NO: 10124 - DNA, 40 bp, Artificial Sequence
  PCR primer for ORF amplification
caggagctgcacttcctttcccagagcagcatgacttctt

SEQ ID NO: 10125 - DNA, 40 bp, Artificial Sequence
  PCR primer for ORF amplification
caggagctgcacttccaatcaaaaaggccaaagcaccacc

SEQ ID NO: 10126 - DNA, 40 bp, Artificial Sequence
  PCR primer for ORF amplification
caggagctgcacttcctagattggtatgaaaaattttttt

SEQ ID NO: 10127 - DNA, 40 bp, Artificial Sequence
  PCR primer for ORF amplification
caggagctgcacttcctaattgtggggccaacatgtccat

SEQ ID NO: 10128 - DNA, 40 bp, Artificial Sequence
  PCR primer for ORF amplification
caggagctgcacttccgaggctcattcgattgtgtgtttt

SEQ ID NO: 10129 - DNA, 40 bp, Artificial Sequence
  PCR primer for ORF amplification
caggagctgcacttccgttcgcactgttcgtggttgaatc

SEQ ID NO: 10130 - DNA, 40 bp, Artificial Sequence
  PCR primer for ORF amplification
caggagctgcacttccccttctgttcataatacagtttat

SEQ ID NO: 10131 - DNA, 40 bp, Artificial Sequence
  PCR primer for ORF amplification
caggagctgcacttccttttgttattggagtgggttcaga

SEQ ID NO: 10132 - DNA, 40 bp, Artificial Sequence
  PCR primer for ORF amplification
caggagctgcacttccgttaatattatgaatgaatcttga

SEQ ID NO: 10133 - DNA, 40 bp, Artificial Sequence
  PCR primer for ORF amplification
caggagctgcacttcctcttagcttgagcagcttttttga

SEQ ID NO: 10134 - DNA, 40 bp, Artificial Sequence
  PCR primer for ORF amplification
caggagctgcacttccgctacgtctgaccgaatacttttc

SEQ ID NO: 10135 - DNA, 40 bp, Artificial Sequence
  PCR primer for ORF amplification
caggagctgcacttcctgggtaaatggcacagggtataga

SEQ ID NO: 10136 - DNA, 40 bp, Artificial Sequence
  PCR primer for ORF amplification
caggagctgcacttccgaggcaagatatggttctgtaaga

SEQ ID NO: 10137 - DNA, 40 bp, Artificial Sequence
  PCR primer for ORF amplification
caggagctgcacttccgtgcgtagtgtgagtgccactagt

SEQ ID NO: 10138 - DNA, 40 bp, Artificial Sequence
  PCR primer for ORF amplification
caggagctgcacttcccatcaacaggctttcggacgactg

SEQ ID NO: 10139 - DNA, 40 bp, Artificial Sequence
  PCR primer for ORF amplification
caggagctgcacttccataatataatctcatataaactcc

SEQ ID NO: 10140 - DNA, 40 bp, Artificial Sequence
  PCR primer for ORF amplification
caggagctgcacttccaagagaaaaaaaaataaatagcgg

SEQ ID NO: 10141 - DNA, 40 bp, Artificial Sequence
  PCR primer for ORF amplification
caggagctgcacttcctttcttaccagattttttgatacc

SEQ ID NO: 10142 - DNA, 40 bp, Artificial Sequence
  PCR primer for ORF amplification
caggagctgcacttcctaggatatagctgattagttgcaa

SEQ ID NO: 10143 - DNA, 40 bp, Artificial Sequence
  PCR primer for ORF amplification
caggagctgcacttccattggcggcatactctttcttgac

SEQ ID NO: 10144 - DNA, 40 bp, Artificial Sequence
  PCR primer for ORF amplification
caggagctgcacttccaaaaattagtggaagctgataaaa

SEQ ID NO: 10145 - DNA, 40 bp, Artificial Sequence
  PCR primer for ORF amplification
caggagctgcacttccgaataagaaagcgacaccggcagc

SEQ ID NO: 10146 - DNA, 40 bp, Artificial Sequence
  PCR primer for ORF amplification
caggagctgcacttccgtcatccatcagcggaaaaaatgg

SEQ ID NO: 10147 - DNA, 40 bp, Artificial Sequence
  PCR primer for ORF amplification
caggagctgcacttccaatgaaaatctcgtcgaaatgcct

SEQ ID NO: 10148 - DNA, 40 bp, Artificial Sequence
  PCR primer for ORF amplification
caggagctgcacttcctgcttttcttgccttactaaagaa

SEQ ID NO: 10149 - DNA, 40 bp, Artificial Sequence
  PCR primer for ORF amplification
caggagctgcacttccaatttgatataaaactaaaggaac

SEQ ID NO: 10150 - DNA, 40 bp, Artificial Sequence
  PCR primer for ORF amplification
caggagctgcacttccattccaattcgaggcatatccaga

SEQ ID NO: 10151 - DNA, 40 bp, Artificial Sequence
  PCR primer for ORF amplification
caggagctgcacttccaaacctggtgtatgatcgttgaga

SEQ ID NO: 10152 - DNA, 40 bp, Artificial Sequence
  PCR primer for ORF amplification
caggagctgcacttccacgcaaacgacgagcttcacgttc

SEQ ID NO: 10153 - DNA, 40 bp, Artificial Sequence; identical to SEQ ID NO: 10152
  PCR primer for ORF amplification

SEQ ID NO: 10154 - DNA, 40 bp, Artificial Sequence
  PCR primer for ORF amplification
caggagctgcacttcccaacagagacaaagagttttttct

SEQ ID NO: 10155 - DNA, 40 bp, Artificial Sequence
  PCR primer for ORF amplification
caggagctgcacttccatatggcgcacacaccgtgttacg

SEQ ID NO: 10156 - DNA, 40 bp, Artificial Sequence
  PCR primer for ORF amplification
caggagctgcacttccctccttcttatgccccgccccttt

SEQ ID NO: 10157 - DNA, 40 bp, Artificial Sequence
  PCR primer for ORF amplification
caggagctgcacttccgttggaagtattcttaccaatgtc

SEQ ID NO: 10158 - DNA, 40 bp, Artificial Sequence
  PCR primer for ORF amplification
caggagctgcacttccttcatctttactacttgcgaacat

SEQ ID NO: 10159 - DNA, 40 bp, Artificial Sequence
  PCR primer for ORF amplification
caggagctgcacttccaatctttttacttaaagcatcctt

SEQ ID NO: 10160 - DNA, 40 bp, Artificial Sequence
  PCR primer for ORF amplification
caggagctgcacttcctaacccacacaccgcatttaggac

SEQ ID NO: 10161 - DNA, 40 bp, Artificial Sequence
  PCR primer for ORF amplification
caggagctgcacttcctcggtgatagaaatctttcttttt

SEQ ID NO: 10162 - DNA, 40 bp, Artificial Sequence
  PCR primer for ORF amplification
caggagctgcacttcctcttctcgtcttttcggcttttaa

SEQ ID NO: 10163 - DNA, 40 bp, Artificial Sequence
  PCR primer for ORF amplification
caggagctgcacttcccgcatcttgcttttccgaatgttt

SEQ ID NO: 10164 - DNA, 40 bp, Artificial Sequence
  PCR primer for ORF amplification
caggagctgcacttccttgcgtttttccaagcatctgctc

SEQ ID NO: 10165 - DNA, 40 bp, Artificial Sequence
  PCR primer for ORF amplification
caggagctgcacttcctttttggctggaactttttgccaa

SEQ ID NO: 10166 - DNA, 40 bp, Artificial Sequence
  PCR primer for ORF amplification
caggagctgcacttccatttgcacttggaacttcgaagcc

SEQ ID NO: 10167 - DNA, 40 bp, Artificial Sequence
  PCR primer for ORF amplification
caggagctgcacttccacatttttcacaattgcatttact

SEQ ID NO: 10168 - DNA, 40 bp, Artificial Sequence
  PCR primer for ORF amplification
caggagctgcacttcccaaatgagtcttctgctttatgcg

SEQ ID NO: 10169 - DNA, 40 bp, Artificial Sequence
  PCR primer for ORF amplification
caggagctgcacttccctcgaagttaggtcgcccaaccct

SEQ ID NO: 10170 - DNA, 40 bp, Artificial Sequence
  PCR primer for ORF amplification
caggagctgcacttcccaaaggataaatctcttggtttgc

SEQ ID NO: 10171 - DNA, 40 bp, Artificial Sequence
  PCR primer for ORF amplification
caggagctgcacttccaataagtgttaactttagggaaaa

SEQ ID NO: 10172 - DNA, 40 bp, Artificial Sequence
  PCR primer for ORF amplification
caggagctgcacttccatctcttttttctaatgggttgta

SEQ ID NO: 10173 - DNA, 40 bp, Artificial Sequence
  PCR primer for ORF amplification
caggagctgcacttcccttggctgtacgcaagaaatccaa

SEQ ID NO: 10174 - DNA, 40 bp, Artificial Sequence
  PCR primer for ORF amplification
caggagctgcacttccgtgtatatttgctagaaagaaaca

SEQ ID NO: 10175 - DNA, 40 bp, Artificial Sequence
  PCR primer for ORF amplification
caggagctgcacttccactcccttggggtttactttccgg

SEQ ID NO: 10176 - DNA, 40 bp, Artificial Sequence
  PCR primer for ORF amplification
caggagctgcacttccctcggtaggaggtgcagtaggact

SEQ ID NO: 10177 - DNA, 40 bp, Artificial Sequence
  PCR primer for ORF amplification
caggagctgcacttcctctagcttcaaattgaaccaatct

SEQ ID NO: 10178 - DNA, 40 bp, Artificial Sequence
  PCR primer for ORF amplification
caggagctgcacttcccgaccttaatggctttacaattat

SEQ ID NO: 10179 - DNA, 40 bp, Artificial Sequence
  PCR primer for ORF amplification
caggagctgcacttccgataagaaagactgagcctatata

SEQ ID NO: 10180 - DNA, 40 bp, Artificial Sequence
  PCR primer for ORF amplification
caggagctgcacttccaaaattagcaacgcctacaattcg

SEQ ID NO: 10181 - DNA, 40 bp, Artificial Sequence
  PCR primer for ORF amplification
caggagctgcacttccaagaggtggcttcttgttattggt

SEQ ID NO: 10182 - DNA, 40 bp, Artificial Sequence
  PCR primer for ORF amplification
caggagctgcacttccctgattttcttcttcatccatagg

SEQ ID NO: 10183 - DNA, 40 bp, Artificial Sequence
  PCR primer for ORF amplification
caggagctgcacttcctggtttgcttcgtgaagataatct

SEQ ID NO: 10184 - DNA, 40 bp, Artificial Sequence
  PCR primer for ORF amplification
caggagctgcacttccgctgttaaattgactgatggccat

SEQ ID NO: 10185 - DNA, 40 bp, Artificial Sequence
  PCR primer for ORF amplification
caggagctgcacttccaatttttttctcattttggtatat

SEQ ID NO: 10186 - DNA, 40 bp, Artificial Sequence
  PCR primer for ORF amplification
caggagctgcacttcccaggtaatacagctccaaatttgt

SEQ ID NO: 10187 - DNA, 40 bp, Artificial Sequence
  PCR primer for ORF amplification
caggagctgcacttcctccggaagttttcgcggaccccac

SEQ ID NO: 10188 - DNA, 40 bp, Artificial Sequence
  PCR primer for ORF amplification
caggagctgcacttcccaattgtttgccagatctaacttc

SEQ ID NO: 10189 - DNA, 40 bp, Artificial Sequence
  PCR primer for ORF amplification
caggagctgcacttcccttttttctcgagaagaagtttcc

SEQ ID NO: 10190 - DNA, 40 bp, Artificial Sequence
  PCR primer for ORF amplification
caggagctgcacttcccaatatccgctgtcttggaaagca

SEQ ID NO: 10191 - DNA, 40 bp, Artificial Sequence
  PCR primer for ORF amplification
caggagctgcacttcccaactttggcgcgtgagccaagtg

SEQ ID NO: 10192 - DNA, 40 bp, Artificial Sequence
  PCR primer for ORF amplification
caggagctgcacttccactattggtatatgtgtccgtgac

SEQ ID NO: 10193 - DNA, 40 bp, Artificial Sequence
  PCR primer for ORF amplification
caggagctgcacttccatcgtttgacatagaatgccaaag

SEQ ID NO: 10194 - DNA, 40 bp, Artificial Sequence
  PCR primer for ORF amplification
caggagctgcacttccaacttttttctttttatcgctgcg

SEQ ID NO: 10195 - DNA, 40 bp, Artificial Sequence
  PCR primer for ORF amplification
caggagctgcacttccttcaagaaattcaactggttcgtt

SEQ ID NO: 10196 - DNA, 40 bp, Artificial Sequence
  PCR primer for ORF amplification
caggagctgcacttccatttgtatgaacttctttgtcttc

SEQ ID NO: 10197 - DNA, 40 bp, Artificial Sequence
  PCR primer for ORF amplification
caggagctgcacttccgttatcgcataccaattctaataa

SEQ ID NO: 10198 - DNA, 40 bp, Artificial Sequence
  PCR primer for ORF amplification
caggagctgcacttccacagtatacgactcccaacacacg

SEQ ID NO: 10199 - DNA, 40 bp, Artificial Sequence
  PCR primer for ORF amplification
caggagctgcacttccttgagcgctggtatatacagctaa

SEQ ID NO: 10200 - DNA, 40 bp, Artificial Sequence
  PCR primer for ORF amplification
caggagctgcacttccccgactcattttgttaagcttgtc

SEQ ID NO: 10201 - DNA, 40 bp, Artificial Sequence
  PCR primer for ORF amplification
caggagctgcacttccagttttcttgaaagttaatgtagt

SEQ ID NO: 10202 - DNA, 40 bp, Artificial Sequence
  PCR primer for ORF amplification
caggagctgcacttcctacaccgaataataataagaatga

SEQ ID NO: 10203 - DNA, 40 bp, Artificial Sequence
  PCR primer for ORF amplification
caggagctgcacttccacaataagcttctgtacgagggtc

SEQ ID NO: 10204 - DNA, 40 bp, Artificial Sequence
  PCR primer for ORF amplification
caggagctgcacttccctccgtctcgttaaagaatatctt

SEQ ID NO: 10205 - DNA, 40 bp, Artificial Sequence
  PCR primer for ORF amplification
caggagctgcacttccccatacaagtttgccgtccaaaat

SEQ ID NO: 10206 - DNA, 40 bp, Artificial Sequence
  PCR primer for ORF amplification
caggagctgcacttccgtcttcctttttattaccatcaac

SEQ ID NO: 10207 - DNA, 40 bp, Artificial Sequence
  PCR primer for ORF amplification
caggagctgcacttcctatggcatctagagcctctaggga

SEQ ID NO: 10208 - DNA, 40 bp, Artificial Sequence
  PCR primer for ORF amplification
caggagctgcacttcccatcaatgtatagtaactaccgga

SEQ ID NO: 10209 - DNA, 40 bp, Artificial Sequence
  PCR primer for ORF amplification
caggagctgcacttcccaattttcgagattcttttgaatc

SEQ ID NO: 10210 - DNA, 40 bp, Artificial Sequence
  PCR primer for ORF amplification
caggagctgcacttcccagtttaccaaatttttccgtcat

SEQ ID NO: 10211 - DNA, 40 bp, Artificial Sequence
  PCR primer for ORF amplification
caggagctgcacttcctaatctgttaaccttcaaagttgg

SEQ ID NO: 10212 - DNA, 40 bp, Artificial Sequence
  PCR primer for ORF amplification
caggagctgcacttccctttttcctttcatttttcaaagc

SEQ ID NO: 10213 - DNA, 40 bp, Artificial Sequence
  PCR primer for ORF amplification
caggagctgcacttccaaaagcacctgactttttcaattg

SEQ ID NO: 10214 - DNA, 40 bp, Artificial Sequence
  PCR primer for ORF amplification
caggagctgcacttccgagacctttggttactggcaattt

SEQ ID NO: 10215 - DNA, 40 bp, Artificial Sequence
  PCR primer for ORF amplification
caggagctgcacttccgaataagaaggcaacaccggcagc

SEQ ID NO: 10216 - DNA, 40 bp, Artificial Sequence
  PCR primer for ORF amplification
caggagctgcacttcctgctaaactaccatagttatcatc

SEQ ID NO: 10217 - DNA, 40 bp, Artificial Sequence
  PCR primer for ORF amplification
caggagctgcacttccatgtatattcgtcagttcagggtg

SEQ ID NO: 10218 - DNA, 40 bp, Artificial Sequence
  PCR primer for ORF amplification
caggagctgcacttccttttttcatgttttcgtaagtctt

SEQ ID NO: 10219 - DNA, 40 bp, Artificial Sequence
  PCR primer for ORF amplification
caggagctgcacttcctttcctttggcatctattgtttgc

SEQ ID NO: 10220 - DNA, 40 bp, Artificial Sequence
  PCR primer for ORF amplification
caggagctgcacttccaaggaagcaatactttagtatacc

SEQ ID NO: 10221 - DNA, 40 bp, Artificial Sequence
  PCR primer for ORF amplification
caggagctgcacttccccgtgaagtatatgtaagggtctt

SEQ ID NO: 10222 - DNA, 40 bp, Artificial Sequence
  PCR primer for ORF amplification
caggagctgcacttccaacaataacgtatctgattggaat

SEQ ID NO: 10223 - DNA, 40 bp, Artificial Sequence
  PCR primer for ORF amplification
caggagctgcacttccttcgtacccggattcataattgtc

SEQ ID NO: 10224 - DNA, 40 bp, Artificial Sequence
  PCR primer for ORF amplification
caggagctgcacttcccatatccatcagaagaagccctac

SEQ ID NO: 10225 - DNA, 40 bp, Artificial Sequence
  PCR primer for ORF amplification
caggagctgcacttccggcagcagcggcaataggctcagg

SEQ ID NO: 10226 - DNA, 40 bp, Artificial Sequence
  PCR primer for ORF amplification
caggagctgcacttccaaataacttaccggcaactttaga

SEQ ID NO: 10227 - DNA, 40 bp, Artificial Sequence
  PCR primer for ORF amplification
caggagctgcacttccgtctgagttgatatcacctgcgaa

SEQ ID NO: 10228 - DNA, 40 bp, Artificial Sequence
  PCR primer for ORF amplification
caggagctgcacttccttccttttggacgttttcaaactt

SEQ ID NO: 10229 - DNA, 40 bp, Artificial Sequence
  PCR primer for ORF amplification
caggagctgcacttcctttcgtaaagttgaaagataaata

SEQ ID NO: 10230 - DNA, 40 bp, Artificial Sequence
  PCR primer for ORF amplification
caggagctgcacttcctatctgttggtttgtcaagttgct

SEQ ID NO: 10231 - DNA, 40 bp, Artificial Sequence
  PCR primer for ORF amplification
caggagctgcacttccaataccggtgcctaggacgaaaga

SEQ ID NO: 10232 - DNA, 40 bp, Artificial Sequence
  PCR primer for ORF amplification
caggagctgcacttccctggtctcctttcaatctgtttgt

SEQ ID NO: 10233 - DNA, 40 bp, Artificial Sequence
  PCR primer for ORF amplification
caggagctgcacttcctttagagttcttcttacctttttc

SEQ ID NO: 10234 - DNA, 40 bp, Artificial Sequence
  PCR primer for ORF amplification
caggagctgcacttcctgccttcttcttggcttcgtactc

SEQ ID NO: 10235 - DNA, 40 bp, Artificial Sequence
  PCR primer for ORF amplification
caggagctgcacttcctttttccaacacattactggatct

SEQ ID NO: 10236 - DNA, 40 bp, Artificial Sequence
  PCR primer for ORF amplification
caggagctgcacttccagcctggccggccaaatccaaaag

SEQ ID NO: 10237 - DNA, 40 bp, Artificial Sequence
  PCR primer for ORF amplification
caggagctgcacttcctttggtcatcgagtcaattttatt

SEQ ID NO: 10238 - DNA, 40 bp, Artificial Sequence
  PCR primer for ORF amplification
caggagctgcacttccgaagccatctaatacactatataa

SEQ ID NO: 10239 - DNA, 40 bp, Artificial Sequence
  PCR primer for ORF amplification
caggagctgcacttccgatgtggtattgttgcaaatcaga

SEQ ID NO: 10240 - DNA, 40 bp, Artificial Sequence
  PCR primer for ORF amplification
caggagctgcacttccgttcggcagctccctgatgtacag

SEQ ID NO: 10241 - DNA, 40 bp, Artificial Sequence
  PCR primer for ORF amplification
caggagctgcacttccatcttttttaaagcggtctcctag

SEQ ID NO: 10242 - DNA, 40 bp, Artificial Sequence
  PCR primer for ORF amplification
caggagctgcacttcctttgtcaacttcttttagtttgcc

SEQ ID NO: 10243 - DNA, 40 bp, Artificial Sequence
  PCR primer for ORF amplification
caggagctgcacttccgtcgatggttctcttctccactat

SEQ ID NO: 10244 - DNA, 40 bp, Artificial Sequence
  PCR primer for ORF amplification
caggagctgcacttcctattttttgttcactgatatacat

SEQ ID NO: 10245 - DNA, 40 bp, Artificial Sequence
  PCR primer for ORF amplification
caggagctgcacttccctttgaaaggttattaattttgtt

SEQ ID NO: 10246 - DNA, 40 bp, Artificial Sequence
  PCR primer for ORF amplification
caggagctgcacttccaaaaacatactgtgtgtttatggg

SEQ ID NO: 10247 - DNA, 40 bp, Artificial Sequence
  PCR primer for ORF amplification
caggagctgcacttccattataaaaactctgaagtaatag

SEQ ID NO: 10248 - DNA, 40 bp, Artificial Sequence
  PCR primer for ORF amplification
caggagctgcacttcctcggcccaagccttgtcccaaggc

SEQ ID NO: 10249 - DNA, 40 bp, Artificial Sequence
  PCR primer for ORF amplification
caggagctgcacttcctacaaagtgttcaatgaacctact

SEQ ID NO: 10250 - DNA, 40 bp, Artificial Sequence
  PCR primer for ORF amplification
caggagctgcacttccgatttggctacctgcatttccaat

SEQ ID NO: 10251 - DNA, 40 bp, Artificial Sequence
  PCR primer for ORF amplification
caggagctgcacttccagaggagtacttggcaatcagttg

SEQ ID NO: 10252 - DNA, 40 bp, Artificial Sequence
  PCR primer for ORF amplification
caggagctgcacttcctacttttacgtgctccgatacagt

SEQ ID NO: 10253 - DNA, 40 bp, Artificial Sequence
  PCR primer for ORF amplification
caggagctgcacttccacgggtgttttgcaacccgttcac

SEQ ID NO: 10254 - DNA, 40 bp, Artificial Sequence
  PCR primer for ORF amplification
caggagctgcacttccaacaatattagccatcaattcaac

SEQ ID NO: 10255 - DNA, 40 bp, Artificial Sequence
  PCR primer for ORF amplification
caggagctgcacttcctataatgtgtgtaaatttcgtcaa

SEQ ID NO: 10256 - DNA, 40 bp, Artificial Sequence
  PCR primer for ORF amplification
caggagctgcacttccagagtggaaaaaaataatagtgat

SEQ ID NO: 10257 - DNA, 40 bp, Artificial Sequence
  PCR primer for ORF amplification
caggagctgcacttccctgattttcccgtttgtatctatc

SEQ ID NO: 10258 - DNA, 40 bp, Artificial Sequence
  PCR primer for ORF amplification
caggagctgcacttcctatctccactgcgccatcgtcatc

SEQ ID NO: 10259 - DNA, 40 bp, Artificial Sequence
  PCR primer for ORF amplification
caggagctgcacttccttgactatccagaaaagcctgcgt

SEQ ID NO: 10260 - DNA, 40 bp, Artificial Sequence
  PCR primer for ORF amplification
caggagctgcacttccttcttgagtaactctttcctgtag

SEQ ID NO: 10261 - DNA, 40 bp, Artificial Sequence
  PCR primer for ORF amplification
caggagctgcacttccctgtcgagggttccagcatgaacg

SEQ ID NO: 10262 - DNA, 40 bp, Artificial Sequence
  PCR primer for ORF amplification
caggagctgcacttccgttggctttcgtatcctgcctcgt

SEQ ID NO: 10263 - DNA, 40 bp, Artificial Sequence
  PCR primer for ORF amplification
caggagctgcacttcctttgttcttggtttgagtatagct

SEQ ID NO: 10264 - DNA, 40 bp, Artificial Sequence
  PCR primer for ORF amplification
caggagctgcacttcctaacaacatagcagcagcagctag

SEQ ID NO: 10265 - DNA, 40 bp, Artificial Sequence
  PCR primer for ORF amplification
caggagctgcacttcctttcatttttcttttacccttgcc

SEQ ID NO: 10266 - DNA, 40 bp, Artificial Sequence
  PCR primer for ORF amplification
caggagctgcacttccccagccttgaattcggctctgtct

SEQ ID NO: 10267 - DNA, 40 bp, Artificial Sequence
  PCR primer for ORF amplification
caggagctgcacttcccaacgcctccgtaggggtcttttt

SEQ ID NO: 10268 - DNA, 40 bp, Artificial Sequence
  PCR primer for ORF amplification
caggagctgcacttccgtatctttttcccctgcctccctt

SEQ ID NO: 10269 - DNA, 40 bp, Artificial Sequence
  PCR primer for ORF amplification
caggagctgcacttccagccaaagtggcgttatataactc

SEQ ID NO: 10270 - DNA, 40 bp, Artificial Sequence
  PCR primer for ORF amplification
caggagctgcacttccaaacttaccggctgcgttaaatga

SEQ ID NO: 10271 - DNA, 40 bp, Artificial Sequence
  PCR primer for ORF amplification
caggagctgcacttccataaacaccgtcatctggcctgtt

SEQ ID NO: 10272 - DNA, 40 bp, Artificial Sequence
  PCR primer for ORF amplification
caggagctgcacttccgccttgacgctgtttgtgtttttt

SEQ ID NO: 10273 - DNA, 40 bp, Artificial Sequence
  PCR primer for ORF amplification
caggagctgcacttcctttcctagcgaaatacgtcgagga

SEQ ID NO: 10274 - DNA, 40 bp, Artificial Sequence
  PCR primer for ORF amplification
caggagctgcacttcctggttcgctattcaatattagaaa

SEQ ID NO: 10275 - DNA, 40 bp, Artificial Sequence
  PCR primer for ORF amplification
caggagctgcacttcccttcgttttcgattgagataaagt

SEQ ID NO: 10276 - DNA, 40 bp, Artificial Sequence
  PCR primer for ORF amplification
caggagctgcacttccgtgttttcttccttgcaatggttc

SEQ ID NO: 10277 - DNA, 40 bp, Artificial Sequence
  PCR primer for ORF amplification
caggagctgcacttcctttagaattgctacccaaagactc

SEQ ID NO: 10278 - DNA, 40 bp, Artificial Sequence
  PCR primer for ORF amplification
caggagctgcacttcctgctagaacacgcatttgacgacc

SEQ ID NO: 10279 - DNA, 40 bp, Artificial Sequence
  PCR primer for ORF amplification
caggagctgcacttccaacattaactctttccagctcttc

SEQ ID NO: 10280 - DNA, 40 bp, Artificial Sequence
  PCR primer for ORF amplification
caggagctgcacttccgttgggctgcttttgtcgtaagtt

SEQ ID NO: 10281 - DNA, 40 bp, Artificial Sequence
  PCR primer for ORF amplification
caggagctgcacttccgtccgctgatgttatcaatgtgat

SEQ ID NO: 10282 - DNA, 40 bp, Artificial Sequence
  PCR primer for ORF amplification
caggagctgcacttccgtcatactggtcgacattaatttc

SEQ ID NO: 10283 - DNA, 40 bp, Artificial Sequence
  PCR primer for ORF amplification
caggagctgcacttcccatgattgaagagaacatcaaata

SEQ ID NO: 10284 - DNA, 40 bp, Artificial Sequence
  PCR primer for ORF amplification
caggagctgcacttccatcatggggtttaccgttgatcct

SEQ ID NO: 10285 - DNA, 40 bp, Artificial Sequence
  PCR primer for ORF amplification
caggagctgcacttccttctatacggcgtccttcctgttc

SEQ ID NO: 10286 - DNA, 40 bp, Artificial Sequence
  PCR primer for ORF amplification
caggagctgcacttccgagcacattaaataatatgtatat

SEQ ID NO: 10287 - DNA, 40 bp, Artificial Sequence
  PCR primer for ORF amplification
caggagctgcacttcctgttgaagcttccttcagggattc

SEQ ID NO: 10288 - DNA, 40 bp, Artificial Sequence
  PCR primer for ORF amplification
caggagctgcacttccaacagaagaggaaataatggtatt

SEQ ID NO: 10289 - DNA, 40 bp, Artificial Sequence
  PCR primer for ORF amplification
caggagctgcacttcctaaaataaacacaactgtaagggc

SEQ ID NO: 10290 - DNA, 40 bp, Artificial Sequence
  PCR primer for ORF amplification
caggagctgcacttccaaccttcgaggatctgaggccagc

SEQ ID NO: 10291 - DNA, 40 bp, Artificial Sequence
  PCR primer for ORF amplification
caggagctgcacttccactgtcccctggtgtaagctttcg

SEQ ID NO: 10292 - DNA, 40 bp, Artificial Sequence
  PCR primer for ORF amplification
caggagctgcacttccattggttattcctacaggaggaac

SEQ ID NO: 10293 - DNA, 40 bp, Artificial Sequence
  PCR primer for ORF amplification
caggagctgcacttccatgatcttcttgtccatgagactg

SEQ ID NO: 10294 - DNA, 40 bp, Artificial Sequence
  PCR primer for ORF amplification
caggagctgcacttccattaggtttatcttctggtggagt

SEQ ID NO: 10295 - DNA, 40 bp, Artificial Sequence
  PCR primer for ORF amplification
caggagctgcacttcctttattatcggtggcgtcttttat

SEQ ID NO: 10296 - DNA, 40 bp, Artificial Sequence
  PCR primer for ORF amplification
caggagctgcacttcctaactttggctcagaacagatcat

SEQ ID NO: 10297 - DNA, 40 bp, Artificial Sequence
  PCR primer for ORF amplification
caggagctgcacttccgtattcttcagcattagacatctt

SEQ ID NO: 10298 - DNA, 40 bp, Artificial Sequence
  PCR primer for ORF amplification
caggagctgcacttccacgtctagcacccctactcaaaca

SEQ ID NO: 10299 - DNA, 40 bp, Artificial Sequence
  PCR primer for ORF amplification
caggagctgcacttcctgtattatcgttgaaggatagaat

SEQ ID NO: 10300 - DNA, 40 bp, Artificial Sequence
  PCR primer for ORF amplification
caggagctgcacttccagcacgtgtagcattgtacaattc

SEQ ID NO: 10301 - DNA, 40 bp, Artificial Sequence
  PCR primer for ORF amplification
caggagctgcacttccaccaccatgtaatgttgaagtaaa

SEQ ID NO: 10302 - DNA, 40 bp, Artificial Sequence
  PCR primer for ORF amplification
caggagctgcacttcccactcgtggggcccacacgattcc

SEQ ID NO: 10303 - DNA, 40 bp, Artificial Sequence
  PCR primer for ORF amplification
caggagctgcacttcctatactcaaatagtccgccgcaag

SEQ ID NO: 10304 - DNA, 40 bp, Artificial Sequence
  PCR primer for ORF amplification
caggagctgcacttccatctagttctacaaacctactgct

SEQ ID NO: 10305 - DNA, 40 bp, Artificial Sequence
  PCR primer for ORF amplification
caggagctgcacttccaagtattaacatgtaacaacttaa

SEQ ID NO: 10306 - DNA, 40 bp, Artificial Sequence
  PCR primer for ORF amplification
caggagctgcacttccatgattacgattaaccatcaaatc

SEQ ID NO: 10307 - DNA, 40 bp, Artificial Sequence
  PCR primer for ORF amplification
caggagctgcacttccaagtactatatctactgcctttct

SEQ ID NO: 10308 - DNA, 40 bp, Artificial Sequence
  PCR primer for ORF amplification
caggagctgcacttcctaccataaacggtatagtaatgat

SEQ ID NO: 10309 - DNA, 40 bp, Artificial Sequence
  PCR primer for ORF amplification
caggagctgcacttcctttgcgatcgtcccatcgcttctt

SEQ ID NO: 10310 - DNA, 40 bp, Artificial Sequence
  PCR primer for ORF amplification
caggagctgcacttccggaattatcctttcttgatggaga

SEQ ID NO: 10311 - DNA, 40 bp, Artificial Sequence
  PCR primer for ORF amplification
caggagctgcacttccgaaaggcgataataacgaggtaag

SEQ ID NO: 10312 - DNA, 40 bp, Artificial Sequence
  PCR primer for ORF amplification
caggagctgcacttccccttctcttaggtcctcttattgg

SEQ ID NO: 10313 - DNA, 40 bp, Artificial Sequence
  PCR primer for ORF amplification
caggagctgcacttccatgctcttccgcacctttatgatg

SEQ ID NO: 10314 - DNA, 40 bp, Artificial Sequence
  PCR primer for ORF amplification
caggagctgcacttccaaaaaggctttcagttgaagagtt

SEQ ID NO: 10315 - DNA, 40 bp, Artificial Sequence
  PCR primer for ORF amplification
caggagctgcacttccctgcgttgcattctccaaggttcc

SEQ ID NO: 10316 - DNA, 40 bp, Artificial Sequence
  PCR primer for ORF amplification
caggagctgcacttccatacgtagcaccaccaatctgttc

SEQ ID NO: 10317 - DNA, 40 bp, Artificial Sequence
  PCR primer for ORF amplification
caggagctgcacttccgttaccacctcttagtgttaatac

SEQ ID NO: 10318 - DNA, 40 bp, Artificial Sequence
  PCR primer for ORF amplification
caggagctgcacttccacttgggcagcacacatgcaaaac

SEQ ID NO: 10319 - DNA, 40 bp, Artificial Sequence
  PCR primer for ORF amplification
caggagctgcacttccacttgggcagcacacacgcaaaac

SEQ ID NO: 10320 - DNA, 40 bp, Artificial Sequence
  PCR primer for ORF amplification
caggagctgcacttcctaacaaagcaaaggcagcagcacc

SEQ ID NO: 10321 - DNA, 40 bp, Artificial Sequence
  PCR primer for ORF amplification
caggagctgcacttccgttgttgagggctctagcattccc

SEQ ID NO: 10322 - DNA, 40 bp, Artificial Sequence
  PCR primer for ORF amplification
caggagctgcacttcccaaatttttactaagacacgtgta

SEQ ID NO: 10323 - DNA, 40 bp, Artificial Sequence
  PCR primer for ORF amplification
caggagctgcacttccctcaacttgactgccatccctcgg

SEQ ID NO: 10324 - DNA, 40 bp, Artificial Sequence
  PCR primer for ORF amplification
caggagctgcacttccaccaccgaaaccatataaggttct

SEQ ID NO: 10325 - DNA, 40 bp, Artificial Sequence
  PCR primer for ORF amplification
caggagctgcacttccaccaccgaaaccgtataaggttct

SEQ ID NO: 10326 - DNA, 40 bp, Artificial Sequence
  PCR primer for ORF amplification
caggagctgcacttcctatagagtataaacagggcattct

SEQ ID NO: 10327 - DNA, 40 bp, Artificial Sequence
  PCR primer for ORF amplification
caggagctgcacttccagcattagcagcaatggcttgctt

SEQ ID NO: 10328 - DNA, 40 bp, Artificial Sequence
  PCR primer for ORF amplification
caggagctgcacttccgaagtccatttcctcgaccttacc

SEQ ID NO: 10329 - DNA, 40 bp, Artificial Sequence
  PCR primer for ORF amplification
caggagctgcacttccttgagaaattttttttaaaacaac

SEQ ID NO: 10330 - DNA, 40 bp, Artificial Sequence
  PCR primer for ORF amplification
caggagctgcacttccaaacaaaaacttcgtcatcgtcat

SEQ ID NO: 10331 - DNA, 40 bp, Artificial Sequence
  PCR primer for ORF amplification
caggagctgcacttccttcattaaatggccaggaaagtcc

SEQ ID NO: 10332 - DNA, 40 bp, Artificial Sequence
  PCR primer for ORF amplification
caggagctgcacttccctgatttcgttccctctgtttagc

SEQ ID NO: 10333 - DNA, 40 bp, Artificial Sequence
  PCR primer for ORF amplification
caggagctgcacttcctacgttggaagcaatagcttgctt

SEQ ID NO: 10334 - DNA, 40 bp, Artificial Sequence
  PCR primer for ORF amplification
caggagctgcacttcctgaacaacggcgagagtgaacgtc

SEQ ID NO: 10335 - DNA, 40 bp, Artificial Sequence
  PCR primer for ORF amplification
caggagctgcacttcccgtgtatttcttgacggctgcaga

SEQ ID NO: 10336 - DNA, 40 bp, Artificial Sequence
  PCR primer for ORF amplification
caggagctgcacttccgcagacaggtctgtcctggagcca

SEQ ID NO: 10337 - DNA, 40 bp, Artificial Sequence
  PCR primer for ORF amplification
caggagctgcacttccatgagacaaaaaccacctaccttt

SEQ ID NO: 10338 - DNA, 40 bp, Artificial Sequence
  PCR primer for ORF amplification
caggagctgcacttccagggtaaaattccttgtatttgtt

SEQ ID NO: 10339 - DNA, 40 bp, Artificial Sequence
  PCR primer for ORF amplification
caggagctgcacttccgatttcgccagaagcggaggcgtt

SEQ ID NO: 10340 - DNA, 40 bp, Artificial Sequence
  PCR primer for ORF amplification
caggagctgcacttccgttattctcttcgacaaatttctt

SEQ ID NO: 10341 - DNA, 40 bp, Artificial Sequence
  PCR primer for ORF amplification
caggagctgcacttccaagttggctcaagaaattgttttg

SEQ ID NO: 10342 - DNA, 40 bp, Artificial Sequence
  PCR primer for ORF amplification
caggagctgcacttccgtcgaataaaccgaaacccatgtc

SEQ ID NO: 10343 - DNA, 40 bp, Artificial Sequence
  PCR primer for ORF amplification
caggagctgcacttcctttagaatcgagtaattcctgtgc

SEQ ID NO: 10344 - DNA, 40 bp, Artificial Sequence
  PCR primer for ORF amplification
caggagctgcacttccgaatctggtgaaagaagttttttt

SEQ ID NO: 10345 - DNA, 40 bp, Artificial Sequence
  PCR primer for ORF amplification
caggagctgcacttccgtccttggcaatcttagccaggat

SEQ ID NO: 10346 - DNA, 40 bp, Artificial Sequence
  PCR primer for ORF amplification
caggagctgcacttccattcttaccccaggagtagatcca

SEQ ID NO: 10347 - DNA, 40 bp, Artificial Sequence
  PCR primer for ORF amplification
caggagctgcacttccatcaaataaaccgaaacccatgtc

SEQ ID NO: 10348 - DNA, 40 bp, Artificial Sequence
  PCR primer for ORF amplification
caggagctgcacttcctttcttagattctttaaccacctc

SEQ ID NO: 10349 - DNA, 40 bp, Artificial Sequence
  PCR primer for ORF amplification
caggagctgcacttcctgctactttcatattccccattaa

SEQ ID NO: 10350 - DNA, 40 bp, Artificial Sequence
  PCR primer for ORF amplification
caggagctgcacttcctacctttttctttttctcgaaatg

SEQ ID NO: 10351 - DNA, 40 bp, Artificial Sequence
  PCR primer for ORF amplification
caggagctgcacttccttcagaagcagtagctctggtgta

SEQ ID NO: 10352 - DNA, 40 bp, Artificial Sequence
  PCR primer for ORF amplification
caggagctgcacttccttcggaagcagcagctctggtata

SEQ ID NO: 10353 - DNA, 40 bp, Artificial Sequence
  PCR primer for ORF amplification
caggagctgcacttccgtattgcgaatctaccgtgttctc

SEQ ID NO: 10354 - DNA, 40 bp, Artificial Sequence
  PCR primer for ORF amplification
caggagctgcacttcctccgattagggcgtatccaaatgt

SEQ ID NO: 10355 - DNA, 40 bp, Artificial Sequence
  PCR primer for ORF amplification
caggagctgcacttcctattctgccattcaatgcgtgttt

SEQ ID NO: 10356 - DNA, 40 bp, Artificial Sequence
  PCR primer for ORF amplification
caggagctgcacttccgtccttctgctggctgttcagaag

SEQ ID NO: 10357 - DNA, 40 bp, Artificial Sequence
  PCR primer for ORF amplification
caggagctgcacttccaaacccatgaattttaatgttctt

SEQ ID NO: 10358 - DNA, 40 bp, Artificial Sequence
  PCR primer for ORF amplification
caggagctgcacttccctcacaggcttttttcaagtaggt

SEQ ID NO: 10359 - DNA, 40 bp, Artificial Sequence
  PCR primer for ORF amplification
caggagctgcacttccattcttcatcaatgcctttagatt

SEQ ID NO: 10360 - DNA, 40 bp, Artificial Sequence
  PCR primer for ORF amplification
caggagctgcacttccttttgtctttgattcgtacacttt

SEQ ID NO: 10361 - DNA, 40 bp, Artificial Sequence
  PCR primer for ORF amplification
caggagctgcacttccttttttggaatcatcagctatttc

SEQ ID NO: 10362 - DNA, 40 bp, Artificial Sequence
  PCR primer for ORF amplification
caggagctgcacttcccttcttggttgggtcttcttcacc

SEQ ID NO: 10363 - DNA, 40 bp, Artificial Sequence
  PCR primer for ORF amplification
caggagctgcacttccaggcagaagcccgattttagtcaa

SEQ ID NO: 10364 - DNA, 40 bp, Artificial Sequence
  PCR primer for ORF amplification
caggagctgcacttccatcgaataaaccaaaacccatgtc

SEQ ID NO: 10365 - DNA, 40 bp, Artificial Sequence
  PCR primer for ORF amplification
caggagctgcacttcctttttttttcttccccttcccctt

SEQ ID NO: 10366 - DNA, 40 bp, Artificial Sequence
  PCR primer for ORF amplification
caggagctgcacttcccataagcgtacaacaaacactatt

SEQ ID NO: 10367 - DNA, 40 bp, Artificial Sequence
  PCR primer for ORF amplification
caggagctgcacttccctgatttatgacatcgatgaggga

SEQ ID NO: 10368 - DNA, 40 bp, Artificial Sequence
  PCR primer for ORF amplification
caggagctgcacttccattttccttccatctatgaccaca

SEQ ID NO: 10369 - DNA, 40 bp, Artificial Sequence
  PCR primer for ORF amplification
caggagctgcacttccatttgcaagaataggttctaacaa

SEQ ID NO: 10370 - DNA, 40 bp, Artificial Sequence
  PCR primer for ORF amplification
caggagctgcacttcctttcgctttggattcatactcctg

SEQ ID NO: 10371 - DNA, 40 bp, Artificial Sequence
  PCR primer for ORF amplification
caggagctgcacttccaatgtgcgctatatatataccatt

SEQ ID NO: 10372 - DNA, 40 bp, Artificial Sequence
  PCR primer for ORF amplification
caggagctgcacttccggaccggtcgtatccctccggtag

SEQ ID NO: 10373 - DNA, 40 bp, Artificial Sequence
  PCR primer for ORF amplification
caggagctgcacttcctctaccctgagatagctttcttct

SEQ ID NO: 10374 - DNA, 40 bp, Artificial Sequence
  PCR primer for ORF amplification
caggagctgcacttccttttgtagagctttgtttttgaca

SEQ ID NO: 10375 - DNA, 40 bp, Artificial Sequence
  PCR primer for ORF amplification
caggagctgcacttccgattggctttttcgtcgcccatgc

SEQ ID NO: 10376 - DNA, 40 bp, Artificial Sequence
  PCR primer for ORF amplification
caggagctgcacttcctccttttttgagagccaaatcccg

SEQ ID NO: 10377 - DNA, 40 bp, Artificial Sequence
  PCR primer for ORF amplification
caggagctgcacttcctagtgttttagtttcactcttgct

SEQ ID NO: 10378 - DNA, 40 bp, Artificial Sequence
  PCR primer for ORF amplification
caggagctgcacttccattgtaggctttggttccggcgtt

SEQ ID NO: 10379 - DNA, 40 bp, Artificial Sequence
  PCR primer for ORF amplification
caggagctgcacttccctgttgtggtggagtaggaggtgt

SEQ ID NO: 10380 - DNA, 40 bp, Artificial Sequence
  PCR primer for ORF amplification
caggagctgcacttcccttccaaacaactggtccagaatg

SEQ ID NO: 10381 - DNA, 40 bp, Artificial Sequence
  PCR primer for ORF amplification
caggagctgcacttcctgatagaacgtccatggcttccac

SEQ ID NO: 10382 - DNA, 40 bp, Artificial Sequence
  PCR primer for ORF amplification
caggagctgcacttccaaggaacttggacgcaaccctccc

SEQ ID NO: 10383 - DNA, 40 bp, Artificial Sequence
  PCR primer for ORF amplification
caggagctgcacttccgtcgttttgtgattggccatgctg

SEQ ID NO: 10384 - DNA, 40 bp, Artificial Sequence
  PCR primer for ORF amplification
caggagctgcacttccgtccttacgtataccgtatttggc

SEQ ID NO: 10385 - DNA, 40 bp, Artificial Sequence
  PCR primer for ORF amplification
caggagctgcacttcctttggcagcctttgtcatataagt

SEQ ID NO: 10386 - DNA, 40 bp, Artificial Sequence
  PCR primer for ORF amplification
caggagctgcacttccttttggagttcgcgattgtcttct

SEQ ID NO: 10387 - DNA, 40 bp, Artificial Sequence
  PCR primer for ORF amplification
caggagctgcacttcctaaggaaaagccggatatcatttc

SEQ ID NO: 10388 - DNA, 40 bp, Artificial Sequence
  PCR primer for ORF amplification
caggagctgcacttccgttgaaaatggaagcaattttacg

SEQ ID NO: 10389 - DNA, 40 bp, Artificial Sequence; identical to SEQ ID NO: 10097
  PCR primer for ORF amplification

SEQ ID NO: 10390 - DNA, 40 bp, Artificial Sequence
  PCR primer for ORF amplification
caggagctgcacttccagcaactaaatggtcacggtttag

SEQ ID NO: 10391 - DNA, 40 bp, Artificial Sequence
  PCR primer for ORF amplification
caggagctgcacttccggcgaggcaaaaaaaaaaaaaaat

SEQ ID NO: 10392 - DNA, 40 bp, Artificial Sequence
  PCR primer for ORF amplification
caggagctgcacttccaatatctacaaatgaagaaagaaa

SEQ ID NO: 10393 - DNA, 40 bp, Artificial Sequence
  PCR primer for ORF amplification
caggagctgcacttcctcttagtttaaggtttctaaaatc

SEQ ID NO: 10394 - DNA, 40 bp, Artificial Sequence
  PCR primer for ORF amplification
caggagctgcacttccgttgaccttcaacaattcgacgtc

SEQ ID NO: 10395 - DNA, 40 bp, Artificial Sequence
  PCR primer for ORF amplification
caggagctgcacttccccttcctgggccagtggaagctgc

SEQ ID NO: 10396 - DNA, 40 bp, Artificial Sequence
  PCR primer for ORF amplification
caggagctgcacttcctctagattgcattctccttatttt

SEQ ID NO: 10397 - DNA, 40 bp, Artificial Sequence
  PCR primer for ORF amplification
caggagctgcacttccatgatagggtaataaccgctttag

SEQ ID NO: 10398 - DNA, 40 bp, Artificial Sequence
  PCR primer for ORF amplification
caggagctgcacttccgtgatgtttatatcccactaattt

SEQ ID NO: 10399 - DNA, 40 bp, Artificial Sequence
  PCR primer for ORF amplification
caggagctgcacttccccaaatacccttcttaacacctgg

SEQ ID NO: 10400 - DNA, 40 bp, Artificial Sequence
  PCR primer for ORF amplification
caggagctgcacttcctctatttactttattgtcgggttc

SEQ ID NO: 10401 - DNA, 40 bp, Artificial Sequence
  PCR primer for ORF amplification
caggagctgcacttccgctgaaatggacgacgataggaac

SEQ ID NO: 10402 - DNA, 40 bp, Artificial Sequence
  PCR primer for ORF amplification
caggagctgcacttccacacatagcggggggagggttctg

SEQ ID NO: 10403 - DNA, 40 bp, Artificial Sequence
  PCR primer for ORF amplification
caggagctgcacttccggttgctaaaatttgtgttactgt

SEQ ID NO: 10404 - DNA, 40 bp, Artificial Sequence
  PCR primer for ORF amplification
caggagctgcacttcctgagtccagtccatcctctccttc

SEQ ID NO: 10405 - DNA, 40 bp, Artificial Sequence
  PCR primer for ORF amplification
caggagctgcacttcctatgctacttttagtccgttggat

SEQ ID NO: 10406 - DNA, 40 bp, Artificial Sequence
  PCR primer for ORF amplification
caggagctgcacttcccctgccaaatgtattttctcctga

SEQ ID NO: 10407 - DNA, 40 bp, Artificial Sequence
  PCR primer for ORF amplification
caggagctgcacttccatctagtttgccagcgaagatatt

SEQ ID NO: 10408 - DNA, 40 bp, Artificial Sequence
  PCR primer for ORF amplification
caggagctgcacttcctgatgatgccggacccttcccagt

SEQ ID NO: 10409 - DNA, 40 bp, Artificial Sequence
  PCR primer for ORF amplification
caggagctgcacttccacgcaactcgatcgaaggttttct

SEQ ID NO: 10410 - DNA, 40 bp, Artificial Sequence
  PCR primer for ORF amplification
caggagctgcacttccgttagcctgtgtttcaccatcgtt

SEQ ID NO: 10411 - DNA, 40 bp, Artificial Sequence
  PCR primer for ORF amplification
caggagctgcacttcctatactcaatccaaaacagggaaa

SEQ ID NO: 10412 - DNA, 40 bp, Artificial Sequence
  PCR primer for ORF amplification
caggagctgcacttccgcaacggtgctcttggcggaaagg

SEQ ID NO: 10413 - DNA, 40 bp, Artificial Sequence
  PCR primer for ORF amplification
caggagctgcacttccctcaccgaacaactttctgactct

SEQ ID NO: 10414 - DNA, 40 bp, Artificial Sequence
  PCR primer for ORF amplification
caggagctgcacttccccagacattctcagattcatcctt

SEQ ID NO: 10415 - DNA, 40 bp, Artificial Sequence
  PCR primer for ORF amplification
caggagctgcacttcctttcgtaaacttgacatcgtgtga

SEQ ID NO: 10416 - DNA, 40 bp, Artificial Sequence
  PCR primer for ORF amplification
caggagctgcacttcccaaagctttctttgcggcagctgc

SEQ ID NO: 10417 - DNA, 40 bp, Artificial Sequence
  PCR primer for ORF amplification
caggagctgcacttcctaaagccttcttggcggcatcagc

SEQ ID NO: 10418 - DNA, 40 bp, Artificial Sequence
  PCR primer for ORF amplification
caggagctgcacttccttctttcttctttgccagaggctc

SEQ ID NO: 10419 - DNA, 40 bp, Artificial Sequence
  PCR primer for ORF amplification
caggagctgcacttccattcgtccagcttctcgggggtaa

SEQ ID NO: 10420 - DNA, 40 bp, Artificial Sequence
  PCR primer for ORF amplification
caggagctgcacttccgtccttcattgaataaccgatctc

SEQ ID NO: 10421 - DNA, 40 bp, Artificial Sequence
  PCR primer for ORF amplification
caggagctgcacttccatccttatctttggcaaggacttc

SEQ ID NO: 10422 - DNA, 40 bp, Artificial Sequence
  PCR primer for ORF amplification
caggagctgcacttccgtttgtgatagtgtagataccgtc

SEQ ID NO: 10423 - DNA, 40 bp, Artificial Sequence; identical to SEQ ID NO: 10061
  PCR primer for ORF amplification

SEQ ID NO: 10424 - DNA, 40 bp, Artificial Sequence
  PCR primer for ORF amplification
caggagctgcacttccgtttgcgatagtgtagataccatc

SEQ ID NO: 10425 - DNA, 40 bp, Artificial Sequence; identical to SEQ ID NO: 10424
  PCR primer for ORF amplification

SEQ ID NO: 10426 - DNA, 40 bp, Artificial Sequence; identical to SEQ ID NO: 10061
  PCR primer for ORF amplification

SEQ ID NO: 10427 - DNA, 40 bp, Artificial Sequence; identical to SEQ ID NO: 10061
  PCR primer for ORF amplification

SEQ ID NO: 10428 - DNA, 40 bp, Artificial Sequence; identical to SEQ ID NO: 10061
  PCR primer for ORF amplification

SEQ ID NO: 10429 - DNA, 40 bp, Artificial Sequence
  PCR primer for ORF amplification
caggagctgcacttccgtacattggttggcctggcttgag

SEQ ID NO: 10430 - DNA, 40 bp, Artificial Sequence
  PCR primer for ORF amplification
caggagctgcacttccaaatgcgtcgtcggcggctagagt

SEQ ID NO: 10431 - DNA, 40 bp, Artificial Sequence
  PCR primer for ORF amplification
caggagctgcacttcctaccacaatcttagaccattcctc

SEQ ID NO: 10432 - DNA, 40 bp, Artificial Sequence
  PCR primer for ORF amplification
caggagctgcacttccagttgtcatctcatcgatgtagga

SEQ ID NO: 10433 - DNA, 40 bp, Artificial Sequence
  PCR primer for ORF amplification
caggagctgcacttccttcgttcaacaaataataagcaac

SEQ ID NO: 10434 - DNA, 40 bp, Artificial Sequence
  PCR primer for ORF amplification
caggagctgcacttccacgttcttttaaagccttgttcct

SEQ ID NO: 10435 - DNA, 40 bp, Artificial Sequence
  PCR primer for ORF amplification
caggagctgcacttccctccaatgtttccattctttcaaa

SEQ ID NO: 10436 - DNA, 40 bp, Artificial Sequence
  PCR primer for ORF amplification
caggagctgcacttcccgtagttttttccgccacgaacgt

SEQ ID NO: 10437 - DNA, 40 bp, Artificial Sequence
  PCR primer for ORF amplification
caggagctgcacttcccctaccgcatcttgctaactgcca

SEQ ID NO: 10438 - DNA, 40 bp, Artificial Sequence
  PCR primer for ORF amplification
caggagctgcacttccgaatctgacagttccggtaagttc

SEQ ID NO: 10439 - DNA, 40 bp, Artificial Sequence
  PCR primer for ORF amplification
caggagctgcacttccgttggaagcaacaacaacttcgac

SEQ ID NO: 10440 - DNA, 40 bp, Artificial Sequence
  PCR primer for ORF amplification
caggagctgcacttccgtccttgattaattccaagtttac

SEQ ID NO: 10441 - DNA, 40 bp, Artificial Sequence
  PCR primer for ORF amplification
caggagctgcacttccttgaatttcaaagtatgcacttga

SEQ ID NO: 10442 - DNA, 40 bp, Artificial Sequence; identical to SEQ ID NO: 10441
  PCR primer for ORF amplification

SEQ ID NO: 10443 - DNA, 40 bp, Artificial Sequence
  PCR primer for ORF amplification
caggagctgcacttccatttgcaatagtgtagataccgtc

SEQ ID NO: 10444 - DNA, 40 bp, Artificial Sequence
  PCR primer for ORF amplification
caggagctgcacttcctgaaaactgcgtccttttgttttt

SEQ ID NO: 10445 - DNA, 40 bp, Artificial Sequence
  PCR primer for ORF amplification
caggagctgcacttcccttagatttactggcgcccttttt

SEQ ID NO: 10446 - DNA, 40 bp, Artificial Sequence
  PCR primer for ORF amplification
caggagctgcacttccctcgctcttttttgagttacatgc

SEQ ID NO: 10447 - DNA, 40 bp, Artificial Sequence
  PCR primer for ORF amplification
caggagctgcacttcctgcttttcttgacctagattgtgc

SEQ ID NO: 10448 - DNA, 40 bp, Artificial Sequence
  PCR primer for ORF amplification
caggagctgcacttccgtatatttctgggtatttcttaca

SEQ ID NO: 10449 - DNA, 40 bp, Artificial Sequence
  PCR primer for ORF amplification
caggagctgcacttccgttttgcctttttttccaattgtc

SEQ ID NO: 10450 - DNA, 40 bp, Artificial Sequence
  PCR primer for ORF amplification
caggagctgcacttcctttcgagttgcgattcttttctat

SEQ ID NO: 10451 - DNA, 40 bp, Artificial Sequence
  PCR primer for ORF amplification
caggagctgcacttccatttgcgatagtgtagataccgtc

SEQ ID NO: 10452 - DNA, 40 bp, Artificial Sequence
  PCR primer for ORF amplification
caggagctgcacttccaacagcatcttcgtcaccgtcacc

SEQ ID NO: 10453 - DNA, 40 bp, Artificial Sequence
  PCR primer for ORF amplification
caggagctgcacttccgacaattgtatacaacactagcat

SEQ ID NO: 10454 - DNA, 40 bp, Artificial Sequence
  PCR primer for ORF amplification
caggagctgcacttccttgctttttatcagagcatttaaa

SEQ ID NO: 10455 - DNA, 40 bp, Artificial Sequence
  PCR primer for ORF amplification
caggagctgcacttcctacaagatcccttaattgttcctc

SEQ ID NO: 10456 - DNA, 40 bp, Artificial Sequence
  PCR primer for ORF amplification
caggagctgcacttccccatgcaccaccgctatttatgct

SEQ ID NO: 10457 - DNA, 40 bp, Artificial Sequence
  PCR primer for ORF amplification
caggagctgcacttccctttggtattttgatattctcgag

SEQ ID NO: 10458 - DNA, 40 bp, Artificial Sequence
  PCR primer for ORF amplification
caggagctgcacttccaaattcgtagtgacagatgctata

SEQ ID NO: 10459 - DNA, 40 bp, Artificial Sequence
  PCR primer for ORF amplification
caggagctgcacttccgtttggaacagcagtgtagatacc

SEQ ID NO: 10460 - DNA, 40 bp, Artificial Sequence
  PCR primer for ORF amplification
caggagctgcacttccttttggaatagcagtgtagatacc

SEQ ID NO: 10461 - DNA, 40 bp, Artificial Sequence
  PCR primer for ORF amplification
caggagctgcacttccttttggaatagcagtgtaaatacc

SEQ ID NO: 10462 - DNA, 40 bp, Artificial Sequence; identical to SEQ ID NO: 10460
  PCR primer for ORF amplification

SEQ ID NO: 10463 - DNA, 40 bp, Artificial Sequence
  PCR primer for ORF amplification
caggagctgcacttccgtttggtacagcagtgtagatacc

SEQ ID NO: 10464 - DNA, 40 bp, Artificial Sequence
  PCR primer for ORF amplification
caggagctgcacttccttcctcgcggatgtagaaggggtt

SEQ ID NO: 10465 - DNA, 40 bp, Artificial Sequence
  PCR primer for ORF amplification
caggagctgcacttcctagtataatgcagataaaaaataa

SEQ ID NO: 10466 - DNA, 40 bp, Artificial Sequence
  PCR primer for ORF amplification
caggagctgcacttccaatttgaaatctggtaccttcggt

SEQ ID NO: 10467 - DNA, 40 bp, Artificial Sequence
  PCR primer for ORF amplification
caggagctgcacttccatgactttctttggtttcctcagc

SEQ ID NO: 10468 - DNA, 40 bp, Artificial Sequence
  PCR primer for ORF amplification
caggagctgcacttcctggtgtgtgcgtatcattatataa

SEQ ID NO: 10469 - DNA, 40 bp, Artificial Sequence
  PCR primer for ORF amplification
caggagctgcacttccatgtacacgaaagtcaatataaaa

SEQ ID NO: 10470 - DNA, 40 bp, Artificial Sequence
  PCR primer for ORF amplification
caggagctgcacttccagcagagtaattcaaacggaagat

SEQ ID NO: 10471 - DNA, 40 bp, Artificial Sequence
  PCR primer for ORF amplification
caggagctgcacttccattgttggtacggaacttgtaacc

SEQ ID NO: 10472 - DNA, 40 bp, Artificial Sequence
  PCR primer for ORF amplification
caggagctgcacttccgtttgcgtcgggattggaagcgat

SEQ ID NO: 10473 - DNA, 40 bp, Artificial Sequence
  PCR primer for ORF amplification
caggagctgcacttcctcggtcctggtagaaggcaatgcc

SEQ ID NO: 10474 - DNA, 40 bp, Artificial Sequence
  PCR primer for ORF amplification
caggagctgcacttcccctctcttctcgtaagtaggcttt

SEQ ID NO: 10475 - DNA, 40 bp, Artificial Sequence
  PCR primer for ORF amplification
caggagctgcacttccgggatagtacaattgggctgttag

SEQ ID NO: 10476 - DNA, 40 bp, Artificial Sequence
  PCR primer for ORF amplification
caggagctgcacttcccttgtgaagccaaagaattgtaat

SEQ ID NO: 10477 - DNA, 40 bp, Artificial Sequence
  PCR primer for ORF amplification
caggagctgcacttcctgtgtgcactgaatccatctcctc

SEQ ID NO: 10478 - DNA, 40 bp, Artificial Sequence
  PCR primer for ORF amplification
caggagctgcacttccaattaataaagtttcaatcttgtc

SEQ ID NO: 10479 - DNA, 40 bp, Artificial Sequence
  PCR primer for ORF amplification
caggagctgcacttcctaccaaaagaaaagcaaatagcac

SEQ ID NO: 10480 - DNA, 40 bp, Artificial Sequence
  PCR primer for ORF amplification
caggagctgcacttccgtgatagaaccttctcctaggata

SEQ ID NO: 10481 - DNA, 40 bp, Artificial Sequence
  PCR primer for ORF amplification
caggagctgcacttccgatctttacatgttggtactctaa

SEQ ID NO: 10482 - DNA, 40 bp, Artificial Sequence
  PCR primer for ORF amplification
caggagctgcacttccgtcccgtagtttttcgaatttttc

SEQ ID NO: 10483 - DNA, 40 bp, Artificial Sequence
  PCR primer for ORF amplification
caggagctgcacttcctttggagacctctatgttgtctaa

SEQ ID NO: 10484 - DNA, 40 bp, Artificial Sequence
  PCR primer for ORF amplification
caggagctgcacttccgttggcccatctttctaccatttc

SEQ ID NO: 10485 - DNA, 40 bp, Artificial Sequence
  PCR primer for ORF amplification
caggagctgcacttccttcgatgtcgagactgctgcccag

SEQ ID NO: 10486 - DNA, 40 bp, Artificial Sequence
  PCR primer for ORF amplification
caggagctgcacttccaaatgaagacagccacaatctgta

SEQ ID NO: 10487 - DNA, 40 bp, Artificial Sequence
  PCR primer for ORF amplification
caggagctgcacttcctagatctttgattcccttctctaa

SEQ ID NO: 10488 - DNA, 40 bp, Artificial Sequence
  PCR primer for ORF amplification
caggagctgcacttccccatacgattgccagcaatacggt

SEQ ID NO: 10489 - DNA, 40 bp, Artificial Sequence
  PCR primer for ORF amplification
caggagctgcacttcctaataagccatcttcatacaaagc

SEQ ID NO: 10490 - DNA, 40 bp, Artificial Sequence
  PCR primer for ORF amplification
caggagctgcacttccatttcttttcggttttcgtactcc

SEQ ID NO: 10491 - DNA, 40 bp, Artificial Sequence
  PCR primer for ORF amplification
caggagctgcacttccgaatagcatatccatggtgcagca

SEQ ID NO: 10492 - DNA, 40 bp, Artificial Sequence
  PCR primer for ORF amplification
caggagctgcacttccttttatgaaggcacttatatatat

SEQ ID NO: 10493 - DNA, 40 bp, Artificial Sequence
  PCR primer for ORF amplification
caggagctgcacttccgtaattcacagttaacaacagttg

SEQ ID NO: 10494 - DNA, 40 bp, Artificial Sequence
  PCR primer for ORF amplification
caggagctgcacttccacgttcaaggttgatattatcacc

SEQ ID NO: 10495 - DNA, 40 bp, Artificial Sequence
  PCR primer for ORF amplification
caggagctgcacttccatctctttcggcagcaatggcttc

SEQ ID NO: 10496 - DNA, 40 bp, Artificial Sequence
  PCR primer for ORF amplification
caggagctgcacttcctgctttttcagcaagtgcttgctt

SEQ ID NO: 10497 - DNA, 40 bp, Artificial Sequence
  PCR primer for ORF amplification
caggagctgcacttcctctgcccgtagtaatttccttttt

SEQ ID NO: 10498 - DNA, 40 bp, Artificial Sequence
  PCR primer for ORF amplification
caggagctgcacttccttcttccagtagttcctcaatatc

SEQ ID NO: 10499 - DNA, 40 bp, Artificial Sequence
  PCR primer for ORF amplification
caggagctgcacttcctaacttagtgttagcgtcattgta

SEQ ID NO: 10500 - DNA, 40 bp, Artificial Sequence
  PCR primer for ORF amplification
caggagctgcacttccatcgtcgtgctcgatgtgcctgtt

SEQ ID NO: 10501 - DNA, 40 bp, Artificial Sequence
  PCR primer for ORF amplification
caggagctgcacttccgtaaacgaaacccaaaatcttacc

SEQ ID NO: 10502 - DNA, 40 bp, Artificial Sequence
  PCR primer for ORF amplification
caggagctgcacttccttgcttgttttcagctttccattt

SEQ ID NO: 10503 - DNA, 40 bp, Artificial Sequence
  PCR primer for ORF amplification
caggagctgcacttccatcatcagaagtgcagcattcatt

SEQ ID NO: 10504 - DNA, 40 bp, Artificial Sequence
  PCR primer for ORF amplification
caggagctgcacttccatttataaaatgtaaacaaacgaa

SEQ ID NO: 10505 - DNA, 40 bp, Artificial Sequence
  PCR primer for ORF amplification
caggagctgcacttccagcttccaaagccaaacgaccctt

SEQ ID NO: 10506 - DNA, 40 bp, Artificial Sequence
  PCR primer for ORF amplification
caggagctgcacttccaccactaacaatcaatttaaggtt

SEQ ID NO: 10507 - DNA, 40 bp, Artificial Sequence
  PCR primer for ORF amplification
caggagctgcacttccctgtttaccagttttttctttctc

SEQ ID NO: 10508 - DNA, 40 bp, Artificial Sequence
  PCR primer for ORF amplification
caggagctgcacttccttctgcaaattcaggtctcaaatc

SEQ ID NO: 10509 - DNA, 40 bp, Artificial Sequence
  PCR primer for ORF amplification
caggagctgcacttccatggtttttgtaagcatctgatac

SEQ ID NO: 10510 - DNA, 40 bp, Artificial Sequence
  PCR primer for ORF amplification
caggagctgcacttccgtgcatcggagaggagatccgtgg

SEQ ID NO: 10511 - DNA, 40 bp, Artificial Sequence
  PCR primer for ORF amplification
caggagctgcacttcccttggatttcgaaggatctaatat

SEQ ID NO: 10512 - DNA, 40 bp, Artificial Sequence
  PCR primer for ORF amplification
caggagctgcacttccaatggattgataatcttcattcac

SEQ ID NO: 10513 - DNA, 40 bp, Artificial Sequence
  PCR primer for ORF amplification
caggagctgcacttcctttatttggagatcttggtggagg

SEQ ID NO: 10514 - DNA, 40 bp, Artificial Sequence
  PCR primer for ORF amplification
caggagctgcacttccggcttgagtagaggaggagtattt

SEQ ID NO: 10515 - DNA, 40 bp, Artificial Sequence
  PCR primer for ORF amplification
caggagctgcacttccatgaaagcgcactacgtatataat

SEQ ID NO: 10516 - DNA, 40 bp, Artificial Sequence
  PCR primer for ORF amplification
caggagctgcacttcctgcttgagtagaggaagagtactt

SEQ ID NO: 10517 - DNA, 40 bp, Artificial Sequence
  PCR primer for ORF amplification
caggagctgcacttccaaagaattttggggcctttctaat

SEQ ID NO: 10518 - DNA, 40 bp, Artificial Sequence
  PCR primer for ORF amplification
caggagctgcacttcccagttcttgagaagctttggcagt

SEQ ID NO: 10519 - DNA, 40 bp, Artificial Sequence
  PCR primer for ORF amplification
caggagctgcacttcctaattcttgagaagccttggtagc

SEQ ID NO: 10520 - DNA, 40 bp, Artificial Sequence
  PCR primer for ORF amplification
caggagctgcacttccgatcatgtgctccagccttgtcag

SEQ ID NO: 10521 - DNA, 40 bp, Artificial Sequence
  PCR primer for ORF amplification
caggagctgcacttccatgaatataaacatataaaatgat

SEQ ID NO: 10522 - DNA, 40 bp, Artificial Sequence
  PCR primer for ORF amplification
caggagctgcacttccttttgtatagtaagcagaaccggc

SEQ ID NO: 10523 - DNA, 40 bp, Artificial Sequence
  PCR primer for ORF amplification
caggagctgcacttccatccttgttgttccgcttcacgtc

SEQ ID NO: 10524 - DNA, 40 bp, Artificial Sequence
  PCR primer for ORF amplification
caggagctgcacttccattttgaagagctttaactgctag

SEQ ID NO: 10525 - DNA, 40 bp, Artificial Sequence
  PCR primer for ORF amplification
caggagctgcacttcccaacaacaaagcagcggcaccagc

SEQ ID NO: 10526 - DNA, 40 bp, Artificial Sequence
  PCR primer for ORF amplification
caggagctgcacttcccataataggtagaggcctatcctt

SEQ ID NO: 10527 - DNA, 40 bp, Artificial Sequence
  PCR primer for ORF amplification
caggagctgcacttccagtacggccggaagagagctgttg

SEQ ID NO: 10528 - DNA, 40 bp, Artificial Sequence
  PCR primer for ORF amplification
caggagctgcacttccaagtcttctcttggatccattaac

SEQ ID NO: 10529 - DNA, 40 bp, Artificial Sequence
  PCR primer for ORF amplification
caggagctgcacttccttcgttaccatctaccctaattct

SEQ ID NO: 10530 - DNA, 40 bp, Artificial Sequence
  PCR primer for ORF amplification
caggagctgcacttcctttgcgctgaatgatgtacttgtc

SEQ ID NO: 10531 - DNA, 40 bp, Artificial Sequence
  PCR primer for ORF amplification
caggagctgcacttcctttcttacttccctttttttccac

SEQ ID NO: 10532 - DNA, 40 bp, Artificial Sequence
  PCR primer for ORF amplification
caggagctgcacttcccttctgtattaacaattgtttaaa

SEQ ID NO: 10533 - DNA, 40 bp, Artificial Sequence
  PCR primer for ORF amplification
caggagctgcacttcctaccaggtgtggaggtaacagcaa

SEQ ID NO: 10534 - DNA, 40 bp, Artificial Sequence
  PCR primer for ORF amplification
caggagctgcacttccggcggctgatttcacgtctaccaa

SEQ ID NO: 10535 - DNA, 40 bp, Artificial Sequence
  PCR primer for ORF amplification
caggagctgcacttccttcatgtcgatgctgctcttccgt

SEQ ID NO: 10536 - DNA, 40 bp, Artificial Sequence
  PCR primer for ORF amplification
caggagctgcacttccgacgtagacaccgaaagaattcga

SEQ ID NO: 10537 - DNA, 40 bp, Artificial Sequence
  PCR primer for ORF amplification
caggagctgcacttccaaacagcatatccaaagtacagca

SEQ ID NO: 10538 - DNA, 40 bp, Artificial Sequence
  PCR primer for ORF amplification
caggagctgcacttcctgatctttcacctcttaatcttct

SEQ ID NO: 10539 - DNA, 40 bp, Artificial Sequence
  PCR primer for ORF amplification
caggagctgcacttcctgatctttcacctcttagtcttct

SEQ ID NO: 10540 - DNA, 40 bp, Artificial Sequence
  PCR primer for ORF amplification
caggagctgcacttccaccatgccaagagcttctataaac

SEQ ID NO: 10541 - DNA, 40 bp, Artificial Sequence
  PCR primer for ORF amplification
caggagctgcacttcctaccgatgacaaccacagtctgta

SEQ ID NO: 10542 - DNA, 40 bp, Artificial Sequence
  PCR primer for ORF amplification
caggagctgcacttccctcatcggcgaatgtagttttctt

SEQ ID NO: 10543 - DNA, 40 bp, Artificial Sequence
  PCR primer for ORF amplification
caggagctgcacttccggatcttttccgatggcataaagg

SEQ ID NO: 10544 - DNA, 40 bp, Artificial Sequence
  PCR primer for ORF amplification
caggagctgcacttccctcatcatcgtcgtctccatcgcc

SEQ ID NO: 10545 - DNA, 40 bp, Artificial Sequence
  PCR primer for ORF amplification
caggagctgcacttccaatgtctacattcggcttgcgtgg

SEQ ID NO: 10546 - DNA, 40 bp, Artificial Sequence
  PCR primer for ORF amplification
caggagctgcacttcctataatactttcttgcggtccaac

SEQ ID NO: 10547 - DNA, 40 bp, Artificial Sequence
  PCR primer for ORF amplification
caggagctgcacttcctttcgagttcgcatcattgtcact

SEQ ID NO: 10548 - DNA, 40 bp, Artificial Sequence
  PCR primer for ORF amplification
caggagctgcacttccttttctttcagtcattacctccct

SEQ ID NO: 10549 - DNA, 40 bp, Artificial Sequence
  PCR primer for ORF amplification
caggagctgcacttcctatgaccctacttgccaaagagca

SEQ ID NO: 10550 - DNA, 40 bp, Artificial Sequence
  PCR primer for ORF amplification
caggagctgcacttcccttgacatcgcgcgatcttccact

SEQ ID NO: 10551 - DNA, 40 bp, Artificial Sequence
  PCR primer for ORF amplification
caggagctgcacttcccattaatcctattgcctggcaccg

SEQ ID NO: 10552 - DNA, 40 bp, Artificial Sequence
  PCR primer for ORF amplification
caggagctgcacttcctttaagcaactgttccattttcat

SEQ ID NO: 10553 - DNA, 40 bp, Artificial Sequence
  PCR primer for ORF amplification
caggagctgcacttccagtacatttacaaatgtttttcag

SEQ ID NO: 10554 - DNA, 40 bp, Artificial Sequence
  PCR primer for ORF amplification
caggagctgcacttccgaagtcatcaccactttcagcaat

SEQ ID NO: 10555 - DNA, 40 bp, Artificial Sequence
  PCR primer for ORF amplification
caggagctgcacttccgaaatccgttactcttccgttaaa

SEQ ID NO: 10556 - DNA, 40 bp, Artificial Sequence
  PCR primer for ORF amplification
caggagctgcacttccttgaaaattctgtttcccacatag

SEQ ID NO: 10557 - DNA, 40 bp, Artificial Sequence
  PCR primer for ORF amplification
caggagctgcacttccaatgtcaagaccggggatcttaac

SEQ ID NO: 10558 - DNA, 40 bp, Artificial Sequence
  PCR primer for ORF amplification
caggagctgcacttcctaagtcaagtttatcacccccatg

SEQ ID NO: 10559 - DNA, 40 bp, Artificial Sequence
  PCR primer for ORF amplification
caggagctgcacttcctgtgctcttttttgagtttgcaat

SEQ ID NO: 10560 - DNA, 40 bp, Artificial Sequence
  PCR primer for ORF amplification
caggagctgcacttccaccaaaaagggaatcatcttcgtt

SEQ ID NO: 10561 - DNA, 40 bp, Artificial Sequence
  PCR primer for ORF amplification
caggagctgcacttccgccgctatcatcattgtcacggtc

SEQ ID NO: 10562 - DNA, 40 bp, Artificial Sequence
  PCR primer for ORF amplification
caggagctgcacttccaacataaatacgcaattctacacc

SEQ ID NO: 10563 - DNA, 40 bp, Artificial Sequence
  PCR primer for ORF amplification
caggagctgcacttccgtcataaatcatgttttccctttc

SEQ ID NO: 10564 - DNA, 40 bp, Artificial Sequence
  PCR primer for ORF amplification
caggagctgcacttccaattctatgccttttcgcagcatg

SEQ ID NO: 10565 - DNA, 40 bp, Artificial Sequence
  PCR primer for ORF amplification
caggagctgcacttcctgtgctggtatggtcgttatcata

SEQ ID NO: 10566 - DNA, 40 bp, Artificial Sequence
  PCR primer for ORF amplification
caggagctgcacttccctcaacaggggtttttaacacaac

SEQ ID NO: 10567 - DNA, 40 bp, Artificial Sequence
  PCR primer for ORF amplification
caggagctgcacttcctggcacataaggaggaggagactc

SEQ ID NO: 10568 - DNA, 40 bp, Artificial Sequence
  PCR primer for ORF amplification
caggagctgcacttccgtttttaacgacttgaatcttatt

SEQ ID NO: 10569 - DNA, 40 bp, Artificial Sequence
  PCR primer for ORF amplification
caggagctgcacttccacgcgttcttgtaactccatagag

SEQ ID NO: 10570 - DNA, 40 bp, Artificial Sequence
  PCR primer for ORF amplification
caggagctgcacttcctcgaccatctccagtgttctgagc

SEQ ID NO: 10571 - DNA, 40 bp, Artificial Sequence
  PCR primer for ORF amplification
caggagctgcacttccttggatagatggcacatggtactt

SEQ ID NO: 10572 - DNA, 40 bp, Artificial Sequence
  PCR primer for ORF amplification
caggagctgcacttcctttttctttttttacagtgttaga

SEQ ID NO: 10573 - DNA, 40 bp, Artificial Sequence
  PCR primer for ORF amplification
caggagctgcacttccgtttaaatgagatggaccaaaagc

SEQ ID NO: 10574 - DNA, 40 bp, Artificial Sequence
  PCR primer for ORF amplification
caggagctgcacttcccatgctcttgattttttcagtaaa

SEQ ID NO: 10575 - DNA, 40 bp, Artificial Sequence
  PCR primer for ORF amplification
caggagctgcacttcccccgttccccattagtatgataac

SEQ ID NO: 10576 - DNA, 40 bp, Artificial Sequence
  PCR primer for ORF amplification
caggagctgcacttccggcactctcttcctccggttgtgt

SEQ ID NO: 10577 - DNA, 40 bp, Artificial Sequence
  PCR primer for ORF amplification
caggagctgcacttcccgtacttccatttgcttcctcttc

SEQ ID NO: 10578 - DNA, 40 bp, Artificial Sequence
  PCR primer for ORF amplification
caggagctgcacttccgcttatcaaatttgcatcattttc

SEQ ID NO: 10579 - DNA, 40 bp, Artificial Sequence
  PCR primer for ORF amplification
caggagctgcacttcctttcaatgggatgaaacgggaagt

SEQ ID NO: 10580 - DNA, 40 bp, Artificial Sequence
  PCR primer for ORF amplification
caggagctgcacttccaacattattcgtaccatatttttg

SEQ ID NO: 10581 - DNA, 40 bp, Artificial Sequence
  PCR primer for ORF amplification
caggagctgcacttccattccttcccataatttgaaggct

SEQ ID NO: 10582 - DNA, 40 bp, Artificial Sequence
  PCR primer for ORF amplification
caggagctgcacttccttgaaataccggcttcaatatttc

SEQ ID NO: 10583 - DNA, 40 bp, Artificial Sequence
  PCR primer for ORF amplification
caggagctgcacttcctgaaacacgcttatgattataatc

SEQ ID NO: 10584 - DNA, 40 bp, Artificial Sequence
  PCR primer for ORF amplification
caggagctgcacttccatctaatccatgactggtcgtagg

SEQ ID NO: 10585 - DNA, 40 bp, Artificial Sequence
  PCR primer for ORF amplification
caggagctgcacttcccttgccaaagatacaagaccaaag

SEQ ID NO: 10586 - DNA, 40 bp, Artificial Sequence
  PCR primer for ORF amplification
caggagctgcacttccaatcatgtcatcgtcatcgtcgat

SEQ ID NO: 10587 - DNA, 40 bp, Artificial Sequence
  PCR primer for ORF amplification
caggagctgcacttccttgttgggagaagtgttccatgat

SEQ ID NO: 10588 - DNA, 40 bp, Artificial Sequence
  PCR primer for ORF amplification
caggagctgcacttcctgaagagtttgtccgtaccaatcc

SEQ ID NO: 10589 - DNA, 40 bp, Artificial Sequence
  PCR primer for ORF amplification
caggagctgcacttccaggcacctcttcgtcgtcctgctc

SEQ ID NO: 10590 - DNA, 40 bp, Artificial Sequence
  PCR primer for ORF amplification
caggagctgcacttcctttcttgtatctcaagtagctcct

SEQ ID NO: 10591 - DNA, 40 bp, Artificial Sequence
  PCR primer for ORF amplification
caggagctgcacttccaatcatgtcggaaagcgataattg

SEQ ID NO: 10592 - DNA, 40 bp, Artificial Sequence
  PCR primer for ORF amplification
caggagctgcacttccagaatttagtagattaccctcccg

SEQ ID NO: 10593 - DNA, 40 bp, Artificial Sequence
  PCR primer for ORF amplification
caggagctgcacttcctacaattattctacaaagtgttat

SEQ ID NO: 10594 - DNA, 40 bp, Artificial Sequence
  PCR primer for ORF amplification
caggagctgcacttccaaataacttaaacagggtatatag

SEQ ID NO: 10595 - DNA, 40 bp, Artificial Sequence
  PCR primer for ORF amplification
caggagctgcacttccatcaaagaagtcgtcatcatcttc

SEQ ID NO: 10596 - DNA, 40 bp, Artificial Sequence
  PCR primer for ORF amplification
caggagctgcacttccgatattacctggcgcatgcctata

SEQ ID NO: 10597 - DNA, 40 bp, Artificial Sequence
  PCR primer for ORF amplification
caggagctgcacttccttcatcgtcactatctaccaaggc

SEQ ID NO: 10598 - DNA, 40 bp, Artificial Sequence
  PCR primer for ORF amplification
caggagctgcacttccaacaaaactaggtttgggtagcgc

SEQ ID NO: 10599 - DNA, 40 bp, Artificial Sequence
  PCR primer for ORF amplification
caggagctgcacttccattcttttcaacagcgataacttc

SEQ ID NO: 10600 - DNA, 40 bp, Artificial Sequence
  PCR primer for ORF amplification
caggagctgcacttcctccacgctccttataacatgaagt

SEQ ID NO: 10601 - DNA, 40 bp, Artificial Sequence
  PCR primer for ORF amplification
caggagctgcacttcctagacctcttcttggccttttatt

SEQ ID NO: 10602 - DNA, 40 bp, Artificial Sequence
  PCR primer for ORF amplification
caggagctgcacttccttgtgtatctacaatctcttcaag

SEQ ID NO: 10603 - DNA, 40 bp, Artificial Sequence
  PCR primer for ORF amplification
caggagctgcacttccttcttgtatgaaatcattcacttc

SEQ ID NO: 10604 - DNA, 40 bp, Artificial Sequence
  PCR primer for ORF amplification
caggagctgcacttccaaatttcttggttaataccctttt

SEQ ID NO: 10605 - DNA, 40 bp, Artificial Sequence
  PCR primer for ORF amplification
caggagctgcacttccgtttttcttcgctaccttgttttt

SEQ ID NO: 10606 - DNA, 40 bp, Artificial Sequence
  PCR primer for ORF amplification
caggagctgcacttcctctctttcttagtaaaacacttct

SEQ ID NO: 10607 - DNA, 40 bp, Artificial Sequence
  PCR primer for ORF amplification
caggagctgcacttccgtgcgttattggcggattagtacc

SEQ ID NO: 10608 - DNA, 40 bp, Artificial Sequence
  PCR primer for ORF amplification
caggagctgcacttccacgacgaatcaaaagataagcgtt

SEQ ID NO: 10609 - DNA, 40 bp, Artificial Sequence
  PCR primer for ORF amplification
caggagctgcacttcctttctgaccgacaatccaatcgtt

SEQ ID NO: 10610 - DNA, 40 bp, Artificial Sequence
  PCR primer for ORF amplification
caggagctgcacttccgttaccagtgctaccaaagccacc

SEQ ID NO: 10611 - DNA, 40 bp, Artificial Sequence
  PCR primer for ORF amplification
caggagctgcacttccatgcatttccaacatatgtttgag

SEQ ID NO: 10612 - DNA, 40 bp, Artificial Sequence
  PCR primer for ORF amplification
caggagctgcacttcctttttgcatatatagtacatcaga

SEQ ID NO: 10613 - DNA, 40 bp, Artificial Sequence
  PCR primer for ORF amplification
caggagctgcacttccttttcggaagttataatgccataa

SEQ ID NO: 10614 - DNA, 40 bp, Artificial Sequence
  PCR primer for ORF amplification
caggagctgcacttccgtctagtctatctaaaatacttag

SEQ ID NO: 10615 - DNA, 40 bp, Artificial Sequence
  PCR primer for ORF amplification
caggagctgcacttccgagaatacattggtcaagaatttt

SEQ ID NO: 10616 - DNA, 40 bp, Artificial Sequence
  PCR primer for ORF amplification
caggagctgcacttccctttaatttgtcaaataatctagg

SEQ ID NO: 10617 - DNA, 40 bp, Artificial Sequence
  PCR primer for ORF amplification
caggagctgcacttcctttagataacaaagcagcgaattg

SEQ ID NO: 10618 - DNA, 40 bp, Artificial Sequence
  PCR primer for ORF amplification
caggagctgcacttccatttggttggtcctttttagccaa

SEQ ID NO: 10619 - DNA, 40 bp, Artificial Sequence
  PCR primer for ORF amplification
caggagctgcacttccaatgcctaattgtttttcgatttt

SEQ ID NO: 10620 - DNA, 40 bp, Artificial Sequence
  PCR primer for ORF amplification
caggagctgcacttccaaaattttgaaatgatctgagttt

SEQ ID NO: 10621 - DNA, 40 bp, Artificial Sequence
  PCR primer for ORF amplification
caggagctgcacttccacgccacagatcgggtaggtaacc

SEQ ID NO: 10622 - DNA, 40 bp, Artificial Sequence
  PCR primer for ORF amplification
caggagctgcacttcctgattgttcttcgtcagacgaatc

SEQ ID NO: 10623 - DNA, 40 bp, Artificial Sequence
  PCR primer for ORF amplification
caggagctgcacttccagagagctggaacttattacccgc

SEQ ID NO: 10624 - DNA, 40 bp, Artificial Sequence
  PCR primer for ORF amplification
caggagctgcacttcctttcttgggtataactgtcagtct

SEQ ID NO: 10625 - DNA, 40 bp, Artificial Sequence
  PCR primer for ORF amplification
caggagctgcacttccctcaccgagttcagttttcaagag

SEQ ID NO: 10626 - DNA, 40 bp, Artificial Sequence
  PCR primer for ORF amplification
caggagctgcacttccagaagagcttggaaatagctcttc

SEQ ID NO: 10627 - DNA, 40 bp, Artificial Sequence
  PCR primer for ORF amplification
caggagctgcacttccccaagcaacaccagtgtagtattc

SEQ ID NO: 10628 - DNA, 40 bp, Artificial Sequence
  PCR primer for ORF amplification
caggagctgcacttcctaaaagcatcataactgcaccagc

SEQ ID NO: 10629 - DNA, 40 bp, Artificial Sequence
  PCR primer for ORF amplification
caggagctgcacttcctcgttgtaacttgcgataaagatc

SEQ ID NO: 10630 - DNA, 40 bp, Artificial Sequence
  PCR primer for ORF amplification
caggagctgcacttcctacaaatccttcgtaagcttcatt

SEQ ID NO: 10631 - DNA, 40 bp, Artificial Sequence
  PCR primer for ORF amplification
caggagctgcacttccgctattcatcacttgttgttttgt

SEQ ID NO: 10632 - DNA, 40 bp, Artificial Sequence
  PCR primer for ORF amplification
caggagctgcacttccctgattgctgcttgcactattatc

SEQ ID NO: 10633 - DNA, 40 bp, Artificial Sequence
  PCR primer for ORF amplification
caggagctgcacttccttgtctcaaaacatcttcgatgaa

SEQ ID NO: 10634 - DNA, 40 bp, Artificial Sequence
  PCR primer for ORF amplification
caggagctgcacttccacaattttctaattgctccctcaa

SEQ ID NO: 10635 - DNA, 40 bp, Artificial Sequence
  PCR primer for ORF amplification
caggagctgcacttccgcggcaccaccagcagccatccca

SEQ ID NO: 10636 - DNA, 40 bp, Artificial Sequence
  PCR primer for ORF amplification
caggagctgcacttccttttttgggcttaacgtcagcacc

SEQ ID NO: 10637 - DNA, 40 bp, Artificial Sequence
  PCR primer for ORF amplification
caggagctgcacttccaatcaattgcttaccagcacaggc

SEQ ID NO: 10638 - DNA, 40 bp, Artificial Sequence
  PCR primer for ORF amplification
caggagctgcacttcctctgataatatggtcccagaatcg

SEQ ID NO: 10639 - DNA, 40 bp, Artificial Sequence
  PCR primer for ORF amplification
caggagctgcacttcctttcttcttttccgaatccttact

SEQ ID NO: 10640 - DNA, 40 bp, Artificial Sequence
  PCR primer for ORF amplification
caggagctgcacttcctttcgttccatctatttcgctgtt

SEQ ID NO: 10641 - DNA, 40 bp, Artificial Sequence
  PCR primer for ORF amplification
caggagctgcacttccggagatttggggtggaacttgcat

SEQ ID NO: 10642 - DNA, 40 bp, Artificial Sequence
  PCR primer for ORF amplification
caggagctgcacttcccatgtgataaattgtggaatcagc

SEQ ID NO: 10643 - DNA, 40 bp, Artificial Sequence
  PCR primer for ORF amplification
caggagctgcacttccaatttgtatctttggagccttagt

SEQ ID NO: 10644 - DNA, 40 bp, Artificial Sequence
  PCR primer for ORF amplification
caggagctgcacttccaatgaatatgctgtttggtgtcac

SEQ ID NO: 10645 - DNA, 40 bp, Artificial Sequence
  PCR primer for ORF amplification
caggagctgcacttccacgatctttggtttcttcttcttc

SEQ ID NO: 10646 - DNA, 40 bp, Artificial Sequence
  PCR primer for ORF amplification
caggagctgcacttcctgctgttttgaaaactaaaaacgc

SEQ ID NO: 10647 - DNA, 40 bp, Artificial Sequence
  PCR primer for ORF amplification
caggagctgcacttccttttgagacatcctccaagttcaa

SEQ ID NO: 10648 - DNA, 40 bp, Artificial Sequence
  PCR primer for ORF amplification
caggagctgcacttccctgaccactctgtccatcacccag

SEQ ID NO: 10649 - DNA, 40 bp, Artificial Sequence
  PCR primer for ORF amplification
caggagctgcacttcctggctttgttacgcttgcacttga

SEQ ID NO: 10650 - DNA, 40 bp, Artificial Sequence
  PCR primer for ORF amplification
caggagctgcacttccttcccactgctgtctgtttttcct

SEQ ID NO: 10651 - DNA, 40 bp, Artificial Sequence
  PCR primer for ORF amplification
caggagctgcacttccggaggtataagtatcatccgtctt

SEQ ID NO: 10652 - DNA, 40 bp, Artificial Sequence
  PCR primer for ORF amplification
caggagctgcacttcctttcttctttggagctcccaaagg

SEQ ID NO: 10653 - DNA, 40 bp, Artificial Sequence
  PCR primer for ORF amplification
caggagctgcacttcctgtagttgaccgggaagagttcaa

SEQ ID NO: 10654 - DNA, 40 bp, Artificial Sequence
  PCR primer for ORF amplification
caggagctgcacttccatcgaaggaaatctgcgcagacat

SEQ ID NO: 10655 - DNA, 40 bp, Artificial Sequence
  PCR primer for ORF amplification
caggagctgcacttcctaattcaacttcagttgaaataaa

SEQ ID NO: 10656 - DNA, 40 bp, Artificial Sequence
  PCR primer for ORF amplification
caggagctgcacttccagcgttaaccttgtagacggaatg

SEQ ID NO: 10657 - DNA, 40 bp, Artificial Sequence
  PCR primer for ORF amplification
caggagctgcacttccgatgtgcaagcctgctataataag

SEQ ID NO: 10658 - DNA, 40 bp, Artificial Sequence
  PCR primer for ORF amplification
caggagctgcacttccattggctgttgctgcagcatcttt

SEQ ID NO: 10659 - DNA, 40 bp, Artificial Sequence
  PCR primer for ORF amplification
caggagctgcacttcctacgttcacgccaggctccggaat

SEQ ID NO: 10660 - DNA, 40 bp, Artificial Sequence
  PCR primer for ORF amplification
caggagctgcacttccgtcttccttcttttgacctgccgc

SEQ ID NO: 10661 - DNA, 40 bp, Artificial Sequence
  PCR primer for ORF amplification
caggagctgcacttcctaataggtaagaaatcaaaccaag

SEQ ID NO: 10662 - DNA, 40 bp, Artificial Sequence
  PCR primer for ORF amplification
caggagctgcacttccgttttcctctaatagattaatata

SEQ ID NO: 10663 - DNA, 40 bp, Artificial Sequence
  PCR primer for ORF amplification
caggagctgcacttccgttcatcaaaattgaaatttctaa

SEQ ID NO: 10664 - DNA, 40 bp, Artificial Sequence
  PCR primer for ORF amplification
caggagctgcacttccaatgtcatcaatatcaagttcttc

SEQ ID NO: 10665 - DNA, 40 bp, Artificial Sequence
  PCR primer for ORF amplification
caggagctgcacttccttcctttgcatacctgatttgccc

SEQ ID NO: 10666 - DNA, 40 bp, Artificial Sequence
  PCR primer for ORF amplification
caggagctgcacttccaacttgtatatcctttgagtgttc

SEQ ID NO: 10667 - DNA, 40 bp, Artificial Sequence
  PCR primer for ORF amplification
caggagctgcacttccttcataaatccacttagcttgatt

SEQ ID NO: 10668 - DNA, 40 bp, Artificial Sequence
  PCR primer for ORF amplification
caggagctgcacttccagcctttggacaatccttggaaat

SEQ ID NO: 10669 - DNA, 40 bp, Artificial Sequence
  PCR primer for ORF amplification
caggagctgcacttccctctttaaaatcatcgtcttcttc

SEQ ID NO: 10670 - DNA, 40 bp, Artificial Sequence
  PCR primer for ORF amplification
caggagctgcacttcctttagattggacctgagaataacc

SEQ ID NO: 10671 - DNA, 40 bp, Artificial Sequence
  PCR primer for ORF amplification
caggagctgcacttcccgatttacttggcttcttggctcc

SEQ ID NO: 10672 - DNA, 40 bp, Artificial Sequence
  PCR primer for ORF amplification
caggagctgcacttccttcagaagaagctggactgaaact

SEQ ID NO: 10673 - DNA, 40 bp, Artificial Sequence
  PCR primer for ORF amplification
caggagctgcacttccttttttcttctcaaggcctaaaac

SEQ ID NO: 10674 - DNA, 40 bp, Artificial Sequence
  PCR primer for ORF amplification
caggagctgcacttcctacagttcttctatccgatatata

SEQ ID NO: 10675 - DNA, 40 bp, Artificial Sequence
  PCR primer for ORF amplification
caggagctgcacttccgttggttagaccaatgacaccaca

SEQ ID NO: 10676 - DNA, 40 bp, Artificial Sequence
  PCR primer for ORF amplification
caggagctgcacttcctcgactaaagtgaacagcaatggg

SEQ ID NO: 10677 - DNA, 40 bp, Artificial Sequence
  PCR primer for ORF amplification
caggagctgcacttccacgagaagtagcagcaaccttttg

SEQ ID NO: 10678 - DNA, 40 bp, Artificial Sequence
  PCR primer for ORF amplification
caggagctgcacttccacgggaagtggcggcaaccttttg

SEQ ID NO: 10679 - DNA, 40 bp, Artificial Sequence
  PCR primer for ORF amplification
caggagctgcacttccccatttttcttcagggttttcttt

SEQ ID NO: 10680 - DNA, 40 bp, Artificial Sequence
  PCR primer for ORF amplification
caggagctgcacttccccttctcttgtttcttaagaagaa

SEQ ID NO: 10681 - DNA, 40 bp, Artificial Sequence
  PCR primer for ORF amplification
caggagctgcacttccgtccttcttttcctgctgttttcg

SEQ ID NO: 10682 - DNA, 40 bp, Artificial Sequence
  PCR primer for ORF amplification
caggagctgcacttccccggcggaataactcgcgcaccat

SEQ ID NO: 10683 - DNA, 40 bp, Artificial Sequence
  PCR primer for ORF amplification
caggagctgcacttccaatttcaaagtcaaacttgttttc

SEQ ID NO: 10684 - DNA, 40 bp, Artificial Sequence
  PCR primer for ORF amplification
caggagctgcacttccgtgatggtggtcatcatttggaac

SEQ ID NO: 10685 - DNA, 40 bp, Artificial Sequence
  PCR primer for ORF amplification
caggagctgcacttcctgtcggaacgtccagcccaaccac

SEQ ID NO: 10686 - DNA, 40 bp, Artificial Sequence
  PCR primer for ORF amplification
caggagctgcacttccttttactctgcatagtacttctcc

SEQ ID NO: 10687 - DNA, 40 bp, Artificial Sequence
  PCR primer for ORF amplification
caggagctgcacttccactcaataccctttcaagattatc

SEQ ID NO: 10688 - DNA, 40 bp, Artificial Sequence
  PCR primer for ORF amplification
caggagctgcacttccatcttgcatactaacatccacatc

SEQ ID NO: 10689 - DNA, 40 bp, Artificial Sequence
  PCR primer for ORF amplification
caggagctgcacttcccgcatccatatccacatcagtatc

SEQ ID NO: 10690 - DNA, 40 bp, Artificial Sequence
  PCR primer for ORF amplification
caggagctgcacttccaacttctatcgatacccacaaaaa

SEQ ID NO: 10691 - DNA, 40 bp, Artificial Sequence
  PCR primer for ORF amplification
caggagctgcacttccgtattgacgtgcagcttcctggca

SEQ ID NO: 10692 - DNA, 40 bp, Artificial Sequence
  PCR primer for ORF amplification
caggagctgcacttccgtaatcgtcgatttcttcataaca

SEQ ID NO: 10693 - DNA, 40 bp, Artificial Sequence
  PCR primer for ORF amplification
caggagctgcacttcctaaagcttgaacttctttgacaac

SEQ ID NO: 10694 - DNA, 40 bp, Artificial Sequence
  PCR primer for ORF amplification
caggagctgcacttcctcccaatagtaattcataaacaat

SEQ ID NO: 10695 - DNA, 40 bp, Artificial Sequence
  PCR primer for ORF amplification
caggagctgcacttccatatcccttcctcttgtataatat

SEQ ID NO: 10696 - DNA, 40 bp, Artificial Sequence
  PCR primer for ORF amplification
caggagctgcacttccatgcaaaacggaggggttcctctt

SEQ ID NO: 10697 - DNA, 40 bp, Artificial Sequence
  PCR primer for ORF amplification
caggagctgcacttcccctactatcaaaggtgaatgcttt

SEQ ID NO: 10698 - DNA, 40 bp, Artificial Sequence
  PCR primer for ORF amplification
caggagctgcacttcccatagactttgggtcctcaaggtc

SEQ ID NO: 10699 - DNA, 40 bp, Artificial Sequence
  PCR primer for ORF amplification
caggagctgcacttccgtgagtattggagacattgtcaat

SEQ ID NO: 10700 - DNA, 40 bp, Artificial Sequence
  PCR primer for ORF amplification
caggagctgcacttcctatcgatcctgcgatataataacc

SEQ ID NO: 10701 - DNA, 40 bp, Artificial Sequence
  PCR primer for ORF amplification
caggagctgcacttccttcgacgtcagcatcaaaagtttg

SEQ ID NO: 10702 - DNA, 40 bp, Artificial Sequence
  PCR primer for ORF amplification
caggagctgcacttccgtctgtgcttgcacatccacggca

SEQ ID NO: 10703 - DNA, 40 bp, Artificial Sequence
  PCR primer for ORF amplification
caggagctgcacttccattcattttcacatctttactctc

SEQ ID NO: 10704 - DNA, 40 bp, Artificial Sequence
  PCR primer for ORF amplification
caggagctgcacttccgaaccagcctatactttggttttt

SEQ ID NO: 10705 - DNA, 40 bp, Artificial Sequence
  PCR primer for ORF amplification
caggagctgcacttccatcagatcttggagcttccttgaa

SEQ ID NO: 10706 - DNA, 40 bp, Artificial Sequence
  PCR primer for ORF amplification
caggagctgcacttccatcggttctagcagcttccttgaa

SEQ ID NO: 10707 - DNA, 40 bp, Artificial Sequence
  PCR primer for ORF amplification
caggagctgcacttccctggaatccggtagcaaggaaccg

SEQ ID NO: 10708 - DNA, 40 bp, Artificial Sequence
  PCR primer for ORF amplification
caggagctgcacttccttgtttggtgaatgaatgtaggtt

SEQ ID NO: 10709 - DNA, 40 bp, Artificial Sequence
  PCR primer for ORF amplification
caggagctgcacttcctatacatttacagtcttgttcttc

SEQ ID NO: 10710 - DNA, 40 bp, Artificial Sequence
  PCR primer for ORF amplification
caggagctgcacttccctcaccaatatcttcaaaccaatc

SEQ ID NO: 10711 - DNA, 40 bp, Artificial Sequence
  PCR primer for ORF amplification
caggagctgcacttccaggtacaaccttaatacccatact

SEQ ID NO: 10712 - DNA, 40 bp, Artificial Sequence
  PCR primer for ORF amplification
caggagctgcacttccagcttgcagaggttgagaggaagg

SEQ ID NO: 10713 - DNA, 40 bp, Artificial Sequence
  PCR primer for ORF amplification
caggagctgcacttcctaaaaataatagcgctgctactcc

SEQ ID NO: 10714 - DNA, 40 bp, Artificial Sequence
  PCR primer for ORF amplification
caggagctgcacttccttttctaatttgcatttccacgcc

SEQ ID NO: 10715 - DNA, 40 bp, Artificial Sequence
  PCR primer for ORF amplification
caggagctgcacttccctgattaaccattggtgctagaaa

SEQ ID NO: 10716 - DNA, 40 bp, Artificial Sequence
  PCR primer for ORF amplification
caggagctgcacttcccttctttccaagcttattttccag

SEQ ID NO: 10717 - DNA, 40 bp, Artificial Sequence
  PCR primer for ORF amplification
caggagctgcacttcctttaagagagtccaaactttttaa

SEQ ID NO: 10718 - DNA, 40 bp, Artificial Sequence
  PCR primer for ORF amplification
caggagctgcacttccgctgtggagagaatgctgcgaaat

SEQ ID NO: 10719 - DNA, 40 bp, Artificial Sequence
  PCR primer for ORF amplification
caggagctgcacttccacagacaacatcttgagtagccct

SEQ ID NO: 10720 - DNA, 40 bp, Artificial Sequence
  PCR primer for ORF amplification
caggagctgcacttccggagttagagatgttcagaaactt

SEQ ID NO: 10721 - DNA, 40 bp, Artificial Sequence
  PCR primer for ORF amplification
caggagctgcacttccaaatttcttcttctgcaattcctc

SEQ ID NO: 10722 - DNA, 40 bp, Artificial Sequence
  PCR primer for ORF amplification
caggagctgcacttccacggcgtcggttgcccatactcca

SEQ ID NO: 10723 - DNA, 40 bp, Artificial Sequence
  PCR primer for ORF amplification
caggagctgcacttcctttcaatacggattgtaggttttc

SEQ ID NO: 10724 - DNA, 40 bp, Artificial Sequence
  PCR primer for ORF amplification
caggagctgcacttcctgcgtagccagagatgatctctag

SEQ ID NO: 10725 - DNA, 40 bp, Artificial Sequence
  PCR primer for ORF amplification
caggagctgcacttccagaaaacaaataagcgattgtttc

SEQ ID NO: 10726 - DNA, 40 bp, Artificial Sequence
  PCR primer for ORF amplification
caggagctgcacttcccacaaaacacaaacgcaaaggaat

SEQ ID NO: 10727 - DNA, 40 bp, Artificial Sequence
  PCR primer for ORF amplification
caggagctgcacttccatttgcgcctacaggatgtgtttt

SEQ ID NO: 10728 - DNA, 40 bp, Artificial Sequence
  PCR primer for ORF amplification
caggagctgcacttcctaactctttttttaaaaactgttt

SEQ ID NO: 10729 - DNA, 40 bp, Artificial Sequence
  PCR primer for ORF amplification
caggagctgcacttccactatcggtgcaaatagctataaa

SEQ ID NO: 10730 - DNA, 40 bp, Artificial Sequence
  PCR primer for ORF amplification
caggagctgcacttcctgcttcgtcgtcttcgtcttcact

SEQ ID NO: 10731 - DNA, 40 bp, Artificial Sequence
  PCR primer for ORF amplification
caggagctgcacttccaaccagcagccataccttcggatt

SEQ ID NO: 10732 - DNA, 40 bp, Artificial Sequence
  PCR primer for ORF amplification
caggagctgcacttccgttcatactcagttctgatattct

SEQ ID NO: 10733 - DNA, 40 bp, Artificial Sequence
  PCR primer for ORF amplification
caggagctgcacttcctaaattttccaatgaattagcaat

SEQ ID NO: 10734 - DNA, 40 bp, Artificial Sequence
  PCR primer for ORF amplification
caggagctgcacttcctttagatctcatacgtttatttat

SEQ ID NO: 10735 - DNA, 40 bp, Artificial Sequence
  PCR primer for ORF amplification
caggagctgcacttcctttacttaacaggctttggatttc

SEQ ID NO: 10736 - DNA, 40 bp, Artificial Sequence
  PCR primer for ORF amplification
caggagctgcacttcccttgttgttttcgctcgacaggag

SEQ ID NO: 10737 - DNA, 40 bp, Artificial Sequence
  PCR primer for ORF amplification
caggagctgcacttccgttgtctaccgttttggatggtaa

SEQ ID NO: 10738 - DNA, 40 bp, Artificial Sequence
  PCR primer for ORF amplification
caggagctgcacttccttgatacttggacaagtccggcat

SEQ ID NO: 10739 - DNA, 40 bp, Artificial Sequence
  PCR primer for ORF amplification
caggagctgcacttccgccgacaaacttttcagcttcaat

SEQ ID NO: 10740 - DNA, 40 bp, Artificial Sequence
  PCR primer for ORF amplification
caggagctgcacttccctccaatatattctgtttgagctt

SEQ ID NO: 10741 - DNA, 40 bp, Artificial Sequence
  PCR primer for ORF amplification
caggagctgcacttccacctagcttgtagccaaacaaatc

SEQ ID NO: 10742 - DNA, 40 bp, Artificial Sequence
  PCR primer for ORF amplification
caggagctgcacttcctaattcaccggacttggcaacaac

SEQ ID NO: 10743 - DNA, 40 bp, Artificial Sequence
  PCR primer for ORF amplification
caggagctgcacttcctttaccaaataatacagttctcat

SEQ ID NO: 10744 - DNA, 40 bp, Artificial Sequence
  PCR primer for ORF amplification
caggagctgcacttccttctgaagaagcagcattttcttg

SEQ ID NO: 10745 - DNA, 40 bp, Artificial Sequence
  PCR primer for ORF amplification
caggagctgcacttcccgaagtcatgtcggaagacgtgaa

SEQ ID NO: 10746 - DNA, 40 bp, Artificial Sequence
  PCR primer for ORF amplification
caggagctgcacttccatcggtgattgaatctaagaaaag

SEQ ID NO: 10747 - DNA, 40 bp, Artificial Sequence
  PCR primer for ORF amplification
caggagctgcacttccttccacctctttcaaaagttcttc

SEQ ID NO: 10748 - DNA, 40 bp, Artificial Sequence
  PCR primer for ORF amplification
caggagctgcacttcctttcaattggttaaaaattgattc

SEQ ID NO: 10749 - DNA, 40 bp, Artificial Sequence; identical to SEQ ID NO: 10460
  PCR primer for ORF amplification

SEQ ID NO: 10750 - DNA, 40 bp, Artificial Sequence
  PCR primer for ORF amplification
caggagctgcacttccgatgagtggctgcaagggttctgt

SEQ ID NO: 10751 - DNA, 40 bp, Artificial Sequence
  PCR primer for ORF amplification
caggagctgcacttcccagttccttgattaaagattctac

SEQ ID NO: 10752 - DNA, 40 bp, Artificial Sequence
  PCR primer for ORF amplification
caggagctgcacttcctttcttcaccgcatttaatttatc

SEQ ID NO: 10753 - DNA, 40 bp, Artificial Sequence
  PCR primer for ORF amplification
caggagctgcacttccttcagagcctctagtgttcaaaat

SEQ ID NO: 10754 - DNA, 40 bp, Artificial Sequence
  PCR primer for ORF amplification
caggagctgcacttccgttttctggaatttcaatttcacc

SEQ ID NO: 10755 - DNA, 40 bp, Artificial Sequence
  PCR primer for ORF amplification
caggagctgcacttccattttctgggatttcgatttcacc

SEQ ID NO: 10756 - DNA, 40 bp, Artificial Sequence
  PCR primer for ORF amplification
caggagctgcacttcctcgtaacaaaaagtcttcgtccag

SEQ ID NO: 10757 - DNA, 40 bp, Artificial Sequence
  PCR primer for ORF amplification
caggagctgcacttcctttctgtttgagtatttccaactt

SEQ ID NO: 10758 - DNA, 40 bp, Artificial Sequence
  PCR primer for ORF amplification
caggagctgcacttccacgagattctcctccaaggcaata

SEQ ID NO: 10759 - DNA, 40 bp, Artificial Sequence
  PCR primer for ORF amplification
caggagctgcacttccgtacattggttggccgggttttaa

SEQ ID NO: 10760 - DNA, 40 bp, Artificial Sequence
  PCR primer for ORF amplification
caggagctgcacttccatacgtatatgtcattgaagaaag

SEQ ID NO: 10761 - DNA, 40 bp, Artificial Sequence
  PCR primer for ORF amplification
caggagctgcacttcccgataacatggttggagtgtttct

SEQ ID NO: 10762 - DNA, 40 bp, Artificial Sequence
  PCR primer for ORF amplification
caggagctgcacttccgaatcctaatgatttcaaaatgga

SEQ ID NO: 10763 - DNA, 40 bp, Artificial Sequence
  PCR primer for ORF amplification
caggagctgcacttccaaaggtttctccttccttcggttg

SEQ ID NO: 10764 - DNA, 40 bp, Artificial Sequence
  PCR primer for ORF amplification
caggagctgcacttcctactggcagaaccctaactcccgc

SEQ ID NO: 10765 - DNA, 40 bp, Artificial Sequence
  PCR primer for ORF amplification
caggagctgcacttccttttagaacgaagttggcccctct

SEQ ID NO: 10766 - DNA, 40 bp, Artificial Sequence
  PCR primer for ORF amplification
caggagctgcacttccagtactggctgaggcagtagactc

SEQ ID NO: 10767 - DNA, 40 bp, Artificial Sequence
  PCR primer for ORF amplification
caggagctgcacttcctgaaagtttaccctttcttgccgc

SEQ ID NO: 10768 - DNA, 40 bp, Artificial Sequence
  PCR primer for ORF amplification
caggagctgcacttcctttcttgtcgtatctggagtagta

SEQ ID NO: 10769 - DNA, 40 bp, Artificial Sequence
  PCR primer for ORF amplification
caggagctgcacttccttcttgatcagtaacgtcttcgtc

SEQ ID NO: 10770 - DNA, 40 bp, Artificial Sequence
  PCR primer for ORF amplification
caggagctgcacttccctcgccccccagcagagcactcaa

SEQ ID NO: 10771 - DNA, 40 bp, Artificial Sequence
  PCR primer for ORF amplification
caggagctgcacttccgatcttttcttccacaataccgtg

SEQ ID NO: 10772 - DNA, 40 bp, Artificial Sequence
  PCR primer for ORF amplification
caggagctgcacttcctgaatcttcataacctaaccaact

SEQ ID NO: 10773 - DNA, 40 bp, Artificial Sequence
  PCR primer for ORF amplification
caggagctgcacttccaatctgttcttctggtggttgatt

SEQ ID NO: 10774 - DNA, 40 bp, Artificial Sequence
  PCR primer for ORF amplification
caggagctgcacttccattatcaaggatttcattgttagc

SEQ ID NO: 10775 - DNA, 40 bp, Artificial Sequence
  PCR primer for ORF amplification
caggagctgcacttcccaacatctctctaacaacggcctc

SEQ ID NO: 10776 - DNA, 40 bp, Artificial Sequence
  PCR primer for ORF amplification
caggagctgcacttcctaggtttgtgttgtaatatttaga

SEQ ID NO: 10777 - DNA, 40 bp, Artificial Sequence
  PCR primer for ORF amplification
caggagctgcacttcctttttttgttttcttgaggttttt

SEQ ID NO: 10778 - DNA, 40 bp, Artificial Sequence
  PCR primer for ORF amplification
caggagctgcacttccacgcttttttttgcccttgttttt

SEQ ID NO: 10779 - DNA, 40 bp, Artificial Sequence
  PCR primer for ORF amplification
caggagctgcacttcctaatacatgcccacgacatcgctc

SEQ ID NO: 10780 - DNA, 40 bp, Artificial Sequence
  PCR primer for ORF amplification
caggagctgcacttccatccttcttgaggtttaaagacgc

SEQ ID NO: 10781 - DNA, 40 bp, Artificial Sequence
  PCR primer for ORF amplification
caggagctgcacttcctttgctaataccccttttttccaa

SEQ ID NO: 10782 - DNA, 40 bp, Artificial Sequence
  PCR primer for ORF amplification
caggagctgcacttcccaaggcattgatatggacttcagc

SEQ ID NO: 10783 - DNA, 40 bp, Artificial Sequence
  PCR primer for ORF amplification
caggagctgcacttccctgcctctttttttccacaggttt

SEQ ID NO: 10784 - DNA, 40 bp, Artificial Sequence
  PCR primer for ORF amplification
caggagctgcacttccccagacgccttggttcccactatc

SEQ ID NO: 10785 - DNA, 40 bp, Artificial Sequence
  PCR primer for ORF amplification
caggagctgcacttcctctaatgggtgattcagtatacaa

SEQ ID NO: 10786 - DNA, 40 bp, Artificial Sequence
  PCR primer for ORF amplification
caggagctgcacttccctgcttagctgtttccgtctctac

SEQ ID NO: 10787 - DNA, 40 bp, Artificial Sequence
  PCR primer for ORF amplification
caggagctgcacttccctttccagagctataagatatatt

SEQ ID NO: 10788 - DNA, 40 bp, Artificial Sequence
  PCR primer for ORF amplification
caggagctgcacttccccatatctcgaacactcttgccaa

SEQ ID NO: 10789 - DNA, 40 bp, Artificial Sequence
  PCR primer for ORF amplification
caggagctgcacttcctatatagtaatctgttatcccctg

SEQ ID NO: 10790 - DNA, 40 bp, Artificial Sequence
  PCR primer for ORF amplification
caggagctgcacttccaaaagcatttttaccgaacttaac

SEQ ID NO: 10791 - DNA, 40 bp, Artificial Sequence
  PCR primer for ORF amplification
caggagctgcacttccgaaacgctccactttacttcgtac

SEQ ID NO: 10792 - DNA, 40 bp, Artificial Sequence
  PCR primer for ORF amplification
caggagctgcacttcctttctttcttcttagacctgcctc

SEQ ID NO: 10793 - DNA, 40 bp, Artificial Sequence
  PCR primer for ORF amplification
caggagctgcacttcccataatgctaatgggccggatgtt

SEQ ID NO: 10794 - DNA, 40 bp, Artificial Sequence
  PCR primer for ORF amplification
caggagctgcacttccaggaagaaatccacccttctttaa

SEQ ID NO: 10795 - DNA, 40 bp, Artificial Sequence
  PCR primer for ORF amplification
caggagctgcacttcctcgtgactgtgggagagccagttc

SEQ ID NO: 10796 - DNA, 40 bp, Artificial Sequence
  PCR primer for ORF amplification
caggagctgcacttccccagaagcgccaccagcttttaac

SEQ ID NO: 10797 - DNA, 40 bp, Artificial Sequence
  PCR primer for ORF amplification
caggagctgcacttccacctacccgcttgatcacatgaac

SEQ ID NO: 10798 - DNA, 40 bp, Artificial Sequence
  PCR primer for ORF amplification
caggagctgcacttccacaaaaaaagtattctgtgttcca

SEQ ID NO: 10799 - DNA, 40 bp, Artificial Sequence
  PCR primer for ORF amplification
caggagctgcacttccacccataacgagcttcttgaattc

SEQ ID NO: 10800 - DNA, 40 bp, Artificial Sequence
  PCR primer for ORF amplification
caggagctgcacttccgtcatcatgaaccagtgtcttttc

SEQ ID NO: 10801 - DNA, 40 bp, Artificial Sequence
  PCR primer for ORF amplification
caggagctgcacttcctatagaagactctttataatttct

SEQ ID NO: 10802 - DNA, 40 bp, Artificial Sequence
  PCR primer for ORF amplification
caggagctgcacttccatagacaaattcatcaagatatgc

SEQ ID NO: 10803 - DNA, 40 bp, Artificial Sequence
  PCR primer for ORF amplification
caggagctgcacttccaatagcacccaaataatcttcttt

SEQ ID NO: 10804 - DNA, 40 bp, Artificial Sequence
  PCR primer for ORF amplification
caggagctgcacttccactaaaatcgttgttattaacgtt

SEQ ID NO: 10805 - DNA, 40 bp, Artificial Sequence
  PCR primer for ORF amplification
caggagctgcacttccaaagatgaatgaaagccacgacga

SEQ ID NO: 10806 - DNA, 40 bp, Artificial Sequence
  PCR primer for ORF amplification
caggagctgcacttccactaaacatatctagttgttgata

SEQ ID NO: 10807 - DNA, 40 bp, Artificial Sequence
  PCR primer for ORF amplification
caggagctgcacttccttgtccttcttgctcttcctcgat

SEQ ID NO: 10808 - DNA, 40 bp, Artificial Sequence
  PCR primer for ORF amplification
caggagctgcacttccgtctgcttcgtcgtcgtcgtcgtc

SEQ ID NO: 10809 - DNA, 40 bp, Artificial Sequence
  PCR primer for ORF amplification
caggagctgcacttccgtacatgtcagatttatggaaatc

SEQ ID NO: 10810 - DNA, 40 bp, Artificial Sequence
  PCR primer for ORF amplification
caggagctgcacttccattaatagtcttcttctttcttat

SEQ ID NO: 10811 - DNA, 40 bp, Artificial Sequence
  PCR primer for ORF amplification
caggagctgcacttccccttggtgggaagatgacttctcc

SEQ ID NO: 10812 - DNA, 40 bp, Artificial Sequence
  PCR primer for ORF amplification
caggagctgcacttccctctctttctaccaagtttgttac

SEQ ID NO: 10813 - DNA, 40 bp, Artificial Sequence
  PCR primer for ORF amplification
caggagctgcacttccgacttgggaaatggttggaacacc

SEQ ID NO: 10814 - DNA, 40 bp, Artificial Sequence
  PCR primer for ORF amplification
caggagctgcacttccatcgtcctcgttttcgttttcgtt

SEQ ID NO: 10815 - DNA, 40 bp, Artificial Sequence
  PCR primer for ORF amplification
caggagctgcacttccgttctccagttttctacccaattt

SEQ ID NO: 10816 - DNA, 40 bp, Artificial Sequence
  PCR primer for ORF amplification
caggagctgcacttccgtagaaatactcctcatcttcatc

SEQ ID NO: 10817 - DNA, 40 bp, Artificial Sequence
  PCR primer for ORF amplification
caggagctgcacttccttggtcactgtcaagaatgattgt

SEQ ID NO: 10818 - DNA, 40 bp, Artificial Sequence
  PCR primer for ORF amplification
caggagctgcacttccgtgaaagtacgcatcgtagagctg

SEQ ID NO: 10819 - DNA, 40 bp, Artificial Sequence
  PCR primer for ORF amplification
caggagctgcacttccttggcttttagaaatggccttctc

SEQ ID NO: 10820 - DNA, 40 bp, Artificial Sequence
  PCR primer for ORF amplification
caggagctgcacttcctttctgggaagggtgagggagctg

SEQ ID NO: 10821 - DNA, 40 bp, Artificial Sequence
  PCR primer for ORF amplification
caggagctgcacttcctctgcagagtaaccgagaaagccg

SEQ ID NO: 10822 - DNA, 40 bp, Artificial Sequence
  PCR primer for ORF amplification
caggagctgcacttccaacctgggaaattgtaggtatgcc

SEQ ID NO: 10823 - DNA, 40 bp, Artificial Sequence
  PCR primer for ORF amplification
caggagctgcacttccttgtctttgcatccgcaaatttct

SEQ ID NO: 10824 - DNA, 40 bp, Artificial Sequence
  PCR primer for ORF amplification
caggagctgcacttcctttatcgagcacatcagcgtcgta

SEQ ID NO: 10825 - DNA, 40 bp, Artificial Sequence
  PCR primer for ORF amplification
caggagctgcacttcctttgtccaaaacatcagcatcgta

SEQ ID NO: 10826 - DNA, 40 bp, Artificial Sequence
  PCR primer for ORF amplification
caggagctgcacttcctttagacaaggacatgatagcgtt

SEQ ID NO: 10827 - DNA, 40 bp, Artificial Sequence
  PCR primer for ORF amplification
caggagctgcacttcccatcacattcaaattgccgaatct

SEQ ID NO: 10828 - DNA, 40 bp, Artificial Sequence
  PCR primer for ORF amplification
caggagctgcacttcctaaggccaaatgtacaaacacatc

SEQ ID NO: 10829 - DNA, 40 bp, Artificial Sequence
  PCR primer for ORF amplification
caggagctgcacttcctttactagcattactctctttttc

SEQ ID NO: 10830 - DNA, 40 bp, Artificial Sequence
  PCR primer for ORF amplification
caggagctgcacttcctctaacatgcttatggagaaattc

SEQ ID NO: 10831 - DNA, 40 bp, Artificial Sequence
  PCR primer for ORF amplification
caggagctgcacttcctttggacaaatgcttacgtgctaa

SEQ ID NO: 10832 - DNA, 40 bp, Artificial Sequence
  PCR primer for ORF amplification
caggagctgcacttcctgggaaaaatgggccgcccagggt

SEQ ID NO: 10833 - DNA, 40 bp, Artificial Sequence
  PCR primer for ORF amplification
caggagctgcacttcctaactttaacatcaaatataatga

SEQ ID NO: 10834 - DNA, 40 bp, Artificial Sequence
  PCR primer for ORF amplification
caggagctgcacttccttctttctgcattttgtcaaatac

SEQ ID NO: 10835 - DNA, 40 bp, Artificial Sequence
  PCR primer for ORF amplification
caggagctgcacttccccgtctagcttccaggagagcaat

SEQ ID NO: 10836 - DNA, 40 bp, Artificial Sequence
  PCR primer for ORF amplification
caggagctgcacttcctaacctctttctgtatatttccaa

SEQ ID NO: 10837 - DNA, 40 bp, Artificial Sequence
  PCR primer for ORF amplification
caggagctgcacttcctttatgtcgtgccatgtttataaa

SEQ ID NO: 10838 - DNA, 40 bp, Artificial Sequence
  PCR primer for ORF amplification
caggagctgcacttccaaactgaggatttctcgcctcttc

SEQ ID NO: 10839 - DNA, 40 bp, Artificial Sequence
  PCR primer for ORF amplification
caggagctgcacttcctaaaaaacttggtttgggcaagtt

SEQ ID NO: 10840 - DNA, 40 bp, Artificial Sequence
  PCR primer for ORF amplification
caggagctgcacttcctgtggccagccggccatgcattag

SEQ ID NO: 10841 - DNA, 40 bp, Artificial Sequence
  PCR primer for ORF amplification
caggagctgcacttccagaaatgtgttttttcaataagat

SEQ ID NO: 10842 - DNA, 40 bp, Artificial Sequence
  PCR primer for ORF amplification
caggagctgcacttcccaaatgagccaagacactttcgac

SEQ ID NO: 10843 - DNA, 40 bp, Artificial Sequence
  PCR primer for ORF amplification
caggagctgcacttccagaagaatcctccgacttaaccgg

SEQ ID NO: 10844 - DNA, 40 bp, Artificial Sequence
  PCR primer for ORF amplification
caggagctgcacttcccaacaggccggtaccattctttat

SEQ ID NO: 10845 - DNA, 40 bp, Artificial Sequence
  PCR primer for ORF amplification
caggagctgcacttccgtttgccggagattgttcctgtgc

SEQ ID NO: 10846 - DNA, 40 bp, Artificial Sequence
  PCR primer for ORF amplification
caggagctgcacttcccatctttaagtaacctagttttcc

SEQ ID NO: 10847 - DNA, 40 bp, Artificial Sequence
  PCR primer for ORF amplification
caggagctgcacttccgctaccattaccgtactcaccata

SEQ ID NO: 10848 - DNA, 40 bp, Artificial Sequence
  PCR primer for ORF amplification
caggagctgcacttcccagctgatatactgtaaaactcat

SEQ ID NO: 10849 - DNA, 40 bp, Artificial Sequence
  PCR primer for ORF amplification
caggagctgcacttccgtatcctttcctcttggcatcttt

SEQ ID NO: 10850 - DNA, 40 bp, Artificial Sequence
  PCR primer for ORF amplification
caggagctgcacttcccttcttgtctctcttcttactggc

SEQ ID NO: 10851 - DNA, 40 bp, Artificial Sequence
  PCR primer for ORF amplification
caggagctgcacttccattagattgagggcgtgcgtagtt

SEQ ID NO: 10852 - DNA, 40 bp, Artificial Sequence
  PCR primer for ORF amplification
caggagctgcacttccttctaaaatggctcttttgctaat

SEQ ID NO: 10853 - DNA, 40 bp, Artificial Sequence
  PCR primer for ORF amplification
caggagctgcacttccaacgccccaaagaacgatgctgcg

SEQ ID NO: 10854 - DNA, 40 bp, Artificial Sequence
  PCR primer for ORF amplification
caggagctgcacttccaacctttccactcaggtaatcttg

SEQ ID NO: 10855 - DNA, 40 bp, Artificial Sequence
  PCR primer for ORF amplification
caggagctgcacttccttcattttttttggtgtcgaggac

SEQ ID NO: 10856 - DNA, 40 bp, Artificial Sequence
  PCR primer for ORF amplification
caggagctgcacttccttcatttcctccaacgacttgttc

SEQ ID NO: 10857 - DNA, 40 bp, Artificial Sequence
  PCR primer for ORF amplification
caggagctgcacttcctagagatttgttcatgaatcttct

SEQ ID NO: 10858 - DNA, 40 bp, Artificial Sequence
  PCR primer for ORF amplification
caggagctgcacttccaacagcatattttttagtccactc

SEQ ID NO: 10859 - DNA, 40 bp, Artificial Sequence
  PCR primer for ORF amplification
caggagctgcacttccctcgtttctcctcctatctaaaaa

SEQ ID NO: 10860 - DNA, 40 bp, Artificial Sequence
  PCR primer for ORF amplification
caggagctgcacttccgtatccgtttctcttgtaaagaac

SEQ ID NO: 10861 - DNA, 40 bp, Artificial Sequence
  PCR primer for ORF amplification
caggagctgcacttccttcgttagcatttttccagatatc

SEQ ID NO: 10862 - DNA, 40 bp, Artificial Sequence
  PCR primer for ORF amplification
caggagctgcacttcctatcttcctcctttttatgcgttg

SEQ ID NO: 10863 - DNA, 40 bp, Artificial Sequence
  PCR primer for ORF amplification
caggagctgcacttccctttgcatacatatctttgataca

SEQ ID NO: 10864 - DNA, 40 bp, Artificial Sequence
  PCR primer for ORF amplification
caggagctgcacttcctattgcaggtatgcccacatctgg

SEQ ID NO: 10865 - DNA, 40 bp, Artificial Sequence
  PCR primer for ORF amplification
caggagctgcacttcccgtactataaattaccttttgtaa

SEQ ID NO: 10866 - DNA, 40 bp, Artificial Sequence
  PCR primer for ORF amplification
caggagctgcacttccgtagtctaggtccggagcgggctt

SEQ ID NO: 10867 - DNA, 40 bp, Artificial Sequence
  PCR primer for ORF amplification
caggagctgcacttccatccaaattcaaatcttcttctag

SEQ ID NO: 10868 - DNA, 40 bp, Artificial Sequence
  PCR primer for ORF amplification
caggagctgcacttccgtactgattgatcagggcaatgta

SEQ ID NO: 10869 - DNA, 40 bp, Artificial Sequence
  PCR primer for ORF amplification
caggagctgcacttccatgacgacgagaggcagcaatgat

SEQ ID NO: 10870 - DNA, 40 bp, Artificial Sequence
  PCR primer for ORF amplification
caggagctgcacttccgatgttcatcttggttcttctcca

SEQ ID NO: 10871 - DNA, 40 bp, Artificial Sequence
  PCR primer for ORF amplification
caggagctgcacttcctacagcgtatttctttgtccattc

SEQ ID NO: 10872 - DNA, 40 bp, Artificial Sequence
  PCR primer for ORF amplification
caggagctgcacttccatctacgcaggcatgttctctaag

SEQ ID NO: 10873 - DNA, 40 bp, Artificial Sequence
  PCR primer for ORF amplification
caggagctgcacttccattgcataaagtgtcaatcagcac

SEQ ID NO: 10874 - DNA, 40 bp, Artificial Sequence
  PCR primer for ORF amplification
caggagctgcacttccctcaaagcgcactccagctttttc

SEQ ID NO: 10875 - DNA, 40 bp, Artificial Sequence
  PCR primer for ORF amplification
caggagctgcacttcctttaaagacacatgatttattaat

SEQ ID NO: 10876 - DNA, 40 bp, Artificial Sequence
  PCR primer for ORF amplification
caggagctgcacttcccaaatccacaatgagttcctccac

SEQ ID NO: 10877 - DNA, 40 bp, Artificial Sequence
  PCR primer for ORF amplification
caggagctgcacttccttttttatcatcttcttcgtcatc

SEQ ID NO: 10878 - DNA, 40 bp, Artificial Sequence
  PCR primer for ORF amplification
caggagctgcacttccaattgtgtaggatatgtttgtata

SEQ ID NO: 10879 - DNA, 40 bp, Artificial Sequence
  PCR primer for ORF amplification
caggagctgcacttccagtaaacaaggtgtcttcatctct

SEQ ID NO: 10880 - DNA, 40 bp, Artificial Sequence
  PCR primer for ORF amplification
caggagctgcacttccttcctgctcagacaacgtttcaac

SEQ ID NO: 10881 - DNA, 40 bp, Artificial Sequence
  PCR primer for ORF amplification
caggagctgcacttcccttcttggcttcaatcttttgact

SEQ ID NO: 10882 - DNA, 40 bp, Artificial Sequence
  PCR primer for ORF amplification
caggagctgcacttcctacaggttcaaatatactatctgt

SEQ ID NO: 10883 - DNA, 40 bp, Artificial Sequence
  PCR primer for ORF amplification
caggagctgcacttccacgatacttgtacttaattttaga

SEQ ID NO: 10884 - DNA, 40 bp, Artificial Sequence
  PCR primer for ORF amplification
caggagctgcacttccggattgattcttcaagttgttgct

SEQ ID NO: 10885 - DNA, 40 bp, Artificial Sequence
  PCR primer for ORF amplification
caggagctgcacttccagttgagtttttcaaactgttact

SEQ ID NO: 10886 - DNA, 40 bp, Artificial Sequence
  PCR primer for ORF amplification
caggagctgcacttccggagtgcaatatggaaaaaatagg

SEQ ID NO: 10887 - DNA, 40 bp, Artificial Sequence
  PCR primer for ORF amplification
caggagctgcacttcctttagattgaacttgagaataacc

SEQ ID NO: 10888 - DNA, 40 bp, Artificial Sequence
  PCR primer for ORF amplification
caggagctgcacttcctaaatatttatatacaaatgggaa

SEQ ID NO: 10889 - DNA, 40 bp, Artificial Sequence
  PCR primer for ORF amplification
caggagctgcacttccagccaaggtggtcaagatatcaga

SEQ ID NO: 10890 - DNA, 40 bp, Artificial Sequence
  PCR primer for ORF amplification
caggagctgcacttcctatcgtcgtcttttttcttttcca

SEQ ID NO: 10891 - DNA, 40 bp, Artificial Sequence
  PCR primer for ORF amplification
caggagctgcacttcccttacctttaataatgcttgatga

SEQ ID NO: 10892 - DNA, 40 bp, Artificial Sequence
  PCR primer for ORF amplification
caggagctgcacttccgggactactaaactgaaatatgct

SEQ ID NO: 10893 - DNA, 40 bp, Artificial Sequence
  PCR primer for ORF amplification
caggagctgcacttccccaaaaccatctcctataccaagg

SEQ ID NO: 10894 - DNA, 40 bp, Artificial Sequence
  PCR primer for ORF amplification
caggagctgcacttcctaactcaccagcttcttcgataac

SEQ ID NO: 10895 - DNA, 40 bp, Artificial Sequence
  PCR primer for ORF amplification
caggagctgcacttccgttgagagggtagcgagcattata

SEQ ID NO: 10896 - DNA, 40 bp, Artificial Sequence
  PCR primer for ORF amplification
caggagctgcacttccgtccttttttaaagtccgaacgcg

SEQ ID NO: 10897 - DNA, 40 bp, Artificial Sequence
  PCR primer for ORF amplification
caggagctgcacttccatggttgttgatccgctctctttc

SEQ ID NO: 10898 - DNA, 40 bp, Artificial Sequence
  PCR primer for ORF amplification
caggagctgcacttcctttctttggaacgtttgtgttgtt

SEQ ID NO: 10899 - DNA, 40 bp, Artificial Sequence
  PCR primer for ORF amplification
caggagctgcacttcctaactgttcctcttttataacatc

SEQ ID NO: 10900 - DNA, 40 bp, Artificial Sequence
  PCR primer for ORF amplification
caggagctgcacttcctgaaaaatcaaaatcgtcgatttg

SEQ ID NO: 10901 - DNA, 40 bp, Artificial Sequence
  PCR primer for ORF amplification
caggagctgcacttcccttcctgtttttgagtagtccctc

SEQ ID NO: 10902 - DNA, 40 bp, Artificial Sequence
  PCR primer for ORF amplification
caggagctgcacttcccggtcttcttgtggtagtgttact

SEQ ID NO: 10903 - DNA, 40 bp, Artificial Sequence
  PCR primer for ORF amplification
caggagctgcacttccgtcatcgatatcgttagcttcagc

SEQ ID NO: 10904 - DNA, 40 bp, Artificial Sequence
  PCR primer for ORF amplification
caggagctgcacttccagcttcaaccatttctcttaatct

SEQ ID NO: 10905 - DNA, 40 bp, Artificial Sequence
  PCR primer for ORF amplification
caggagctgcacttccaatttttagcagagaatcctcggg

SEQ ID NO: 10906 - DNA, 40 bp, Artificial Sequence
  PCR primer for ORF amplification
caggagctgcacttcccttcttccctcctttcttttttcc

SEQ ID NO: 10907 - DNA, 40 bp, Artificial Sequence
  PCR primer for ORF amplification
caggagctgcacttccgagcgtcaaagaatatgaatattc

SEQ ID NO: 10908 - DNA, 40 bp, Artificial Sequence
  PCR primer for ORF amplification
caggagctgcacttccaaagggaaccgtcaaggggcctgg

SEQ ID NO: 10909 - DNA, 40 bp, Artificial Sequence
  PCR primer for ORF amplification
caggagctgcacttcccatttctctcagataatgagtagg

SEQ ID NO: 10910 - DNA, 40 bp, Artificial Sequence
  PCR primer for ORF amplification
caggagctgcacttccaactttgtttttattttccacggt

SEQ ID NO: 10911 - DNA, 40 bp, Artificial Sequence
  PCR primer for ORF amplification
caggagctgcacttccgtgattcatttccaattgttttcc

SEQ ID NO: 10912 - DNA, 40 bp, Artificial Sequence
  PCR primer for ORF amplification
caggagctgcacttcccataacggaaccaaccatggaata

SEQ ID NO: 10913 - DNA, 40 bp, Artificial Sequence
  PCR primer for ORF amplification
caggagctgcacttccactaaagtccaaaatttctaaaag

SEQ ID NO: 10914 - DNA, 40 bp, Artificial Sequence
  PCR primer for ORF amplification
caggagctgcacttccaaatcccaaaaagttgtataattt

SEQ ID NO: 10915 - DNA, 40 bp, Artificial Sequence
  PCR primer for ORF amplification
caggagctgcacttccttggtttcttaaaactttagcaat

SEQ ID NO: 10916 - DNA, 40 bp, Artificial Sequence
  PCR primer for ORF amplification
caggagctgcacttcctgacttattttttttgtcgtcatc

SEQ ID NO: 10917 - DNA, 40 bp, Artificial Sequence
  PCR primer for ORF amplification
caggagctgcacttccattttcaatatcaaaactacttcc

SEQ ID NO: 10918 - DNA, 40 bp, Artificial Sequence
  PCR primer for ORF amplification
caggagctgcacttccgagcagtccatcaaggaaatcctg

SEQ ID NO: 10919 - DNA, 40 bp, Artificial Sequence
  PCR primer for ORF amplification
caggagctgcacttcctttgaaaatttccttgaattgctt

SEQ ID NO: 10920 - DNA, 40 bp, Artificial Sequence
  PCR primer for ORF amplification
caggagctgcacttcctgtaatccatacccaaaaaaatag

SEQ ID NO: 10921 - DNA, 40 bp, Artificial Sequence
  PCR primer for ORF amplification
caggagctgcacttccaccaaacgctacggatgcacaata

SEQ ID NO: 10922 - DNA, 40 bp, Artificial Sequence
  PCR primer for ORF amplification
caggagctgcacttcccttttttgaatttctatttttatt

SEQ ID NO: 10923 - DNA, 40 bp, Artificial Sequence
  PCR primer for ORF amplification
caggagctgcacttccttgattacttaatcttctaataca

SEQ ID NO: 10924 - DNA, 40 bp, Artificial Sequence
  PCR primer for ORF amplification
caggagctgcacttcccctgcccatgttccgtctcttaat

SEQ ID NO: 10925 - DNA, 40 bp, Artificial Sequence
  PCR primer for ORF amplification
caggagctgcacttcctccacctttcctaccatcgtcttg

SEQ ID NO: 10926 - DNA, 40 bp, Artificial Sequence
  PCR primer for ORF amplification
caggagctgcacttcccttatttgcagtggtctccctctc

SEQ ID NO: 10927 - DNA, 40 bp, Artificial Sequence
  PCR primer for ORF amplification
caggagctgcacttcctgctttgaatccatctaggataca

SEQ ID NO: 10928 - DNA, 40 bp, Artificial Sequence
  PCR primer for ORF amplification
caggagctgcacttccaaattcgaccttttgtggagaaga

SEQ ID NO: 10929 - DNA, 40 bp, Artificial Sequence
  PCR primer for ORF amplification
caggagctgcacttcctttttctgcaaagataaaatcctt

SEQ ID NO: 10930 - DNA, 40 bp, Artificial Sequence
  PCR primer for ORF amplification
caggagctgcacttccttttttcaacgcttccttttgagc

SEQ ID NO: 10931 - DNA, 40 bp, Artificial Sequence
  PCR primer for ORF amplification
caggagctgcacttcctttatttttaaatataaaattttt

SEQ ID NO: 10932 - DNA, 40 bp, Artificial Sequence
  PCR primer for ORF amplification
caggagctgcacttcccaatctactaaggcttaagctatt

SEQ ID NO: 10933 - DNA, 40 bp, Artificial Sequence
  PCR primer for ORF amplification
caggagctgcacttccttcagccttaacaccagcgttacc

SEQ ID NO: 10934 - DNA, 40 bp, Artificial Sequence
  PCR primer for ORF amplification
caggagctgcacttcctattttcaaagaggtcttcaaacg

SEQ ID NO: 10935 - DNA, 40 bp, Artificial Sequence
  PCR primer for ORF amplification
caggagctgcacttccgttagaagaatgagaatatttctt

SEQ ID NO: 10936 - DNA, 40 bp, Artificial Sequence
  PCR primer for ORF amplification
caggagctgcacttccgcacaatggagttgttaatttctg

SEQ ID NO: 10937 - DNA, 40 bp, Artificial Sequence
  PCR primer for ORF amplification
caggagctgcacttcctttgtcgtctttaatgatagcaga

SEQ ID NO: 10938 - DNA, 40 bp, Artificial Sequence
  PCR primer for ORF amplification
caggagctgcacttccatggcaggcgagggagctgtcatc

SEQ ID NO: 10939 - DNA, 40 bp, Artificial Sequence
  PCR primer for ORF amplification
caggagctgcacttccaaagacatctggcaatttttcaat

SEQ ID NO: 10940 - DNA, 40 bp, Artificial Sequence
  PCR primer for ORF amplification
caggagctgcacttccaacggaagacgttgttgctatcac

SEQ ID NO: 10941 - DNA, 40 bp, Artificial Sequence
  PCR primer for ORF amplification
caggagctgcacttcctttgttccagtacgtcttgacttt

SEQ ID NO: 10942 - DNA, 40 bp, Artificial Sequence
  PCR primer for ORF amplification
caggagctgcacttcctaagccttgctgtaacctttcttg

SEQ ID NO: 10943 - DNA, 40 bp, Artificial Sequence
  PCR primer for ORF amplification
caggagctgcacttccgttgctcttagcctgcacatctag

SEQ ID NO: 10944 - DNA, 40 bp, Artificial Sequence
  PCR primer for ORF amplification
caggagctgcacttccatcggaaaaccattgtaatccatt

SEQ ID NO: 10945 - DNA, 40 bp, Artificial Sequence
  PCR primer for ORF amplification
caggagctgcacttccctcggtttcatcttttttctctct

SEQ ID NO: 10946 - DNA, 40 bp, Artificial Sequence
  PCR primer for ORF amplification
caggagctgcacttcctattaagccatcgtaaaggtttaa

SEQ ID NO: 10947 - DNA, 40 bp, Artificial Sequence
  PCR primer for ORF amplification
caggagctgcacttccagcatttttgtatttgtatttcaa

SEQ ID NO: 10948 - DNA, 40 bp, Artificial Sequence
  PCR primer for ORF amplification
caggagctgcacttcctgaaatgtactgagtcagagcacg

SEQ ID NO: 10949 - DNA, 40 bp, Artificial Sequence
  PCR primer for ORF amplification
caggagctgcacttccggctgtagacgactcctttttttg

SEQ ID NO: 10950 - DNA, 40 bp, Artificial Sequence
  PCR primer for ORF amplification
caggagctgcacttcctttattcctcgttgtttcgatgca

SEQ ID NO: 10951 - DNA, 40 bp, Artificial Sequence
  PCR primer for ORF amplification
caggagctgcacttcctaaatcttcagtaataaaaccctt

SEQ ID NO: 10952 - DNA, 40 bp, Artificial Sequence
  PCR primer for ORF amplification
caggagctgcacttcccatgtcttcgacaatgaaaccctt

SEQ ID NO: 10953 - DNA, 40 bp, Artificial Sequence
  PCR primer for ORF amplification
caggagctgcacttcccaaaattgcacattttttactttt

SEQ ID NO: 10954 - DNA, 40 bp, Artificial Sequence
  PCR primer for ORF amplification
caggagctgcacttcccataatagcattataaaacaataa

SEQ ID NO: 10955 - DNA, 40 bp, Artificial Sequence
  PCR primer for ORF amplification
caggagctgcacttccgccattactgctaccattgtggtt

SEQ ID NO: 10956 - DNA, 40 bp, Artificial Sequence
  PCR primer for ORF amplification
caggagctgcacttccgttgtcgtattcttccttaattag

SEQ ID NO: 10957 - DNA, 40 bp, Artificial Sequence
  PCR primer for ORF amplification
caggagctgcacttccaaaatatagggatgaaaactcatc

SEQ ID NO: 10958 - DNA, 40 bp, Artificial Sequence
  PCR primer for ORF amplification
caggagctgcacttccttgggtaaaatggcaggattccac

SEQ ID NO: 10959 - DNA, 40 bp, Artificial Sequence
  PCR primer for ORF amplification
caggagctgcacttccgtttcttccaaatatatacaaatg

SEQ ID NO: 10960 - DNA, 40 bp, Artificial Sequence
  PCR primer for ORF amplification
caggagctgcacttcctaaaattatgcaacagttagcccc

SEQ ID NO: 10961 - DNA, 40 bp, Artificial Sequence
  PCR primer for ORF amplification
caggagctgcacttccctcaatattcaaaactttactttt

SEQ ID NO: 10962 - DNA, 40 bp, Artificial Sequence
  PCR primer for ORF amplification
caggagctgcacttccagcggtgtcaagattatttaaacc

SEQ ID NO: 10963 - DNA, 40 bp, Artificial Sequence
  PCR primer for ORF amplification
caggagctgcacttccttcaccgttatattcggccagatt

SEQ ID NO: 10964 - DNA, 40 bp, Artificial Sequence
  PCR primer for ORF amplification
caggagctgcacttccatcttcgccgatcggtatttcgtc

SEQ ID NO: 10965 - DNA, 40 bp, Artificial Sequence
  PCR primer for ORF amplification
caggagctgcacttccgtgataaacgttgattacgttatt

SEQ ID NO: 10966 - DNA, 40 bp, Artificial Sequence
  PCR primer for ORF amplification
caggagctgcacttccattgaagatttcaacatcgttttt

SEQ ID NO: 10967 - DNA, 40 bp, Artificial Sequence
  PCR primer for ORF amplification
caggagctgcacttccttttggaatttttcttaacaaacc

SEQ ID NO: 10968 - DNA, 40 bp, Artificial Sequence
  PCR primer for ORF amplification
caggagctgcacttcctttagagtactgtttagcttgaag

SEQ ID NO: 10969 - DNA, 40 bp, Artificial Sequence
  PCR primer for ORF amplification
caggagctgcacttccttttttaaacatccaccttttcgt

SEQ ID NO: 10970 - DNA, 40 bp, Artificial Sequence
  PCR primer for ORF amplification
caggagctgcacttccacggtcttcagcccattcattttc

SEQ ID NO: 10971 - DNA, 40 bp, Artificial Sequence
  PCR primer for ORF amplification
caggagctgcacttccttctaaactgaccttagctcctaa

SEQ ID NO: 10972 - DNA, 40 bp, Artificial Sequence
  PCR primer for ORF amplification
caggagctgcacttccttttttagaggtggcaaaattgga

SEQ ID NO: 10973 - DNA, 40 bp, Artificial Sequence
  PCR primer for ORF amplification
caggagctgcacttccacgtgagtaagaccagacgttctt

SEQ ID NO: 10974 - DNA, 40 bp, Artificial Sequence
  PCR primer for ORF amplification
caggagctgcacttccaaatcttacatcatgtggatagca

SEQ ID NO: 10975 - DNA, 40 bp, Artificial Sequence
  PCR primer for ORF amplification
caggagctgcacttcccttctctccaaacatgtgaagctg

SEQ ID NO: 10976 - DNA, 40 bp, Artificial Sequence
  PCR primer for ORF amplification
caggagctgcacttcccgcctggtaccacaggagttttct

SEQ ID NO: 10977 - DNA, 40 bp, Artificial Sequence
  PCR primer for ORF amplification
caggagctgcacttccatcggagccttctagtttggcaag

SEQ ID NO: 10978 - DNA, 40 bp, Artificial Sequence
  PCR primer for ORF amplification
caggagctgcacttccaacgtaggattgaggcggtggctg

SEQ ID NO: 10979 - DNA, 40 bp, Artificial Sequence
  PCR primer for ORF amplification
caggagctgcacttccgatgataatacaaacgtcgccatc

SEQ ID NO: 10980 - DNA, 40 bp, Artificial Sequence
  PCR primer for ORF amplification
caggagctgcacttcccttttgcctcttcttcgagacaat

SEQ ID NO: 10981 - DNA, 40 bp, Artificial Sequence
  PCR primer for ORF amplification
caggagctgcacttccgtattgaacaccaatcaagtagtc

SEQ ID NO: 10982 - DNA, 40 bp, Artificial Sequence
  PCR primer for ORF amplification
caggagctgcacttccaccgtgctgtttagcctccttctc

SEQ ID NO: 10983 - DNA, 40 bp, Artificial Sequence
  PCR primer for ORF amplification
caggagctgcacttccctgagccagtaaatacgttcctaa

SEQ ID NO: 10984 - DNA, 40 bp, Artificial Sequence
  PCR primer for ORF amplification
caggagctgcacttcctacggaattggagagcatttgtaa

SEQ ID NO: 10985 - DNA, 40 bp, Artificial Sequence
  PCR primer for ORF amplification
caggagctgcacttccttttcttttaaaacctggtggggg

SEQ ID NO: 10986 - DNA, 40 bp, Artificial Sequence
  PCR primer for ORF amplification
caggagctgcacttcctttacgtgccttcttttttttatc

SEQ ID NO: 10987 - DNA, 40 bp, Artificial Sequence
  PCR primer for ORF amplification
caggagctgcacttccttctatacaggtttcctcatcagt

SEQ ID NO: 10988 - DNA, 40 bp, Artificial Sequence
  PCR primer for ORF amplification
caggagctgcacttcccgtttgctcaaggttttgaactct

SEQ ID NO: 10989 - DNA, 40 bp, Artificial Sequence
  PCR primer for ORF amplification
caggagctgcacttccttttcgatagtttgtagttgtact

SEQ ID NO: 10990 - DNA, 40 bp, Artificial Sequence
  PCR primer for ORF amplification
caggagctgcacttccattattggcatttttgaaatactc

SEQ ID NO: 10991 - DNA, 40 bp, Artificial Sequence
  PCR primer for ORF amplification
caggagctgcacttcctttgttggcagcttcgaagtattc

SEQ ID NO: 10992 - DNA, 40 bp, Artificial Sequence
  PCR primer for ORF amplification
caggagctgcacttccactgttgtccttgcagaattgcgt

SEQ ID NO: 10993 - DNA, 40 bp, Artificial Sequence
  PCR primer for ORF amplification
caggagctgcacttccatatttatagctgacctgcgcacc

SEQ ID NO: 10994 - DNA, 40 bp, Artificial Sequence
  PCR primer for ORF amplification
caggagctgcacttcctattggttgcttggcagtgagaat

SEQ ID NO: 10995 - DNA, 40 bp, Artificial Sequence
  PCR primer for ORF amplification
caggagctgcacttccttcgaccacgggtggataatgaac

SEQ ID NO: 10996 - DNA, 40 bp, Artificial Sequence
  PCR primer for ORF amplification
caggagctgcacttccaaagtcattttgatacaagtactc

SEQ ID NO: 10997 - DNA, 40 bp, Artificial Sequence
  PCR primer for ORF amplification
caggagctgcacttcctttcttcttcattctaccaaacaa

SEQ ID NO: 10998 - DNA, 40 bp, Artificial Sequence
  PCR primer for ORF amplification
caggagctgcacttccaattggtgtcttggtattttcagc

SEQ ID NO: 10999 - DNA, 40 bp, Artificial Sequence
  PCR primer for ORF amplification
caggagctgcacttcctgcatggcgaaccgattttgtatc

SEQ ID NO: 11000 - DNA, 40 bp, Artificial Sequence
  PCR primer for ORF amplification
caggagctgcacttccctcactgtcttcatcgtcttcgtc

SEQ ID NO: 11001 - DNA, 40 bp, Artificial Sequence
  PCR primer for ORF amplification
caggagctgcacttccgataaattgtccttccccataaac

SEQ ID NO: 11002 - DNA, 40 bp, Artificial Sequence
  PCR primer for ORF amplification
caggagctgcacttcccaaaaattctttggctttctttgc

SEQ ID NO: 11003 - DNA, 40 bp, Artificial Sequence
  PCR primer for ORF amplification
caggagctgcacttccagacgtgatagagctggtgatttg

SEQ ID NO: 11004 - DNA, 40 bp, Artificial Sequence
  PCR primer for ORF amplification
caggagctgcacttccacttttcataaaactttctaatga

SEQ ID NO: 11005 - DNA, 40 bp, Artificial Sequence
  PCR primer for ORF amplification
caggagctgcacttcctttgttagcatttaaacttgctaa

SEQ ID NO: 11006 - DNA, 40 bp, Artificial Sequence
  PCR primer for ORF amplification
caggagctgcacttccggcaagtggctcgaaaccgtgtga

SEQ ID NO: 11007 - DNA, 40 bp, Artificial Sequence
  PCR primer for ORF amplification
caggagctgcacttccaaactttgcaacggtttcgtagaa

SEQ ID NO: 11008 - DNA, 40 bp, Artificial Sequence
  PCR primer for ORF amplification
caggagctgcacttccctgtgcctggaagtcatctacttg

SEQ ID NO: 11009 - DNA, 40 bp, Artificial Sequence
  PCR primer for ORF amplification
caggagctgcacttccattaggcatcgcattttcaaaaat

SEQ ID NO: 11010 - DNA, 40 bp, Artificial Sequence
  PCR primer for ORF amplification
caggagctgcacttccaaatttcagcaaaagatcgttcaa

SEQ ID NO: 11011 - DNA, 40 bp, Artificial Sequence
  PCR primer for ORF amplification
caggagctgcacttccactcaaatcatgtaaagcttttcc

SEQ ID NO: 11012 - DNA, 40 bp, Artificial Sequence
  PCR primer for ORF amplification
caggagctgcacttccccaggattgagcctgattttgttt

SEQ ID NO: 11013 - DNA, 40 bp, Artificial Sequence
  PCR primer for ORF amplification
caggagctgcacttccatggtcaatggtaggtttagattc

SEQ ID NO: 11014 - DNA, 40 bp, Artificial Sequence
  PCR primer for ORF amplification
caggagctgcacttccatagcgttgaggctgggtgataat

SEQ ID NO: 11015 - DNA, 40 bp, Artificial Sequence
  PCR primer for ORF amplification
caggagctgcacttccttcattaaaagcaaccaccaagct

SEQ ID NO: 11016 - DNA, 40 bp, Artificial Sequence
  PCR primer for ORF amplification
caggagctgcacttcctaaagttaataaataagtaccgag

SEQ ID NO: 11017 - DNA, 40 bp, Artificial Sequence
  PCR primer for ORF amplification
caggagctgcacttcccttggcagctccttctgcagcagg

SEQ ID NO: 11018 - DNA, 40 bp, Artificial Sequence
  PCR primer for ORF amplification
caggagctgcacttcctttataaatcggtggtcttgactt

SEQ ID NO: 11019 - DNA, 40 bp, Artificial Sequence
  PCR primer for ORF amplification
caggagctgcacttccccttggcacttggccattcacaaa

SEQ ID NO: 11020 - DNA, 40 bp, Artificial Sequence
  PCR primer for ORF amplification
caggagctgcacttccaaaagcaattttctttgtatttct

SEQ ID NO: 11021 - DNA, 40 bp, Artificial Sequence
  PCR primer for ORF amplification
caggagctgcacttccacatatacagccactgccgctttt

SEQ ID NO: 11022 - DNA, 40 bp, Artificial Sequence
  PCR primer for ORF amplification
caggagctgcacttcccaagttttccagagatgcagcaat

SEQ ID NO: 11023 - DNA, 40 bp, Artificial Sequence
  PCR primer for ORF amplification
caggagctgcacttcctatcttgaggtttttagtcccttc

SEQ ID NO: 11024 - DNA, 40 bp, Artificial Sequence
  PCR primer for ORF amplification
caggagctgcacttccttgtctctggaaaaacgattggat

SEQ ID NO: 11025 - DNA, 40 bp, Artificial Sequence
  PCR primer for ORF amplification
caggagctgcacttccaataggcctagcatccaccgttgg

SEQ ID NO: 11026 - DNA, 40 bp, Artificial Sequence
  PCR primer for ORF amplification
caggagctgcacttccctttcttctgaaagatgtaccctc

SEQ ID NO: 11027 - DNA, 40 bp, Artificial Sequence
  PCR primer for ORF amplification
caggagctgcacttccccaacgtgaaccgccattgaatcc

SEQ ID NO: 11028 - DNA, 40 bp, Artificial Sequence
  PCR primer for ORF amplification
caggagctgcacttcctttcttagcagtcaatcttcttag

SEQ ID NO: 11029 - DNA, 40 bp, Artificial Sequence
  PCR primer for ORF amplification
caggagctgcacttcctgtggagaatgtaaggcgtggtag

SEQ ID NO: 11030 - DNA, 40 bp, Artificial Sequence
  PCR primer for ORF amplification
caggagctgcacttcccatgatgatgcaacacgaattgga

SEQ ID NO: 11031 - DNA, 40 bp, Artificial Sequence
  PCR primer for ORF amplification
caggagctgcacttccaactatatctctccgttgtcctaa

SEQ ID NO: 11032 - DNA, 40 bp, Artificial Sequence
  PCR primer for ORF amplification
caggagctgcacttcctgagtattgctcttgccataaaag

SEQ ID NO: 11033 - DNA, 40 bp, Artificial Sequence
  PCR primer for ORF amplification
caggagctgcacttccttttgttaatagttttttgtatgc

SEQ ID NO: 11034 - DNA, 40 bp, Artificial Sequence
  PCR primer for ORF amplification
caggagctgcacttccactcttccctttacttagaaacat

SEQ ID NO: 11035 - DNA, 40 bp, Artificial Sequence
  PCR primer for ORF amplification
caggagctgcacttccgtctttatttatattcagtttctc

SEQ ID NO: 11036 - DNA, 40 bp, Artificial Sequence
  PCR primer for ORF amplification
caggagctgcacttccttggacagatggacctgggttcat

SEQ ID NO: 11037 - DNA, 40 bp, Artificial Sequence
  PCR primer for ORF amplification
caggagctgcacttcccacatcgtattgcaatgtcagact

SEQ ID NO: 11038 - DNA, 40 bp, Artificial Sequence
  PCR primer for ORF amplification
caggagctgcacttccttccaagacgtttttgtccatctt

SEQ ID NO: 11039 - DNA, 40 bp, Artificial Sequence
  PCR primer for ORF amplification
caggagctgcacttccttcgcatacaacgccaatgaaaca

SEQ ID NO: 11040 - DNA, 40 bp, Artificial Sequence
  PCR primer for ORF amplification
caggagctgcacttcctccgaatatgccatcaatggctga

SEQ ID NO: 11041 - DNA, 40 bp, Artificial Sequence
  PCR primer for ORF amplification
caggagctgcacttccaccccgaaattccatcttgaattt

SEQ ID NO: 11042 - DNA, 40 bp, Artificial Sequence
  PCR primer for ORF amplification
caggagctgcacttccatagttttccttcaattccaagac

SEQ ID NO: 11043 - DNA, 40 bp, Artificial Sequence
  PCR primer for ORF amplification
caggagctgcacttccagctaaaaaagctaactcagctgc

SEQ ID NO: 11044 - DNA, 40 bp, Artificial Sequence
  PCR primer for ORF amplification
caggagctgcacttccaggatcggtgcttttcgtatggtc

SEQ ID NO: 11045 - DNA, 40 bp, Artificial Sequence
  PCR primer for ORF amplification
caggagctgcacttccagcctttttgttgatttcttgagc

SEQ ID NO: 11046 - DNA, 40 bp, Artificial Sequence
  PCR primer for ORF amplification
caggagctgcacttcccatgtcatagttgaaatcaacggt

SEQ ID NO: 11047 - DNA, 40 bp, Artificial Sequence
  PCR primer for ORF amplification
caggagctgcacttcccgtgtaggctgccaaattgtaccc

SEQ ID NO: 11048 - DNA, 40 bp, Artificial Sequence
  PCR primer for ORF amplification
caggagctgcacttccataattgaatttaattttacttct

SEQ ID NO: 11049 - DNA, 40 bp, Artificial Sequence
  PCR primer for ORF amplification
caggagctgcacttccgctatgttttctgtctgactgcgc

SEQ ID NO: 11050 - DNA, 40 bp, Artificial Sequence
  PCR primer for ORF amplification
caggagctgcacttccttttttgacaatttcgacccccca

SEQ ID NO: 11051 - DNA, 40 bp, Artificial Sequence
  PCR primer for ORF amplification
caggagctgcacttcccaaatgcttacggatgattttttc

SEQ ID NO: 11052 - DNA, 40 bp, Artificial Sequence
  PCR primer for ORF amplification
caggagctgcacttccgctgtatatagtttcaactagcaa

SEQ ID NO: 11053 - DNA, 40 bp, Artificial Sequence
  PCR primer for ORF amplification
caggagctgcacttccaacaaccttaatggcaattacttt

SEQ ID NO: 11054 - DNA, 40 bp, Artificial Sequence
  PCR primer for ORF amplification
caggagctgcacttccaacagtttcttcatcaaatacagt

SEQ ID NO: 11055 - DNA, 40 bp, Artificial Sequence
  PCR primer for ORF amplification
caggagctgcacttccatgagaaccagcgcctctgctgac

SEQ ID NO: 11056 - DNA, 40 bp, Artificial Sequence
  PCR primer for ORF amplification
caggagctgcacttcccaaaccggaaacagaaccaccgtt

SEQ ID NO: 11057 - DNA, 40 bp, Artificial Sequence
  PCR primer for ORF amplification
caggagctgcacttccatttaattgcccggttttaccttc

SEQ ID NO: 11058 - DNA, 40 bp, Artificial Sequence
  PCR primer for ORF amplification
caggagctgcacttccttttggaacggaggggaacacgtg

SEQ ID NO: 11059 - DNA, 40 bp, Artificial Sequence
  PCR primer for ORF amplification
caggagctgcacttcccttcttttccaaatgttttttaaa

SEQ ID NO: 11060 - DNA, 40 bp, Artificial Sequence
  PCR primer for ORF amplification
caggagctgcacttccacctttcatgtaagcatctaattc

SEQ ID NO: 11061 - DNA, 40 bp, Artificial Sequence
  PCR primer for ORF amplification
caggagctgcacttccagtcagcaaactttgcaaatcttt

SEQ ID NO: 11062 - DNA, 40 bp, Artificial Sequence
  PCR primer for ORF amplification
caggagctgcacttccgactagagatgtgacctcaaagaa

SEQ ID NO: 11063 - DNA, 40 bp, Artificial Sequence
  PCR primer for ORF amplification
caggagctgcacttccggcactctcagattgcgaattagc

SEQ ID NO: 11064 - DNA, 40 bp, Artificial Sequence
  PCR primer for ORF amplification
caggagctgcacttcctttttttgcatcgctatcatcatt

SEQ ID NO: 11065 - DNA, 40 bp, Artificial Sequence
  PCR primer for ORF amplification
caggagctgcacttcctatttggctttctaagtcttttag

SEQ ID NO: 11066 - DNA, 40 bp, Artificial Sequence
  PCR primer for ORF amplification
caggagctgcacttcctaaggcattcttcatatttctcct

SEQ ID NO: 11067 - DNA, 40 bp, Artificial Sequence
  PCR primer for ORF amplification
caggagctgcacttccgttagaggaaactaaacttccatc

SEQ ID NO: 11068 - DNA, 40 bp, Artificial Sequence
  PCR primer for ORF amplification
caggagctgcacttccatttatttcttcttgcaacgattc

SEQ ID NO: 11069 - DNA, 40 bp, Artificial Sequence
  PCR primer for ORF amplification
caggagctgcacttccaactggttgtactgtttggccgta

SEQ ID NO: 11070 - DNA, 40 bp, Artificial Sequence
  PCR primer for ORF amplification
caggagctgcacttcccaataacatgacggcagcaagggc

SEQ ID NO: 11071 - DNA, 40 bp, Artificial Sequence
  PCR primer for ORF amplification
caggagctgcacttcctaatagtaataaggcaccggctac

SEQ ID NO: 11072 - DNA, 40 bp, Artificial Sequence
  PCR primer for ORF amplification
caggagctgcacttcctttcagtacctggtacgtgtcttg

SEQ ID NO: 11073 - DNA, 40 bp, Artificial Sequence
  PCR primer for ORF amplification
caggagctgcacttcctaagctatcacggatagcgtcttg

SEQ ID NO: 11074 - DNA, 40 bp, Artificial Sequence
  PCR primer for ORF amplification
caggagctgcacttccttgagcaaatgagactttttttac

SEQ ID NO: 11075 - DNA, 40 bp, Artificial Sequence
  PCR primer for ORF amplification
caggagctgcacttccttttctatacctccataacgacag

SEQ ID NO: 11076 - DNA, 40 bp, Artificial Sequence
  PCR primer for ORF amplification
caggagctgcacttccgtgtggccgtaagctgtcaataaa

SEQ ID NO: 11077 - DNA, 40 bp, Artificial Sequence
  PCR primer for ORF amplification
caggagctgcacttccttttctgtatctccacaaggacaa

SEQ ID NO: 11078 - DNA, 40 bp, Artificial Sequence
  PCR primer for ORF amplification
caggagctgcacttccgcccctcaatgctcttagtctttg

SEQ ID NO: 11079 - DNA, 40 bp, Artificial Sequence
  PCR primer for ORF amplification
caggagctgcacttcctacattcatgaagatgagttcgta

SEQ ID NO: 11080 - DNA, 40 bp, Artificial Sequence
  PCR primer for ORF amplification
caggagctgcacttccgtagtatatccagccgacgagcaa

SEQ ID NO: 11081 - DNA, 40 bp, Artificial Sequence
  PCR primer for ORF amplification
caggagctgcacttccagaagagagctcaggcgtccactc

SEQ ID NO: 11082 - DNA, 40 bp, Artificial Sequence
  PCR primer for ORF amplification
caggagctgcacttccgtgctttcttcttccttttggttg

SEQ ID NO: 11083 - DNA, 40 bp, Artificial Sequence
  PCR primer for ORF amplification
caggagctgcacttcctcttctacctcctctgaaaccacc

SEQ ID NO: 11084 - DNA, 40 bp, Artificial Sequence
  PCR primer for ORF amplification
caggagctgcacttccaacctcgtcaccgcctgacgatga

SEQ ID NO: 11085 - DNA, 40 bp, Artificial Sequence
  PCR primer for ORF amplification
caggagctgcacttccccagaacttgtaccatttcttctc

SEQ ID NO: 11086 - DNA, 40 bp, Artificial Sequence
  PCR primer for ORF amplification
caggagctgcacttccctcagtcttttgatcagctccggc

SEQ ID NO: 11087 - DNA, 40 bp, Artificial Sequence
  PCR primer for ORF amplification
caggagctgcacttccatcttgtctcatcttcaagtatct

SEQ ID NO: 11088 - DNA, 40 bp, Artificial Sequence
  PCR primer for ORF amplification
caggagctgcacttcccatattctttttggccttatcacg

SEQ ID NO: 11089 - DNA, 40 bp, Artificial Sequence
  PCR primer for ORF amplification
caggagctgcacttccacagcagcccccaccggtgttggt

SEQ ID NO: 11090 - DNA, 40 bp, Artificial Sequence
  PCR primer for ORF amplification
caggagctgcacttccgtttcctttcttggaagcttcagc

SEQ ID NO: 11091 - DNA, 40 bp, Artificial Sequence
  PCR primer for ORF amplification
caggagctgcacttccagcaaaaccagcgtctggtggaca

SEQ ID NO: 11092 - DNA, 40 bp, Artificial Sequence
  PCR primer for ORF amplification
caggagctgcacttccatcaaaaccagcttctggtggaca

SEQ ID NO: 11093 - DNA, 40 bp, Artificial Sequence
  PCR primer for ORF amplification
caggagctgcacttccttcttgaacactttccaaaggatt

SEQ ID NO: 11094 - DNA, 40 bp, Artificial Sequence
  PCR primer for ORF amplification
caggagctgcacttcctttcatcttttttttgcttttgtg

SEQ ID NO: 11095 - DNA, 40 bp, Artificial Sequence
  PCR primer for ORF amplification
caggagctgcacttccgtaatatgaaggagcgtataatga

SEQ ID NO: 11096 - DNA, 40 bp, Artificial Sequence
  PCR primer for ORF amplification
caggagctgcacttccacgataaaagtctgggcgacctat

SEQ ID NO: 11097 - DNA, 40 bp, Artificial Sequence
  PCR primer for ORF amplification
caggagctgcacttccatcttcttcactagagtcttcctc

SEQ ID NO: 11098 - DNA, 40 bp, Artificial Sequence
  PCR primer for ORF amplification
caggagctgcacttccattgactaatcttccatcattatt

SEQ ID NO: 11099 - DNA, 40 bp, Artificial Sequence
  PCR primer for ORF amplification
caggagctgcacttccttggacggatggacctgggttcat

SEQ ID NO: 11100 - DNA, 40 bp, Artificial Sequence; identical to SEQ ID NO: 10342
  PCR primer for ORF amplification

SEQ ID NO: 11101 - DNA, 40 bp, Artificial Sequence
  PCR primer for ORF amplification
caggagctgcacttcccctagctgttggatttgctgttac

SEQ ID NO: 11102 - DNA, 40 bp, Artificial Sequence
  PCR primer for ORF amplification
caggagctgcacttcctttcttaataaggtgctttaattt

SEQ ID NO: 11103 - DNA, 40 bp, Artificial Sequence
  PCR primer for ORF amplification
caggagctgcacttcctacgtagtttttttggcgactggt

SEQ ID NO: 11104 - DNA, 40 bp, Artificial Sequence
  PCR primer for ORF amplification
caggagctgcacttcctgttaataacctcatatatgctaa

SEQ ID NO: 11105 - DNA, 40 bp, Artificial Sequence
  PCR primer for ORF amplification
caggagctgcacttccttctttaaaatcgttttgaggtgg

SEQ ID NO: 11106 - DNA, 40 bp, Artificial Sequence
  PCR primer for ORF amplification
caggagctgcacttcccggagagccttctttagaagaagg

SEQ ID NO: 11107 - DNA, 40 bp, Artificial Sequence
  PCR primer for ORF amplification
caggagctgcacttccaccgtacataccccaatcttcttc

SEQ ID NO: 11108 - DNA, 40 bp, Artificial Sequence
  PCR primer for ORF amplification
caggagctgcacttccagcagaagccttagaagcagagcc

SEQ ID NO: 11109 - DNA, 40 bp, Artificial Sequence
  PCR primer for ORF amplification
caggagctgcacttccaacttcaccgtttataattgcgtt

SEQ ID NO: 11110 - DNA, 40 bp, Artificial Sequence
  PCR primer for ORF amplification
caggagctgcacttccatacaatttcaaatcacctgttat

SEQ ID NO: 11111 - DNA, 40 bp, Artificial Sequence
  PCR primer for ORF amplification
caggagctgcacttcctacttccagttgcatatcgtcagt

SEQ ID NO: 11112 - DNA, 40 bp, Artificial Sequence
  PCR primer for ORF amplification
caggagctgcacttcccgtatgagagttcggatacgagtt

SEQ ID NO: 11113 - DNA, 40 bp, Artificial Sequence
  PCR primer for ORF amplification
caggagctgcacttcctatcttctgcaaataaccttgttg

SEQ ID NO: 11114 - DNA, 40 bp, Artificial Sequence
  PCR primer for ORF amplification
caggagctgcacttccctgaggtacgtagttatcatcttc

SEQ ID NO: 11115 - DNA, 40 bp, Artificial Sequence
  PCR primer for ORF amplification
caggagctgcacttccacagctacaagaattattttctcc

SEQ ID NO: 11116 - DNA, 40 bp, Artificial Sequence
  PCR primer for ORF amplification
caggagctgcacttcctttcttcaaatattgggccaattc

SEQ ID NO: 11117 - DNA, 40 bp, Artificial Sequence
  PCR primer for ORF amplification
caggagctgcacttcccggtacttttctataactgttggc

SEQ ID NO: 11118 - DNA, 40 bp, Artificial Sequence
  PCR primer for ORF amplification
caggagctgcacttccacggcttttcttacataggagaac

SEQ ID NO: 11119 - DNA, 40 bp, Artificial Sequence
  PCR primer for ORF amplification
caggagctgcacttccctcatcttcatagacgtggaagga

SEQ ID NO: 11120 - DNA, 40 bp, Artificial Sequence
  PCR primer for ORF amplification
caggagctgcacttcccattatagaacatttattattatt

SEQ ID NO: 11121 - DNA, 40 bp, Artificial Sequence
  PCR primer for ORF amplification
caggagctgcacttccgtcatgaccttgagccttagcgag

SEQ ID NO: 11122 - DNA, 40 bp, Artificial Sequence
  PCR primer for ORF amplification
caggagctgcacttcctaacaagacacacttcttcttctt

SEQ ID NO: 11123 - DNA, 40 bp, Artificial Sequence; identical to SEQ ID NO: 10418
  PCR primer for ORF amplification

SEQ ID NO: 11124 - DNA, 40 bp, Artificial Sequence
  PCR primer for ORF amplification
caggagctgcacttcctaaattcaaatattcaatatattt

SEQ ID NO: 11125 - DNA, 40 bp, Artificial Sequence
  PCR primer for ORF amplification
caggagctgcacttccacaactgcaagcactgtttgcgct

SEQ ID NO: 11126 - DNA, 40 bp, Artificial Sequence
  PCR primer for ORF amplification
caggagctgcacttccaaatccataatcgttattgcgtct

SEQ ID NO: 11127 - DNA, 40 bp, Artificial Sequence
  PCR primer for ORF amplification
caggagctgcacttcccttactcactttcgctcttgccgg

SEQ ID NO: 11128 - DNA, 40 bp, Artificial Sequence
  PCR primer for ORF amplification
caggagctgcacttcccaaatctttgatacggtcgtaaaa

SEQ ID NO: 11129 - DNA, 40 bp, Artificial Sequence
  PCR primer for ORF amplification
caggagctgcacttccagtgtgcacattgctgctatgctt

SEQ ID NO: 11130 - DNA, 40 bp, Artificial Sequence
  PCR primer for ORF amplification
caggagctgcacttccccaactggtcgaattagtaatcga

SEQ ID NO: 11131 - DNA, 40 bp, Artificial Sequence
  PCR primer for ORF amplification
caggagctgcacttccttgtttttgcagcttgataacctc

SEQ ID NO: 11132 - DNA, 40 bp, Artificial Sequence
  PCR primer for ORF amplification
caggagctgcacttcctaacaataaagcagctgcacctgc

SEQ ID NO: 11133 - DNA, 40 bp, Artificial Sequence
  PCR primer for ORF amplification
caggagctgcacttccttttttggcgttcttcctcttttg

SEQ ID NO: 11134 - DNA, 40 bp, Artificial Sequence
  PCR primer for ORF amplification
caggagctgcacttcctttttttgcgtttggtgaagcgtc

SEQ ID NO: 11135 - DNA, 40 bp, Artificial Sequence
  PCR primer for ORF amplification
caggagctgcacttccactggaggatagtctaaaccatag

SEQ ID NO: 11136 - DNA, 40 bp, Artificial Sequence
  PCR primer for ORF amplification
caggagctgcacttcctagcgtttcattctctgatgtctt

SEQ ID NO: 11137 - DNA, 40 bp, Artificial Sequence
  PCR primer for ORF amplification
caggagctgcacttccaatgatatgtttcgttttgaagta

SEQ ID NO: 11138 - DNA, 40 bp, Artificial Sequence
  PCR primer for ORF amplification
caggagctgcacttccaaaaaagtccaacgatgtccttct

SEQ ID NO: 11139 - DNA, 40 bp, Artificial Sequence
  PCR primer for ORF amplification
caggagctgcacttcctatatgctcctttctatctcttct

SEQ ID NO: 11140 - DNA, 40 bp, Artificial Sequence
  PCR primer for ORF amplification
caggagctgcacttccgggtgtttcagtgttgcggaacca

SEQ ID NO: 11141 - DNA, 40 bp, Artificial Sequence
  PCR primer for ORF amplification
caggagctgcacttccttgaaaccaatgtatggatccatc

SEQ ID NO: 11142 - DNA, 40 bp, Artificial Sequence
  PCR primer for ORF amplification
caggagctgcacttccaaagtcactaccgtcaaatccatc

SEQ ID NO: 11143 - DNA, 40 bp, Artificial Sequence
  PCR primer for ORF amplification
caggagctgcacttcctttacgattgtatagagtgaattc

SEQ ID NO: 11144 - DNA, 40 bp, Artificial Sequence
  PCR primer for ORF amplification
caggagctgcacttccatcatcgtcatcagtatcgaatat

SEQ ID NO: 11145 - DNA, 40 bp, Artificial Sequence
  PCR primer for ORF amplification
caggagctgcacttcctactaccttctgtttgacaaagaa

SEQ ID NO: 11146 - DNA, 40 bp, Artificial Sequence
  PCR primer for ORF amplification
caggagctgcacttcctttggccagagaccagcctttttg

SEQ ID NO: 11147 - DNA, 40 bp, Artificial Sequence
  PCR primer for ORF amplification
caggagctgcacttccatctatatccatgtaatcgttagc

SEQ ID NO: 11148 - DNA, 40 bp, Artificial Sequence
  PCR primer for ORF amplification
caggagctgcacttccacaggttccatttaccttgataga

SEQ ID NO: 11149 - DNA, 40 bp, Artificial Sequence
  PCR primer for ORF amplification
caggagctgcacttcccgtctctagtctctcatacaatgg

SEQ ID NO: 11150 - DNA, 40 bp, Artificial Sequence
  PCR primer for ORF amplification
caggagctgcacttccttcttcaacatcgtctggcaggac

SEQ ID NO: 11151 - DNA, 40 bp, Artificial Sequence
  PCR primer for ORF amplification
caggagctgcacttccaatgctgtcctctaagaccttatt

SEQ ID NO: 11152 - DNA, 40 bp, Artificial Sequence
  PCR primer for ORF amplification
caggagctgcacttccttcccaccaactaacgagtcccat

SEQ ID NO: 11153 - DNA, 40 bp, Artificial Sequence
  PCR primer for ORF amplification
caggagctgcacttccgtatttcaaattaccttgtttatc

SEQ ID NO: 11154 - DNA, 40 bp, Artificial Sequence
  PCR primer for ORF amplification
caggagctgcacttccctgaaattcagaagctttaccggc

SEQ ID NO: 11155 - DNA, 40 bp, Artificial Sequence
  PCR primer for ORF amplification
caggagctgcacttcctttcaacatgttgtgctttaatgc

SEQ ID NO: 11156 - DNA, 40 bp, Artificial Sequence
  PCR primer for ORF amplification
caggagctgcacttcccatcaacagatcgtccaaactttg

SEQ ID NO: 11157 - DNA, 40 bp, Artificial Sequence
  PCR primer for ORF amplification
caggagctgcacttccgaattgcaatctgtccattagcgc

SEQ ID NO: 11158 - DNA, 40 bp, Artificial Sequence
  PCR primer for ORF amplification
caggagctgcacttccttcgaataatgaatctgcataata

SEQ ID NO: 11159 - DNA, 40 bp, Artificial Sequence
  PCR primer for ORF amplification
caggagctgcacttcctgaccttgcatttacctttgccct

SEQ ID NO: 11160 - DNA, 40 bp, Artificial Sequence
  PCR primer for ORF amplification
caggagctgcacttccctttcctaatctttcccagatgta

SEQ ID NO: 11161 - DNA, 40 bp, Artificial Sequence
  PCR primer for ORF amplification
caggagctgcacttccaatattgaattcttcttcatcatt

SEQ ID NO: 11162 - DNA, 40 bp, Artificial Sequence
  PCR primer for ORF amplification
caggagctgcacttcccaaggtgattgatggttgagggtg

SEQ ID NO: 11163 - DNA, 40 bp, Artificial Sequence
  PCR primer for ORF amplification
caggagctgcacttccttgtttcgagcccaaatgcttcaa

SEQ ID NO: 11164 - DNA, 40 bp, Artificial Sequence
  PCR primer for ORF amplification
caggagctgcacttcctgcaactcgttttgaaggctctag

SEQ ID NO: 11165 - DNA, 40 bp, Artificial Sequence
  PCR primer for ORF amplification
caggagctgcacttccccctttattcaaagcctttctatt

SEQ ID NO: 11166 - DNA, 40 bp, Artificial Sequence
  PCR primer for ORF amplification
caggagctgcacttcctttgaggaagatccaccagaagag

SEQ ID NO: 11167 - DNA, 40 bp, Artificial Sequence
  PCR primer for ORF amplification
caggagctgcacttcctttgtgaagctgctgtaaaacctt

SEQ ID NO: 11168 - DNA, 40 bp, Artificial Sequence
  PCR primer for ORF amplification
caggagctgcacttccgttaccccacgattcttgagaaga

SEQ ID NO: 11169 - DNA, 40 bp, Artificial Sequence
  PCR primer for ORF amplification
caggagctgcacttcctttgattttcttgtcctttagctt

SEQ ID NO: 11170 - DNA, 40 bp, Artificial Sequence
  PCR primer for ORF amplification
caggagctgcacttccctccttcaaactgtcgaaaaaggc

SEQ ID NO: 11171 - DNA, 40 bp, Artificial Sequence
  PCR primer for ORF amplification
caggagctgcacttccacactgacaagcgctttgttcctg

SEQ ID NO: 11172 - DNA, 40 bp, Artificial Sequence
  PCR primer for ORF amplification
caggagctgcacttccgatgcgcagaacacctcttgccga

SEQ ID NO: 11173 - DNA, 40 bp, Artificial Sequence
  PCR primer for ORF amplification
caggagctgcacttccggcgttgtaacaagattcaaaaaa

SEQ ID NO: 11174 - DNA, 40 bp, Artificial Sequence
  PCR primer for ORF amplification
caggagctgcacttccaacgtaatttttttgacgaccagt

SEQ ID NO: 11175 - DNA, 40 bp, Artificial Sequence
  PCR primer for ORF amplification
caggagctgcacttcccatacagattctgtaactggcata

SEQ ID NO: 11176 - DNA, 40 bp, Artificial Sequence
  PCR primer for ORF amplification
caggagctgcacttccttctgatccttttgattccctgct

SEQ ID NO: 11177 - DNA, 40 bp, Artificial Sequence
  PCR primer for ORF amplification
caggagctgcacttccgtgatagaatctaaaatcgagtct

SEQ ID NO: 11178 - DNA, 40 bp, Artificial Sequence
  PCR primer for ORF amplification
caggagctgcacttccttcttctttaaacttttcagcgac

SEQ ID NO: 11179 - DNA, 40 bp, Artificial Sequence
  PCR primer for ORF amplification
caggagctgcacttccacagcaatttgatttagaactgtt

SEQ ID NO: 11180 - DNA, 40 bp, Artificial Sequence
  PCR primer for ORF amplification
caggagctgcacttcccttcaacaattcctcgatgatacg

SEQ ID NO: 11181 - DNA, 40 bp, Artificial Sequence
  PCR primer for ORF amplification
caggagctgcacttccaaagatattattaacaatatctga

SEQ ID NO: 11182 - DNA, 40 bp, Artificial Sequence
  PCR primer for ORF amplification
caggagctgcacttccaccaacaatgaccttatcaccatc

SEQ ID NO: 11183 - DNA, 40 bp, Artificial Sequence
  PCR primer for ORF amplification
caggagctgcacttcccagtgtaatcttgcttagaacttt

SEQ ID NO: 11184 - DNA, 40 bp, Artificial Sequence
  PCR primer for ORF amplification
caggagctgcacttcctctatcatctgttagtctttgaat

SEQ ID NO: 11185 - DNA, 40 bp, Artificial Sequence
  PCR primer for ORF amplification
caggagctgcacttccctcaacgctgaagttccataaggg

SEQ ID NO: 11186 - DNA, 40 bp, Artificial Sequence
  PCR primer for ORF amplification
caggagctgcacttcctttgaagaaaagaatcgttttcca

SEQ ID NO: 11187 - DNA, 40 bp, Artificial Sequence
  PCR primer for ORF amplification
caggagctgcacttcctttatccacgacattgatgttgtg

SEQ ID NO: 11188 - DNA, 40 bp, Artificial Sequence
  PCR primer for ORF amplification
caggagctgcacttccgaagaacgaaaatttatcatgatc

SEQ ID NO: 11189 - DNA, 40 bp, Artificial Sequence
  PCR primer for ORF amplification
caggagctgcacttccactaatttgagcacggcccgtaat

SEQ ID NO: 11190 - DNA, 40 bp, Artificial Sequence
  PCR primer for ORF amplification
caggagctgcacttccatcctcctccaggaagtccattaa

SEQ ID NO: 11191 - DNA, 40 bp, Artificial Sequence
  PCR primer for ORF amplification
caggagctgcacttccagctttcacttccggctctatttc

SEQ ID NO: 11192 - DNA, 40 bp, Artificial Sequence
  PCR primer for ORF amplification
caggagctgcacttccaacacagtagtatctgtcaccaaa

SEQ ID NO: 11193 - DNA, 40 bp, Artificial Sequence
  PCR primer for ORF amplification
caggagctgcacttcctaatactttctgcttaacaaaaaa

SEQ ID NO: 11194 - DNA, 40 bp, Artificial Sequence
  PCR primer for ORF amplification
caggagctgcacttcctttacaaagagatgaattgtgtgt

SEQ ID NO: 11195 - DNA, 40 bp, Artificial Sequence
  PCR primer for ORF amplification
caggagctgcacttcctagaaattttgggattttatcatg

SEQ ID NO: 11196 - DNA, 40 bp, Artificial Sequence
  PCR primer for ORF amplification
caggagctgcacttcccacacccctcaattgaatagcgtc

SEQ ID NO: 11197 - DNA, 40 bp, Artificial Sequence
  PCR primer for ORF amplification
caggagctgcacttccttcgtcccagccgtccttccatct

SEQ ID NO: 11198 - DNA, 40 bp, Artificial Sequence
  PCR primer for ORF amplification
caggagctgcacttcctttaaactttgagaacaaaactag

SEQ ID NO: 11199 - DNA, 40 bp, Artificial Sequence
  PCR primer for ORF amplification
caggagctgcacttcctagtcttctcatctttggtgatct

SEQ ID NO: 11200 - DNA, 40 bp, Artificial Sequence
  PCR primer for ORF amplification
caggagctgcacttcccctccgcttctttctcatctcttt

SEQ ID NO: 11201 - DNA, 40 bp, Artificial Sequence
  PCR primer for ORF amplification
caggagctgcacttccaaagaggttgtcacttccatttcc

SEQ ID NO: 11202 - DNA, 40 bp, Artificial Sequence
  PCR primer for ORF amplification
caggagctgcacttccgcatcggtgaacatctttaatagt

SEQ ID NO: 11203 - DNA, 40 bp, Artificial Sequence
  PCR primer for ORF amplification
caggagctgcacttccaattagtttcttcccgaaagagga

SEQ ID NO: 11204 - DNA, 40 bp, Artificial Sequence
  PCR primer for ORF amplification
caggagctgcacttcctttaagctcgaaatggctattgaa

SEQ ID NO: 11205 - DNA, 40 bp, Artificial Sequence
  PCR primer for ORF amplification
caggagctgcacttccgtacaatctgaaagctggacccat

SEQ ID NO: 11206 - DNA, 40 bp, Artificial Sequence; identical to SEQ ID NO: 11205
  PCR primer for ORF amplification

SEQ ID NO: 11207 - DNA, 40 bp, Artificial Sequence
  PCR primer for ORF amplification
caggagctgcacttccagcagaagtagccttagcagaacc

SEQ ID NO: 11208 - DNA, 40 bp, Artificial Sequence
  PCR primer for ORF amplification
caggagctgcacttccagcaaacagcgacgtgtccacaac

SEQ ID NO: 11209 - DNA, 40 bp, Artificial Sequence
  PCR primer for ORF amplification
caggagctgcacttccgaaactttctttattcatattttg

SEQ ID NO: 11210 - DNA, 40 bp, Artificial Sequence
  PCR primer for ORF amplification
caggagctgcacttcctggggaccacaattcgcctgtacc

SEQ ID NO: 11211 - DNA, 40 bp, Artificial Sequence
  PCR primer for ORF amplification
caggagctgcacttcctcttctgtaaccagagcggttgcc

SEQ ID NO: 11212 - DNA, 40 bp, Artificial Sequence
  PCR primer for ORF amplification
caggagctgcacttccgcagtcatggtcttcattcaatct

SEQ ID NO: 11213 - DNA, 40 bp, Artificial Sequence
  PCR primer for ORF amplification
caggagctgcacttcctaattgttgtttgaatacttgata

SEQ ID NO: 11214 - DNA, 40 bp, Artificial Sequence
  PCR primer for ORF amplification
caggagctgcacttcctttcgtttccgcatagaagaaatt

SEQ ID NO: 11215 - DNA, 40 bp, Artificial Sequence
  PCR primer for ORF amplification
caggagctgcacttccttgaatagcattatatattagtgc

SEQ ID NO: 11216 - DNA, 40 bp, Artificial Sequence
  PCR primer for ORF amplification
caggagctgcacttcctatataggcaccgatagtatagcc

SEQ ID NO: 11217 - DNA, 40 bp, Artificial Sequence
  PCR primer for ORF amplification
caggagctgcacttcctaaaattttttgcttaacaaaaaa

SEQ ID NO: 11218 - DNA, 40 bp, Artificial Sequence
  PCR primer for ORF amplification
caggagctgcacttccctttcttcttttttgccgttttga

SEQ ID NO: 11219 - DNA, 40 bp, Artificial Sequence
  PCR primer for ORF amplification
caggagctgcacttccttgtaggttttctaccattttttt

SEQ ID NO: 11220 - DNA, 40 bp, Artificial Sequence
  PCR primer for ORF amplification
caggagctgcacttccactacaacagcaggtcgagagggc

SEQ ID NO: 11221 - DNA, 40 bp, Artificial Sequence
  PCR primer for ORF amplification
caggagctgcacttccccatatttcggttcctcttctaag

SEQ ID NO: 11222 - DNA, 40 bp, Artificial Sequence
  PCR primer for ORF amplification
caggagctgcacttcctaaatcagcatcatcttcatcagg

SEQ ID NO: 11223 - DNA, 40 bp, Artificial Sequence
  PCR primer for ORF amplification
caggagctgcacttcctgaagaatgctcaattgaaccatc

SEQ ID NO: 11224 - DNA, 40 bp, Artificial Sequence
  PCR primer for ORF amplification
caggagctgcacttccttgccccgttgcccattgtgcaaa

SEQ ID NO: 11225 - DNA, 40 bp, Artificial Sequence
  PCR primer for ORF amplification
caggagctgcacttcccataagaacacctttggtggaggg

SEQ ID NO: 11226 - DNA, 40 bp, Artificial Sequence
  PCR primer for ORF amplification
caggagctgcacttccgtaagtcttgttcttctcgttggc

SEQ ID NO: 11227 - DNA, 40 bp, Artificial Sequence
  PCR primer for ORF amplification
caggagctgcacttcctagctcttgtatcctacaacccaa

SEQ ID NO: 11228 - DNA, 40 bp, Artificial Sequence
  PCR primer for ORF amplification
caggagctgcacttccgcagttacaacccccagtctccct

SEQ ID NO: 11229 - DNA, 40 bp, Artificial Sequence
  PCR primer for ORF amplification
caggagctgcacttccctccagcctccttcttttcatatc

SEQ ID NO: 11230 - DNA, 40 bp, Artificial Sequence
  PCR primer for ORF amplification
caggagctgcacttccccatttgaattcgatacctgactt

SEQ ID NO: 11231 - DNA, 40 bp, Artificial Sequence
  PCR primer for ORF amplification
caggagctgcacttcctaaatcagcatcgtcttcatcagg

SEQ ID NO: 11232 - DNA, 40 bp, Artificial Sequence
  PCR primer for ORF amplification
caggagctgcacttccactgctagcctccctcctcttcca

SEQ ID NO: 11233 - DNA, 40 bp, Artificial Sequence
  PCR primer for ORF amplification
caggagctgcacttccgttctccatttctttatttttcaa

SEQ ID NO: 11234 - DNA, 40 bp, Artificial Sequence
  PCR primer for ORF amplification
caggagctgcacttccatagagtgtttctaggtttgacaa

SEQ ID NO: 11235 - DNA, 40 bp, Artificial Sequence
  PCR primer for ORF amplification
caggagctgcacttccttttggggtaacttttgtgtaagt

SEQ ID NO: 11236 - DNA, 40 bp, Artificial Sequence
  PCR primer for ORF amplification
caggagctgcacttccatcttgtgcatgtaacctcagtag

SEQ ID NO: 11237 - DNA, 40 bp, Artificial Sequence
  PCR primer for ORF amplification
caggagctgcacttcctggattgtttcgatctatcctttt

SEQ ID NO: 11238 - DNA, 40 bp, Artificial Sequence
  PCR primer for ORF amplification
caggagctgcacttccccttgtaaagctgtacacactgag

SEQ ID NO: 11239 - DNA, 40 bp, Artificial Sequence
  PCR primer for ORF amplification
caggagctgcacttcctaaagatgccagaagcatatcgcg

SEQ ID NO: 11240 - DNA, 40 bp, Artificial Sequence
  PCR primer for ORF amplification
caggagctgcacttccagcttgagcagcaaagtattctgg

SEQ ID NO: 11241 - DNA, 40 bp, Artificial Sequence
  PCR primer for ORF amplification
caggagctgcacttccttcagcgtgcggaaccgaatcctc

SEQ ID NO: 11242 - DNA, 40 bp, Artificial Sequence
  PCR primer for ORF amplification
caggagctgcacttccggatagtaatgctaaaggttcctt

SEQ ID NO: 11243 - DNA, 40 bp, Artificial Sequence
  PCR primer for ORF amplification
caggagctgcacttccttgcttgtgttcctgctcaggaat

SEQ ID NO: 11244 - DNA, 40 bp, Artificial Sequence
  PCR primer for ORF amplification
caggagctgcacttcctttactgtagtttttaagaacaaa

SEQ ID NO: 11245 - DNA, 40 bp, Artificial Sequence
  PCR primer for ORF amplification
caggagctgcacttccttttcttctcttggaatctggttc

SEQ ID NO: 11246 - DNA, 40 bp, Artificial Sequence
  PCR primer for ORF amplification
caggagctgcacttccgaactttttgttttgcaacaagtt

SEQ ID NO: 11247 - DNA, 40 bp, Artificial Sequence
  PCR primer for ORF amplification
caggagctgcacttccactaatttgggcgcgacctgtgat

SEQ ID NO: 11248 - DNA, 40 bp, Artificial Sequence
  PCR primer for ORF amplification
caggagctgcacttccacaacagttgctggattttttctt

SEQ ID NO: 11249 - DNA, 40 bp, Artificial Sequence
  PCR primer for ORF amplification
caggagctgcacttccttgtggaaagattaagctgtagtc

SEQ ID NO: 11250 - DNA, 40 bp, Artificial Sequence
  PCR primer for ORF amplification
caggagctgcacttccttgggacgacgatggaggagattg

SEQ ID NO: 11251 - DNA, 40 bp, Artificial Sequence
  PCR primer for ORF amplification
caggagctgcacttcctttttcaagtagtcttttcttgac

SEQ ID NO: 11252 - DNA, 40 bp, Artificial Sequence
  PCR primer for ORF amplification
caggagctgcacttccatccttacctagcttgttcaagat

SEQ ID NO: 11253 - DNA, 40 bp, Artificial Sequence
  PCR primer for ORF amplification
caggagctgcacttccatctcgtaatatccttttcgagag

SEQ ID NO: 11254 - DNA, 40 bp, Artificial Sequence
  PCR primer for ORF amplification
caggagctgcacttccatacgcctgtataaataataaaat

SEQ ID NO: 11255 - DNA, 40 bp, Artificial Sequence
  PCR primer for ORF amplification
caggagctgcacttccggtcaactgctggagccattgagc

SEQ ID NO: 11256 - DNA, 40 bp, Artificial Sequence
  PCR primer for ORF amplification
caggagctgcacttccacaacagttatttccatttgcctt

SEQ ID NO: 11257 - DNA, 40 bp, Artificial Sequence
  PCR primer for ORF amplification
caggagctgcacttcctacaactagacgaggtgatatatt

SEQ ID NO: 11258 - DNA, 40 bp, Artificial Sequence
  PCR primer for ORF amplification
caggagctgcacttccccatgtgaaaaacaaaaacagtat

SEQ ID NO: 11259 - DNA, 40 bp, Artificial Sequence
  PCR primer for ORF amplification
caggagctgcacttcctttaattaaccattttaggtgatt

SEQ ID NO: 11260 - DNA, 40 bp, Artificial Sequence
  PCR primer for ORF amplification
caggagctgcacttccgtggaggtggttgatattgtaagt

SEQ ID NO: 11261 - DNA, 40 bp, Artificial Sequence
  PCR primer for ORF amplification
caggagctgcacttccattactagatgatgttgaagtaga

SEQ ID NO: 11262 - DNA, 40 bp, Artificial Sequence
  PCR primer for ORF amplification
caggagctgcacttccctcaactatgttgatgtgcaagtt

SEQ ID NO: 11263 - DNA, 40 bp, Artificial Sequence
  PCR primer for ORF amplification
caggagctgcacttccagtcagagcttggtatataatggt

SEQ ID NO: 11264 - DNA, 40 bp, Artificial Sequence
  PCR primer for ORF amplification
caggagctgcacttccagcaatgaatgccaaaactaataa

SEQ ID NO: 11265 - DNA, 40 bp, Artificial Sequence
  PCR primer for ORF amplification
caggagctgcacttcccgacttgaagatcttggagtttat

SEQ ID NO: 11266 - DNA, 40 bp, Artificial Sequence
  PCR primer for ORF amplification
caggagctgcacttcccatactatgaaattttagttttgg

SEQ ID NO: 11267 - DNA, 40 bp, Artificial Sequence
  PCR primer for ORF amplification
caggagctgcacttccaagggcaactgcaaagattccgaa

SEQ ID NO: 11268 - DNA, 40 bp, Artificial Sequence
  PCR primer for ORF amplification
caggagctgcacttccaaagcctaaagatttccagaaccg

SEQ ID NO: 11269 - DNA, 40 bp, Artificial Sequence
  PCR primer for ORF amplification
caggagctgcacttccattagaaacaaactgtctgataaa

SEQ ID NO: 11270 - DNA, 40 bp, Artificial Sequence
  PCR primer for ORF amplification
caggagctgcacttccgttttgcaaagctctcagcctttc

SEQ ID NO: 11271 - DNA, 40 bp, Artificial Sequence
  PCR primer for ORF amplification
caggagctgcacttcctttcttagcatttttgacgaaatt

SEQ ID NO: 11272 - DNA, 40 bp, Artificial Sequence
  PCR primer for ORF amplification
caggagctgcacttccactaaacaggtaatctttaatcat

SEQ ID NO: 11273 - DNA, 40 bp, Artificial Sequence
  PCR primer for ORF amplification
caggagctgcacttccattaactgacccttcgccaagagt

SEQ ID NO: 11274 - DNA, 40 bp, Artificial Sequence
  PCR primer for ORF amplification
caggagctgcacttccatgaacagaagcacctgtagcctt

SEQ ID NO: 11275 - DNA, 40 bp, Artificial Sequence
  PCR primer for ORF amplification
caggagctgcacttccgttatacccaaatgtattgcatat

SEQ ID NO: 11276 - DNA, 40 bp, Artificial Sequence
  PCR primer for ORF amplification
caggagctgcacttccataatttcggaagataatatctga

SEQ ID NO: 11277 - DNA, 40 bp, Artificial Sequence
  PCR primer for ORF amplification
caggagctgcacttccgagttcatcgtgggctgcttcgct

SEQ ID NO: 11278 - DNA, 40 bp, Artificial Sequence
  PCR primer for ORF amplification
caggagctgcacttccttttttataggtttctggcaacca

SEQ ID NO: 11279 - DNA, 40 bp, Artificial Sequence
  PCR primer for ORF amplification
caggagctgcacttcctttaagtagtttggctctatcagg

SEQ ID NO: 11280 - DNA, 40 bp, Artificial Sequence
  PCR primer for ORF amplification
caggagctgcacttccttgtgaatgtgagttatgcgaaga

SEQ ID NO: 11281 - DNA, 40 bp, Artificial Sequence
  PCR primer for ORF amplification
caggagctgcacttcccacattatgctttctcgattctct

SEQ ID NO: 11282 - DNA, 40 bp, Artificial Sequence
  PCR primer for ORF amplification
caggagctgcacttccacggttagacttggcaacacgttc

SEQ ID NO: 11283 - DNA, 40 bp, Artificial Sequence
  PCR primer for ORF amplification
caggagctgcacttcctttaatgggttgcatctcagtctc

SEQ ID NO: 11284 - DNA, 40 bp, Artificial Sequence
  PCR primer for ORF amplification
caggagctgcacttccctgggaagacacttccgtctgctc

SEQ ID NO: 11285 - DNA, 40 bp, Artificial Sequence
  PCR primer for ORF amplification
caggagctgcacttccagcggaggcaccgtaggtttgaag

SEQ ID NO: 11286 - DNA, 40 bp, Artificial Sequence
  PCR primer for ORF amplification
caggagctgcacttccaccgcttaaattgggaagagattc

SEQ ID NO: 11287 - DNA, 40 bp, Artificial Sequence
  PCR primer for ORF amplification
caggagctgcacttccatcttcccttgtgaaatcacccaa

SEQ ID NO: 11288 - DNA, 40 bp, Artificial Sequence
  PCR primer for ORF amplification
caggagctgcacttccacttccgttaatggcttcttgttt

SEQ ID NO: 11289 - DNA, 40 bp, Artificial Sequence
  PCR primer for ORF amplification
caggagctgcacttccagcttcaaccatttctctcaatct

SEQ ID NO: 11290 - DNA, 40 bp, Artificial Sequence
  PCR primer for ORF amplification
caggagctgcacttcctgatgataagctcttcttgataaa

SEQ ID NO: 11291 - DNA, 40 bp, Artificial Sequence
  PCR primer for ORF amplification
caggagctgcacttccacagtcgaccaaagaaacagcttc

SEQ ID NO: 11292 - DNA, 40 bp, Artificial Sequence
  PCR primer for ORF amplification
caggagctgcacttccaagagtttcaaaattcttgtatac

SEQ ID NO: 11293 - DNA, 40 bp, Artificial Sequence
  PCR primer for ORF amplification
caggagctgcacttcccaaactttgaatgaatttttccat

SEQ ID NO: 11294 - DNA, 40 bp, Artificial Sequence
  PCR primer for ORF amplification
caggagctgcacttcctataccataggccttacggtagtt

SEQ ID NO: 11295 - DNA, 40 bp, Artificial Sequence
  PCR primer for ORF amplification
caggagctgcacttcctggggctagtctaacgactttcca

SEQ ID NO: 11296 - DNA, 40 bp, Artificial Sequence
  PCR primer for ORF amplification
caggagctgcacttcctggcatgcccttggcagcattagc

SEQ ID NO: 11297 - DNA, 40 bp, Artificial Sequence
  PCR primer for ORF amplification
caggagctgcacttccgttctcttcgcccttaacaattcc

SEQ ID NO: 11298 - DNA, 40 bp, Artificial Sequence
  PCR primer for ORF amplification
caggagctgcacttccaacagccaatctatcaaagtcagg

SEQ ID NO: 11299 - DNA, 40 bp, Artificial Sequence
  PCR primer for ORF amplification
caggagctgcacttccaatgccctttgtatctgattgctc

SEQ ID NO: 11300 - DNA, 40 bp, Artificial Sequence
  PCR primer for ORF amplification
caggagctgcacttcctacattatttaggaaaaacttttt

SEQ ID NO: 11301 - DNA, 40 bp, Artificial Sequence
  PCR primer for ORF amplification
caggagctgcacttccctgagcgctttctaaagctttatt

SEQ ID NO: 11302 - DNA, 40 bp, Artificial Sequence
  PCR primer for ORF amplification
caggagctgcacttccacaagatttaatctgtttccaaga

SEQ ID NO: 11303 - DNA, 40 bp, Artificial Sequence
  PCR primer for ORF amplification
caggagctgcacttccttcgtcatcctcttcttcgtcagc

SEQ ID NO: 11304 - DNA, 40 bp, Artificial Sequence
  PCR primer for ORF amplification
caggagctgcacttcctggttcttttgtcgtactatcatc

SEQ ID NO: 11305 - DNA, 40 bp, Artificial Sequence
  PCR primer for ORF amplification
caggagctgcacttccaataaactgtcccctgattcttct

SEQ ID NO: 11306 - DNA, 40 bp, Artificial Sequence
  PCR primer for ORF amplification
caggagctgcacttcctgatttacgcaaatggtaattaat

SEQ ID NO: 11307 - DNA, 40 bp, Artificial Sequence
  PCR primer for ORF amplification
caggagctgcacttccagcatcttcttcaacgacaacggt

SEQ ID NO: 11308 - DNA, 40 bp, Artificial Sequence
  PCR primer for ORF amplification
caggagctgcacttccattttcgtggttgtatgcgtctct

SEQ ID NO: 11309 - DNA, 40 bp, Artificial Sequence
  PCR primer for ORF amplification
caggagctgcacttccacgtaatcttaagtcactgacgac

SEQ ID NO: 11310 - DNA, 40 bp, Artificial Sequence
  PCR primer for ORF amplification
caggagctgcacttccttttacaatgcttttttcaacttt

SEQ ID NO: 11311 - DNA, 40 bp, Artificial Sequence
  PCR primer for ORF amplification
caggagctgcacttccatcgaaaattctatgaaaaaaccc

SEQ ID NO: 11312 - DNA, 40 bp, Artificial Sequence
  PCR primer for ORF amplification
caggagctgcacttcctatcttttcgagcggtatgtttct

SEQ ID NO: 11313 - DNA, 40 bp, Artificial Sequence
  PCR primer for ORF amplification
caggagctgcacttcctaaccttgtacctaatgtctcatt

SEQ ID NO: 11314 - DNA, 40 bp, Artificial Sequence
  PCR primer for ORF amplification
caggagctgcacttcctatatctaaatcactatcactttc

SEQ ID NO: 11315 - DNA, 40 bp, Artificial Sequence
  PCR primer for ORF amplification
caggagctgcacttccgatttctgaacagtactcttggct

SEQ ID NO: 11316 - DNA, 40 bp, Artificial Sequence
  PCR primer for ORF amplification
caggagctgcacttccggtagcaatcttctccagagaagc

SEQ ID NO: 11317 - DNA, 40 bp, Artificial Sequence
  PCR primer for ORF amplification
caggagctgcacttccttttgatgcaataccgtttctttt

SEQ ID NO: 11318 - DNA, 40 bp, Artificial Sequence
  PCR primer for ORF amplification
caggagctgcacttccagcaaaagaatcttttggctcatt

SEQ ID NO: 11319 - DNA, 40 bp, Artificial Sequence
  PCR primer for ORF amplification
caggagctgcacttccatttccataccgcctccttttata

SEQ ID NO: 11320 - DNA, 40 bp, Artificial Sequence
  PCR primer for ORF amplification
caggagctgcacttccattattggaaggtttttcacgttg

SEQ ID NO: 11321 - DNA, 40 bp, Artificial Sequence
  PCR primer for ORF amplification
caggagctgcacttcccaatctatgatttcccaactcttt

SEQ ID NO: 11322 - DNA, 40 bp, Artificial Sequence
  PCR primer for ORF amplification
caggagctgcacttcccataatggtacagctggatccact

SEQ ID NO: 11323 - DNA, 40 bp, Artificial Sequence
  PCR primer for ORF amplification
caggagctgcacttcccttacaagtcactaacatcttaga

SEQ ID NO: 11324 - DNA, 40 bp, Artificial Sequence
  PCR primer for ORF amplification
caggagctgcacttccttgtccctttttcaaatgtgttct

SEQ ID NO: 11325 - DNA, 40 bp, Artificial Sequence
  PCR primer for ORF amplification
caggagctgcacttcctttgatgtggtattgcttggccat

SEQ ID NO: 11326 - DNA, 40 bp, Artificial Sequence
  PCR primer for ORF amplification
caggagctgcacttcccctgtatttatttacagtctccaa

SEQ ID NO: 11327 - DNA, 40 bp, Artificial Sequence
  PCR primer for ORF amplification
caggagctgcacttcctgacagatcgtaatatctatcttt

SEQ ID NO: 11328 - DNA, 40 bp, Artificial Sequence
  PCR primer for ORF amplification
caggagctgcacttccgtttggcatgggcttgagtgcgta

SEQ ID NO: 11329 - DNA, 40 bp, Artificial Sequence
  PCR primer for ORF amplification
caggagctgcacttccacggaacttgataccatctttccg

SEQ ID NO: 11330 - DNA, 40 bp, Artificial Sequence
  PCR primer for ORF amplification
caggagctgcacttccctcttttaagactttattaccgtc

SEQ ID NO: 11331 - DNA, 40 bp, Artificial Sequence
  PCR primer for ORF amplification
caggagctgcacttcctatggaattagcctcagcatagag

SEQ ID NO: 11332 - DNA, 40 bp, Artificial Sequence
  PCR primer for ORF amplification
caggagctgcacttccacgtcctctgaagagtttgtactg

SEQ ID NO: 11333 - DNA, 40 bp, Artificial Sequence
  PCR primer for ORF amplification
caggagctgcacttccaggagaaactatgttatcatattt

SEQ ID NO: 11334 - DNA, 40 bp, Artificial Sequence
  PCR primer for ORF amplification
caggagctgcacttcccagttgcctcgtaatccaagaggg

SEQ ID NO: 11335 - DNA, 40 bp, Artificial Sequence
  PCR primer for ORF amplification
caggagctgcacttcccgaggattttgaacggatttctag

SEQ ID NO: 11336 - DNA, 40 bp, Artificial Sequence
  PCR primer for ORF amplification
caggagctgcacttcccttcacgttaacgccagtccaatt

SEQ ID NO: 11337 - DNA, 40 bp, Artificial Sequence
  PCR primer for ORF amplification
caggagctgcacttccgactttggtttggtaattgaaatt

SEQ ID NO: 11338 - DNA, 40 bp, Artificial Sequence
  PCR primer for ORF amplification
caggagctgcacttccctcaaaaaagtcatccttttcatc

SEQ ID NO: 11339 - DNA, 40 bp, Artificial Sequence
  PCR primer for ORF amplification
caggagctgcacttccagcaccgggagccttcgcgttacc

SEQ ID NO: 11340 - DNA, 40 bp, Artificial Sequence
  PCR primer for ORF amplification
caggagctgcacttccatctctatgtttctttttcttatc

SEQ ID NO: 11341 - DNA, 40 bp, Artificial Sequence
  PCR primer for ORF amplification
caggagctgcacttccatcaaagaactttcttgtcttgga

SEQ ID NO: 11342 - DNA, 40 bp, Artificial Sequence
  PCR primer for ORF amplification
caggagctgcacttccaattctttcggcactccatatagc

SEQ ID NO: 11343 - DNA, 40 bp, Artificial Sequence
  PCR primer for ORF amplification
caggagctgcacttccgatcttgccagcatcgaatcttct

SEQ ID NO: 11344 - DNA, 40 bp, Artificial Sequence
  PCR primer for ORF amplification
caggagctgcacttccaaaaattccatttttgaatttctc

SEQ ID NO: 11345 - DNA, 40 bp, Artificial Sequence
  PCR primer for ORF amplification
caggagctgcacttccaggtaaatcagcgtcaggatattg

SEQ ID NO: 11346 - DNA, 40 bp, Artificial Sequence
  PCR primer for ORF amplification
caggagctgcacttccttccgtctttttaagaagcgcatc

SEQ ID NO: 11347 - DNA, 40 bp, Artificial Sequence; identical to SEQ ID NO: 11346
  PCR primer for ORF amplification

SEQ ID NO: 11348 - DNA, 40 bp, Artificial Sequence
  PCR primer for ORF amplification
caggagctgcacttcctgcttgctccaacttttcataaag

SEQ ID NO: 11349 - DNA, 40 bp, Artificial Sequence
  PCR primer for ORF amplification
caggagctgcacttccaatgtatttctttaatactgatct

SEQ ID NO: 11350 - DNA, 40 bp, Artificial Sequence
  PCR primer for ORF amplification
caggagctgcacttccgaaattgctacctaaagcacgcgc

SEQ ID NO: 11351 - DNA, 40 bp, Artificial Sequence
  PCR primer for ORF amplification
caggagctgcacttccgatgtatttagcaacagcttctcc

SEQ ID NO: 11352 - DNA, 40 bp, Artificial Sequence
  PCR primer for ORF amplification
caggagctgcacttccactgcaacaagatgttggatcatt

SEQ ID NO: 11353 - DNA, 40 bp, Artificial Sequence
  PCR primer for ORF amplification
caggagctgcacttccctttgaggcaacggcagcatactt

SEQ ID NO: 11354 - DNA, 40 bp, Artificial Sequence
  PCR primer for ORF amplification
caggagctgcacttccaggcaaatcaacctctgggtattg

SEQ ID NO: 11355 - DNA, 40 bp, Artificial Sequence
  PCR primer for ORF amplification
caggagctgcacttccttttaaaaaagtttcggatgaaat

SEQ ID NO: 11356 - DNA, 40 bp, Artificial Sequence
  PCR primer for ORF amplification
caggagctgcacttccaaggttaagttcatccattagttt

SEQ ID NO: 11357 - DNA, 40 bp, Artificial Sequence
  PCR primer for ORF amplification
caggagctgcacttcctataaatttccaatgcaggtacca

SEQ ID NO: 11358 - DNA, 40 bp, Artificial Sequence
  PCR primer for ORF amplification
caggagctgcacttccaactgtgacccccatctctggata

SEQ ID NO: 11359 - DNA, 40 bp, Artificial Sequence
  PCR primer for ORF amplification
caggagctgcacttccatctaaaataatggcatcgtcgac

SEQ ID NO: 11360 - DNA, 40 bp, Artificial Sequence
  PCR primer for ORF amplification
caggagctgcacttcctatggttttgtaaaagctattacg

SEQ ID NO: 11361 - DNA, 40 bp, Artificial Sequence
  PCR primer for ORF amplification
caggagctgcacttcctctcctacgcttgttgtcgtttgc

SEQ ID NO: 11362 - DNA, 40 bp, Artificial Sequence
  PCR primer for ORF amplification
caggagctgcacttcctaaaatagttgacaaccaggccat

SEQ ID NO: 11363 - DNA, 40 bp, Artificial Sequence
  PCR primer for ORF amplification
caggagctgcacttccagcagctttctgctcacaagccac

SEQ ID NO: 11364 - DNA, 40 bp, Artificial Sequence
  PCR primer for ORF amplification
caggagctgcacttcccagtccatatttggacatttccag

SEQ ID NO: 11365 - DNA, 40 bp, Artificial Sequence
  PCR primer for ORF amplification
caggagctgcacttccttcccaattagggcccaatcctag

SEQ ID NO: 11366 - DNA, 40 bp, Artificial Sequence
  PCR primer for ORF amplification
caggagctgcacttccttccatgttgatgttagtgctttc

SEQ ID NO: 11367 - DNA, 40 bp, Artificial Sequence
  PCR primer for ORF amplification
caggagctgcacttcccaggtccatatcctggcggaaact

SEQ ID NO: 11368 - DNA, 40 bp, Artificial Sequence
  PCR primer for ORF amplification
caggagctgcacttccatccgatatatctaattttgtttt

SEQ ID NO: 11369 - DNA, 40 bp, Artificial Sequence
  PCR primer for ORF amplification
caggagctgcacttccgtttgacaagctttctcttattgc

SEQ ID NO: 11370 - DNA, 40 bp, Artificial Sequence
  PCR primer for ORF amplification
caggagctgcacttcctgtagctttccacatgtcttgcat

SEQ ID NO: 11371 - DNA, 40 bp, Artificial Sequence
  PCR primer for ORF amplification
caggagctgcacttccagggtgaagtaacaagtacagacc

SEQ ID NO: 11372 - DNA, 40 bp, Artificial Sequence
  PCR primer for ORF amplification
caggagctgcacttccaatatattgagataaccattggaa

SEQ ID NO: 11373 - DNA, 40 bp, Artificial Sequence
  PCR primer for ORF amplification
caggagctgcacttccgctatataatgcgtttatagctct

SEQ ID NO: 11374 - DNA, 40 bp, Artificial Sequence
  PCR primer for ORF amplification
caggagctgcacttccaaaaaactcatcgacaccaggata

SEQ ID NO: 11375 - DNA, 40 bp, Artificial Sequence
  PCR primer for ORF amplification
caggagctgcacttccaacaaggatgccgaaccacttgga

SEQ ID NO: 11376 - DNA, 40 bp, Artificial Sequence
  PCR primer for ORF amplification
caggagctgcacttccttctacgtcttgttgggtcattaa

SEQ ID NO: 11377 - DNA, 40 bp, Artificial Sequence
  PCR primer for ORF amplification
caggagctgcacttccaaaatctttttgagaaaattcata

SEQ ID NO: 11378 - DNA, 40 bp, Artificial Sequence
  PCR primer for ORF amplification
caggagctgcacttccatagccttcgaacaactcatctat

SEQ ID NO: 11379 - DNA, 40 bp, Artificial Sequence
  PCR primer for ORF amplification
caggagctgcacttccgttttttaaagcgtcgatggatct

SEQ ID NO: 11380 - DNA, 40 bp, Artificial Sequence
  PCR primer for ORF amplification
caggagctgcacttccctggcttggttgttgcatatccat

SEQ ID NO: 11381 - DNA, 40 bp, Artificial Sequence
  PCR primer for ORF amplification
caggagctgcacttcctaaatatctggatagttcgtcagc

SEQ ID NO: 11382 - DNA, 40 bp, Artificial Sequence
  PCR primer for ORF amplification
caggagctgcacttcctagtatgaattcgcattttatcgt

SEQ ID NO: 11383 - DNA, 40 bp, Artificial Sequence
  PCR primer for ORF amplification
caggagctgcacttcctttgggtcggggcacgacgaaatc

SEQ ID NO: 11384 - DNA, 40 bp, Artificial Sequence
  PCR primer for ORF amplification
caggagctgcacttccaacaccaccagagagtagtttttc

SEQ ID NO: 11385 - DNA, 40 bp, Artificial Sequence
  PCR primer for ORF amplification
caggagctgcacttcccttctttaactcgcttaggatttt

SEQ ID NO: 11386 - DNA, 40 bp, Artificial Sequence
  PCR primer for ORF amplification
caggagctgcacttcctttagttatcgattgagtcaaatc

SEQ ID NO: 11387 - DNA, 40 bp, Artificial Sequence
  PCR primer for ORF amplification
caggagctgcacttccaggtctgggaaccatgacatagga

SEQ ID NO: 11388 - DNA, 40 bp, Artificial Sequence
  PCR primer for ORF amplification
caggagctgcacttccctccaaagctgtcagtaaccaact

SEQ ID NO: 11389 - DNA, 40 bp, Artificial Sequence
  PCR primer for ORF amplification
caggagctgcacttcctttgatatgcgtgcctttagcatc

SEQ ID NO: 11390 - DNA, 40 bp, Artificial Sequence
  PCR primer for ORF amplification
caggagctgcacttcctacaatgatatcatttacgccttg

SEQ ID NO: 11391 - DNA, 40 bp, Artificial Sequence
  PCR primer for ORF amplification
caggagctgcacttccgattaacatagcggcaacagcagc

SEQ ID NO: 11392 - DNA, 40 bp, Artificial Sequence
  PCR primer for ORF amplification
caggagctgcacttccagacattatgttagatccatcatc

SEQ ID NO: 11393 - DNA, 40 bp, Artificial Sequence
  PCR primer for ORF amplification
caggagctgcacttccatctagcaaatctctagaacgcaa

SEQ ID NO: 11394 - DNA, 40 bp, Artificial Sequence
  PCR primer for ORF amplification
caggagctgcacttcccccgtgaaatatttcctcagggta

SEQ ID NO: 11395 - DNA, 40 bp, Artificial Sequence
  PCR primer for ORF amplification
caggagctgcacttcctttatttaggtagtttctaacctt

SEQ ID NO: 11396 - DNA, 40 bp, Artificial Sequence
  PCR primer for ORF amplification
caggagctgcacttcccaacaagtaagcagctgcgaccgc

SEQ ID NO: 11397 - DNA, 40 bp, Artificial Sequence
  PCR primer for ORF amplification
caggagctgcacttccatcccttttggatttatcattgaa

SEQ ID NO: 11398 - DNA, 40 bp, Artificial Sequence
  PCR primer for ORF amplification
caggagctgcacttccatcttttctggggccccatctaat

SEQ ID NO: 11399 - DNA, 40 bp, Artificial Sequence
  PCR primer for ORF amplification
caggagctgcacttccattcttatcacctttctttgccga

SEQ ID NO: 11400 - DNA, 40 bp, Artificial Sequence
  PCR primer for ORF amplification
caggagctgcacttcctataaaaggtattccgacaccaac

SEQ ID NO: 11401 - DNA, 40 bp, Artificial Sequence
  PCR primer for ORF amplification
caggagctgcacttcctggtatatcggcgtcaggatattg

SEQ ID NO: 11402 - DNA, 40 bp, Artificial Sequence
  PCR primer for ORF amplification
caggagctgcacttccagttagactggtctcattgaaatc

SEQ ID NO: 11403 - DNA, 40 bp, Artificial Sequence
  PCR primer for ORF amplification
caggagctgcacttccaacgtccacccgtcccaatacctc

SEQ ID NO: 11404 - DNA, 40 bp, Artificial Sequence
  PCR primer for ORF amplification
caggagctgcacttccttcaatgaaccctctatatgtcac

SEQ ID NO: 11405 - DNA, 40 bp, Artificial Sequence
  PCR primer for ORF amplification
caggagctgcacttcctaatcttctacctcttctaccacc

SEQ ID NO: 11406 - DNA, 40 bp, Artificial Sequence
  PCR primer for ORF amplification
caggagctgcacttccttgtaattcccttatagtgttcac

SEQ ID NO: 11407 - DNA, 40 bp, Artificial Sequence
  PCR primer for ORF amplification
caggagctgcacttcccgccaaactttgtatacaattaca

SEQ ID NO: 11408 - DNA, 40 bp, Artificial Sequence
  PCR primer for ORF amplification
caggagctgcacttccatccttacaaagctttagaatctc

SEQ ID NO: 11409 - DNA, 40 bp, Artificial Sequence
  PCR primer for ORF amplification
caggagctgcacttcccatttttctaaattcacttagcac

SEQ ID NO: 11410 - DNA, 40 bp, Artificial Sequence
  PCR primer for ORF amplification
caggagctgcacttccagcttcaactggttcagcttgagc

SEQ ID NO: 11411 - DNA, 40 bp, Artificial Sequence
  PCR primer for ORF amplification
caggagctgcacttcccctgtaacctctttgggggcgacc

SEQ ID NO: 11412 - DNA, 40 bp, Artificial Sequence
  PCR primer for ORF amplification
caggagctgcacttccctcctccttgaccgtaagtatttc

SEQ ID NO: 11413 - DNA, 40 bp, Artificial Sequence
  PCR primer for ORF amplification
caggagctgcacttccaagccccatttctgcttgtagttc

SEQ ID NO: 11414 - DNA, 40 bp, Artificial Sequence
  PCR primer for ORF amplification
caggagctgcacttccacgggagtaagaccaaacgttctt

SEQ ID NO: 11415 - DNA, 40 bp, Artificial Sequence
  PCR primer for ORF amplification
caggagctgcacttccgtttctctttctgtaacgtctgtc

SEQ ID NO: 11416 - DNA, 40 bp, Artificial Sequence
  PCR primer for ORF amplification
caggagctgcacttcccaagcagcatttgcgatcatcact

SEQ ID NO: 11417 - DNA, 40 bp, Artificial Sequence
  PCR primer for ORF amplification
caggagctgcacttccgtcttcagaatcctcacctacgtc

SEQ ID NO: 11418 - DNA, 40 bp, Artificial Sequence
  PCR primer for ORF amplification
caggagctgcacttcctaccgctgaagactttttattttg

SEQ ID NO: 11419 - DNA, 40 bp, Artificial Sequence
  PCR primer for ORF amplification
caggagctgcacttccatctctttttagctcataaaattc

SEQ ID NO: 11420 - DNA, 40 bp, Artificial Sequence
  PCR primer for ORF amplification
caggagctgcacttcccgtcaggattctcggaacggacaa

SEQ ID NO: 11421 - DNA, 40 bp, Artificial Sequence
  PCR primer for ORF amplification
caggagctgcacttccattttccatcaattcagcgactgt

SEQ ID NO: 11422 - DNA, 40 bp, Artificial Sequence
  PCR primer for ORF amplification
caggagctgcacttccaaaaatgctgttgacaatatcact

SEQ ID NO: 11423 - DNA, 40 bp, Artificial Sequence
  PCR primer for ORF amplification
caggagctgcacttccatcattggctttccttttcttgga

SEQ ID NO: 11424 - DNA, 40 bp, Artificial Sequence
  PCR primer for ORF amplification
caggagctgcacttccaaagaaaaggtctcgaaaaatgtt

SEQ ID NO: 11425 - DNA, 40 bp, Artificial Sequence
  PCR primer for ORF amplification
caggagctgcacttccgtatcttctttgaggtctttggga

SEQ ID NO: 11426 - DNA, 40 bp, Artificial Sequence
  PCR primer for ORF amplification
caggagctgcacttccttgtggaagaggtcttctaggcac

SEQ ID NO: 11427 - DNA, 40 bp, Artificial Sequence
  PCR primer for ORF amplification
caggagctgcacttcctttttccgaattaaagtcactatt

SEQ ID NO: 11428 - DNA, 40 bp, Artificial Sequence
  PCR primer for ORF amplification
caggagctgcacttccatccagtaaagcataaaaactttt

SEQ ID NO: 11429 - DNA, 40 bp, Artificial Sequence
  PCR primer for ORF amplification
caggagctgcacttcccttgctttttattccttcccaacg

SEQ ID NO: 11430 - DNA, 40 bp, Artificial Sequence
  PCR primer for ORF amplification
caggagctgcacttccttcttcaagtgcggctatccttct

SEQ ID NO: 11431 - DNA, 40 bp, Artificial Sequence
  PCR primer for ORF amplification
caggagctgcacttcctgattcgctgctggtgtcgttgtc

SEQ ID NO: 11432 - DNA, 40 bp, Artificial Sequence
  PCR primer for ORF amplification
caggagctgcacttccaggtaatttattttcattcattac

SEQ ID NO: 11433 - DNA, 40 bp, Artificial Sequence
  PCR primer for ORF amplification
caggagctgcacttccttcggcgatattcagtagaggagt

SEQ ID NO: 11434 - DNA, 40 bp, Artificial Sequence
  PCR primer for ORF amplification
caggagctgcacttccctcgggtttcttctttgcatacaa

SEQ ID NO: 11435 - DNA, 40 bp, Artificial Sequence
  PCR primer for ORF amplification
caggagctgcacttccttcagaagcttcttgtaaggaaga

SEQ ID NO: 11436 - DNA, 40 bp, Artificial Sequence
  PCR primer for ORF amplification
caggagctgcacttccgtatgctgtatgatctttgaagta

SEQ ID NO: 11437 - DNA, 40 bp, Artificial Sequence
  PCR primer for ORF amplification
caggagctgcacttccaatacttcttcttcctaaaagagt

SEQ ID NO: 11438 - DNA, 40 bp, Artificial Sequence
  PCR primer for ORF amplification
caggagctgcacttccatacgacaagtgggacgattcatc

SEQ ID NO: 11439 - DNA, 40 bp, Artificial Sequence
  PCR primer for ORF amplification
caggagctgcacttcccagctccagagcacgaacatactg

SEQ ID NO: 11440 - DNA, 40 bp, Artificial Sequence
  PCR primer for ORF amplification
caggagctgcacttccctgtagagcatgttggaaatattc

SEQ ID NO: 11441 - DNA, 40 bp, Artificial Sequence
  PCR primer for ORF amplification
caggagctgcacttcccttcaatttagaaagcaattgttc

SEQ ID NO: 11442 - DNA, 40 bp, Artificial Sequence
  PCR primer for ORF amplification
caggagctgcacttccagcgtgatattcaataacttccca

SEQ ID NO: 11443 - DNA, 40 bp, Artificial Sequence
  PCR primer for ORF amplification
caggagctgcacttcccagtttttcatctatccattcgcg

SEQ ID NO: 11444 - DNA, 40 bp, Artificial Sequence
  PCR primer for ORF amplification
caggagctgcacttcctttttgtgagttgacaaatcttat

SEQ ID NO: 11445 - DNA, 40 bp, Artificial Sequence
  PCR primer for ORF amplification
caggagctgcacttcctctgtagaaccatcctaaaaccaa

SEQ ID NO: 11446 - DNA, 40 bp, Artificial Sequence
  PCR primer for ORF amplification
caggagctgcacttcccggactggccatcttcagatgctt

SEQ ID NO: 11447 - DNA, 40 bp, Artificial Sequence
  PCR primer for ORF amplification
caggagctgcacttccgtcatcggccagtctcgcacaaag

SEQ ID NO: 11448 - DNA, 40 bp, Artificial Sequence
  PCR primer for ORF amplification
caggagctgcacttcctttttcttcttttggattcccttg

SEQ ID NO: 11449 - DNA, 40 bp, Artificial Sequence
  PCR primer for ORF amplification
caggagctgcacttccaaacaaagatccaaaaatgctctc

SEQ ID NO: 11450 - DNA, 40 bp, Artificial Sequence
  PCR primer for ORF amplification
caggagctgcacttcctttagcacaatcctcgtgagcgtg

SEQ ID NO: 11451 - DNA, 40 bp, Artificial Sequence
  PCR primer for ORF amplification
caggagctgcacttccacaatgggccttcagctttccttt

SEQ ID NO: 11452 - DNA, 40 bp, Artificial Sequence
  PCR primer for ORF amplification
caggagctgcacttccctcgctggtaaactgaatcgattg

SEQ ID NO: 11453 - DNA, 40 bp, Artificial Sequence
  PCR primer for ORF amplification
caggagctgcacttccgcccggcgacggcgcatttgaatg

SEQ ID NO: 11454 - DNA, 40 bp, Artificial Sequence
  PCR primer for ORF amplification
caggagctgcacttcctgtattaacgcccggcgatggtgc

SEQ ID NO: 11455 - DNA, 40 bp, Artificial Sequence
  PCR primer for ORF amplification
caggagctgcacttcctgagtaggtttcaatcaaagtatc

SEQ ID NO: 11456 - DNA, 40 bp, Artificial Sequence
  PCR primer for ORF amplification
caggagctgcacttccgtggatgatggaccggatgtcgat

SEQ ID NO: 11457 - DNA, 40 bp, Artificial Sequence
  PCR primer for ORF amplification
caggagctgcacttcctagggccgggaataattgaattat

SEQ ID NO: 11458 - DNA, 40 bp, Artificial Sequence
  PCR primer for ORF amplification
caggagctgcacttccgtttttttgcttatcccttctttg

SEQ ID NO: 11459 - DNA, 40 bp, Artificial Sequence
  PCR primer for ORF amplification
caggagctgcacttccaatagaagagttggatttgtcctt

SEQ ID NO: 11460 - DNA, 40 bp, Artificial Sequence
  PCR primer for ORF amplification
caggagctgcacttccgtttttcaatttaccaaatttgtc

SEQ ID NO: 11461 - DNA, 40 bp, Artificial Sequence
  PCR primer for ORF amplification
caggagctgcacttccatctctcgtcaaagggttgtttac

SEQ ID NO: 11462 - DNA, 40 bp, Artificial Sequence
  PCR primer for ORF amplification
caggagctgcacttcccttcctgataagctgaaacaagtg

SEQ ID NO: 11463 - DNA, 40 bp, Artificial Sequence
  PCR primer for ORF amplification
caggagctgcacttccggcccttgtcaaagggttgtttac

SEQ ID NO: 11464 - DNA, 40 bp, Artificial Sequence
  PCR primer for ORF amplification
caggagctgcacttccaacattcgaaaaatgattgaacca

SEQ ID NO: 11465 - DNA, 40 bp, Artificial Sequence
  PCR primer for ORF amplification
caggagctgcacttcccctagcagaggcgttactgactct

SEQ ID NO: 11466 - DNA, 40 bp, Artificial Sequence
  PCR primer for ORF amplification
caggagctgcacttccgagtttcaatatttggtctgtgga

SEQ ID NO: 11467 - DNA, 40 bp, Artificial Sequence
  PCR primer for ORF amplification
caggagctgcacttccgtccgatgaggacatcttcaataa

SEQ ID NO: 11468 - DNA, 40 bp, Artificial Sequence
  PCR primer for ORF amplification
caggagctgcacttccatttttagttacttcatccaaaaa

SEQ ID NO: 11469 - DNA, 40 bp, Artificial Sequence
  PCR primer for ORF amplification
caggagctgcacttcctaaccattgtgttaaaccaggatc

SEQ ID NO: 11470 - DNA, 40 bp, Artificial Sequence
  PCR primer for ORF amplification
caggagctgcacttccaacctccgtaaattccttgaactc

SEQ ID NO: 11471 - DNA, 40 bp, Artificial Sequence
  PCR primer for ORF amplification
caggagctgcacttccgcgaaacatcttccttgagctgct

SEQ ID NO: 11472 - DNA, 40 bp, Artificial Sequence
  PCR primer for ORF amplification
caggagctgcacttcctttcttaccttggttggcaacagc

SEQ ID NO: 11473 - DNA, 40 bp, Artificial Sequence
  PCR primer for ORF amplification
caggagctgcacttcctctgaacgggttatttgaagactt

SEQ ID NO: 11474 - DNA, 40 bp, Artificial Sequence
  PCR primer for ORF amplification
caggagctgcacttccctttaattgaatatatgctctgtg

SEQ ID NO: 11475 - DNA, 40 bp, Artificial Sequence
  PCR primer for ORF amplification
caggagctgcacttcccatgacagtacagcaggataataa

SEQ ID NO: 11476 - DNA, 40 bp, Artificial Sequence
  PCR primer for ORF amplification
caggagctgcacttccctgatgttttttctttgctatttt

SEQ ID NO: 11477 - DNA, 40 bp, Artificial Sequence
  PCR primer for ORF amplification
caggagctgcacttccaaccaaagctgtcctcttttttat

SEQ ID NO: 11478 - DNA, 40 bp, Artificial Sequence
  PCR primer for ORF amplification
caggagctgcacttccctttagcttgttatgagccttcac

SEQ ID NO: 11479 - DNA, 40 bp, Artificial Sequence
  PCR primer for ORF amplification
caggagctgcacttcctatggttgcgtttttctctgtaga

SEQ ID NO: 11480 - DNA, 40 bp, Artificial Sequence
  PCR primer for ORF amplification
caggagctgcacttccgtttctagagttgatgatatcaac

SEQ ID NO: 11481 - DNA, 40 bp, Artificial Sequence
  PCR primer for ORF amplification
caggagctgcacttccgacaaaaattaccatgagggcaaa

SEQ ID NO: 11482 - DNA, 40 bp, Artificial Sequence
  PCR primer for ORF amplification
caggagctgcacttcccaagttacctagacagccaccagg

SEQ ID NO: 11483 - DNA, 40 bp, Artificial Sequence
  PCR primer for ORF amplification
caggagctgcacttcctttgatgttgttggccaaggcatc

SEQ ID NO: 11484 - DNA, 40 bp, Artificial Sequence
  PCR primer for ORF amplification
caggagctgcacttcccttctcaagagtagctgctagaac

SEQ ID NO: 11485 - DNA, 40 bp, Artificial Sequence
  PCR primer for ORF amplification
caggagctgcacttccattttgttttatttttgtattatc

SEQ ID NO: 11486 - DNA, 40 bp, Artificial Sequence
  PCR primer for ORF amplification
caggagctgcacttccaaaagttttcgtttgaacttttcc

SEQ ID NO: 11487 - DNA, 40 bp, Artificial Sequence
  PCR primer for ORF amplification
caggagctgcacttccttggttacttgtaaagagatgaat

SEQ ID NO: 11488 - DNA, 40 bp, Artificial Sequence
  PCR primer for ORF amplification
caggagctgcacttccctttgatcccttcgattctgcatc

SEQ ID NO: 11489 - DNA, 40 bp, Artificial Sequence
  PCR primer for ORF amplification
caggagctgcacttccaagaatgttttccaaaaggccgtt

SEQ ID NO: 11490 - DNA, 40 bp, Artificial Sequence
  PCR primer for ORF amplification
caggagctgcacttccagtttcctggttcattaaacagct

SEQ ID NO: 11491 - DNA, 40 bp, Artificial Sequence
  PCR primer for ORF amplification
caggagctgcacttcctaatgcttctaatctatcatttat

SEQ ID NO: 11492 - DNA, 40 bp, Artificial Sequence
  PCR primer for ORF amplification
caggagctgcacttccccttttctcggtcttttcttgctc

SEQ ID NO: 11493 - DNA, 40 bp, Artificial Sequence
  PCR primer for ORF amplification
caggagctgcacttccaaccatgaaactctcgccacaacc

SEQ ID NO: 11494 - DNA, 40 bp, Artificial Sequence
  PCR primer for ORF amplification
caggagctgcacttccaataaagccagatcctgaccctcc

SEQ ID NO: 11495 - DNA, 40 bp, Artificial Sequence
  PCR primer for ORF amplification
caggagctgcacttccaaccttagatttcttatgtacatt

SEQ ID NO: 11496 - DNA, 40 bp, Artificial Sequence
  PCR primer for ORF amplification
caggagctgcacttccgttatgcgttgtattatctatgac

SEQ ID NO: 11497 - DNA, 40 bp, Artificial Sequence
  PCR primer for ORF amplification
caggagctgcacttccccatttcaacaagtcatccttagc

SEQ ID NO: 11498 - DNA, 40 bp, Artificial Sequence
  PCR primer for ORF amplification
caggagctgcacttccacgtaatatagcatcctggaagac

SEQ ID NO: 11499 - DNA, 40 bp, Artificial Sequence
  PCR primer for ORF amplification
caggagctgcacttccacgtttccgttgtttcttccattt

SEQ ID NO: 11500 - DNA, 40 bp, Artificial Sequence
  PCR primer for ORF amplification
caggagctgcacttcctttcataaaaaggccaaccaaaaa

SEQ ID NO: 11501 - DNA, 40 bp, Artificial Sequence
  PCR primer for ORF amplification
caggagctgcacttccccatttcaacagatcgtccttagc

SEQ ID NO: 11502 - DNA, 40 bp, Artificial Sequence
  PCR primer for ORF amplification
caggagctgcacttccttcattgtcgcttcctgcggcagc

SEQ ID NO: 11503 - DNA, 40 bp, Artificial Sequence
  PCR primer for ORF amplification
caggagctgcacttcctttcgaatctttttcttgggtaga

SEQ ID NO: 11504 - DNA, 40 bp, Artificial Sequence
  PCR primer for ORF amplification
caggagctgcacttcctttcaacttcttctttggacgcaa

SEQ ID NO: 11505 - DNA, 40 bp, Artificial Sequence
  PCR primer for ORF amplification
caggagctgcacttccttcttcgtcttcttcttcgtcttc

SEQ ID NO: 11506 - DNA, 40 bp, Artificial Sequence
  PCR primer for ORF amplification
caggagctgcacttccatatcttctttgtggtctttgagt

SEQ ID NO: 11507 - DNA, 40 bp, Artificial Sequence
  PCR primer for ORF amplification
caggagctgcacttcctattttttgcaagaataacctcca

SEQ ID NO: 11508 - DNA, 40 bp, Artificial Sequence
  PCR primer for ORF amplification
caggagctgcacttccaaaggcggcctcttcatttggatc

SEQ ID NO: 11509 - DNA, 40 bp, Artificial Sequence
  PCR primer for ORF amplification
caggagctgcacttccggctaagctatcgtggttgctggt

SEQ ID NO: 11510 - DNA, 40 bp, Artificial Sequence
  PCR primer for ORF amplification
caggagctgcacttcctaataacatggcggcagcggccat

SEQ ID NO: 11511 - DNA, 40 bp, Artificial Sequence
  PCR primer for ORF amplification
caggagctgcacttccagcctctatatcttttaactgttt

SEQ ID NO: 11512 - DNA, 40 bp, Artificial Sequence
  PCR primer for ORF amplification
caggagctgcacttccttgttcatttaatcattccaaaaa

SEQ ID NO: 11513 - DNA, 40 bp, Artificial Sequence
  PCR primer for ORF amplification
caggagctgcacttcctgatcttggcttttccttcttttc

SEQ ID NO: 11514 - DNA, 40 bp, Artificial Sequence
  PCR primer for ORF amplification
caggagctgcacttccttttggcagtttgaaaccctttcc

SEQ ID NO: 11515 - DNA, 40 bp, Artificial Sequence
  PCR primer for ORF amplification
caggagctgcacttccccgcccattcaatcttctagatac

SEQ ID NO: 11516 - DNA, 40 bp, Artificial Sequence
  PCR primer for ORF amplification
caggagctgcacttccattgtcttcgtcaacactcaccac

SEQ ID NO: 11517 - DNA, 40 bp, Artificial Sequence
  PCR primer for ORF amplification
caggagctgcacttcctaaaatattccaagcatcttcagc

SEQ ID NO: 11518 - DNA, 40 bp, Artificial Sequence
  PCR primer for ORF amplification
caggagctgcacttccatcttgttcagcaattgctactag

SEQ ID NO: 11519 - DNA, 40 bp, Artificial Sequence
  PCR primer for ORF amplification
caggagctgcacttcccagaaatgctttattttccttgtc

SEQ ID NO: 11520 - DNA, 40 bp, Artificial Sequence
  PCR primer for ORF amplification
caggagctgcacttccattgtgaaaagacgaagacaatat

SEQ ID NO: 11521 - DNA, 40 bp, Artificial Sequence
  PCR primer for ORF amplification
caggagctgcacttccgaattgcaaagcttgacccttttg

SEQ ID NO: 11522 - DNA, 40 bp, Artificial Sequence
  PCR primer for ORF amplification
caggagctgcacttccgattataaaaggtattatggcgta

SEQ ID NO: 11523 - DNA, 40 bp, Artificial Sequence
  PCR primer for ORF amplification
caggagctgcacttcccatatactgtttcaaaaccctttg

SEQ ID NO: 11524 - DNA, 40 bp, Artificial Sequence
  PCR primer for ORF amplification
caggagctgcacttcctccctcaagttttttcttcatttg

SEQ ID NO: 11525 - DNA, 40 bp, Artificial Sequence
  PCR primer for ORF amplification
caggagctgcacttcctttcttagccttcttttcagattt

SEQ ID NO: 11526 - DNA, 40 bp, Artificial Sequence
  PCR primer for ORF amplification
caggagctgcacttccagcatcttcttcgacaacaacagt

SEQ ID NO: 11527 - DNA, 40 bp, Artificial Sequence
  PCR primer for ORF amplification
caggagctgcacttcctagttgttcatattcatcagggta

SEQ ID NO: 11528 - DNA, 40 bp, Artificial Sequence
  PCR primer for ORF amplification
caggagctgcacttccatcttttggtctgctcaggggttt

SEQ ID NO: 11529 - DNA, 40 bp, Artificial Sequence
  PCR primer for ORF amplification
caggagctgcacttcctaacaaaagggcaccaacggcgaa

SEQ ID NO: 11530 - DNA, 40 bp, Artificial Sequence
  PCR primer for ORF amplification
caggagctgcacttcctaagttgaatagttcagtcaaaat

SEQ ID NO: 11531 - DNA, 40 bp, Artificial Sequence
  PCR primer for ORF amplification
caggagctgcacttccatggttagattttttctttttgtc

SEQ ID NO: 11532 - DNA, 40 bp, Artificial Sequence
  PCR primer for ORF amplification
caggagctgcacttccctgcgcggctgtggtcccatttga

SEQ ID NO: 11533 - DNA, 40 bp, Artificial Sequence
  PCR primer for ORF amplification
caggagctgcacttcctaacaacatagcggcagctgcgac

SEQ ID NO: 11534 - DNA, 40 bp, Artificial Sequence
  PCR primer for ORF amplification
caggagctgcacttccaggcataaagtccgccaaggcagg

SEQ ID NO: 11535 - DNA, 40 bp, Artificial Sequence
  PCR primer for ORF amplification
caggagctgcacttccaatttcatcatcgctctccacgtc

SEQ ID NO: 11536 - DNA, 40 bp, Artificial Sequence
  PCR primer for ORF amplification
caggagctgcacttccctggtcccagttttccaacaggac

SEQ ID NO: 11537 - DNA, 40 bp, Artificial Sequence
  PCR primer for ORF amplification
caggagctgcacttccgaatctcttcttttgagcagaagc

SEQ ID NO: 11538 - DNA, 40 bp, Artificial Sequence
  PCR primer for ORF amplification
caggagctgcacttcctgtgttgatttcaaatcctcttct

SEQ ID NO: 11539 - DNA, 40 bp, Artificial Sequence
  PCR primer for ORF amplification
caggagctgcacttccgtgacgacgagaagcagcaatgat

SEQ ID NO: 11540 - DNA, 40 bp, Artificial Sequence
  PCR primer for ORF amplification
caggagctgcacttccctctaacaaattcttacatagctt

SEQ ID NO: 11541 - DNA, 40 bp, Artificial Sequence
  PCR primer for ORF amplification
caggagctgcacttccagtctgcttcttcaaagtgttcaa

SEQ ID NO: 11542 - DNA, 40 bp, Artificial Sequence
  PCR primer for ORF amplification
caggagctgcacttcctattttatctccttggctgggtgg

SEQ ID NO: 11543 - DNA, 40 bp, Artificial Sequence
  PCR primer for ORF amplification
caggagctgcacttcctaatactaatagaagcaacaggag

SEQ ID NO: 11544 - DNA, 40 bp, Artificial Sequence
  PCR primer for ORF amplification
caggagctgcacttcccacagtttccaagacttcgtcctt

SEQ ID NO: 11545 - DNA, 40 bp, Artificial Sequence
  PCR primer for ORF amplification
caggagctgcacttcccacagtttccaagacttcatcctt

SEQ ID NO: 11546 - DNA, 40 bp, Artificial Sequence
  PCR primer for ORF amplification
caggagctgcacttcctttattgtcaatatctaagtcaat

SEQ ID NO: 11547 - DNA, 40 bp, Artificial Sequence
  PCR primer for ORF amplification
caggagctgcacttccagccttgatagcgtactttctttg

SEQ ID NO: 11548 - DNA, 40 bp, Artificial Sequence
  PCR primer for ORF amplification
caggagctgcacttccgcagttttcaggaatcaaggcgcc

SEQ ID NO: 11549 - DNA, 40 bp, Artificial Sequence
  PCR primer for ORF amplification
caggagctgcacttccgatgatatcagctttacctacagt

SEQ ID NO: 11550 - DNA, 40 bp, Artificial Sequence
  PCR primer for ORF amplification
caggagctgcacttccaaagacgccttcgctgccgtcata

SEQ ID NO: 11551 - DNA, 40 bp, Artificial Sequence
  PCR primer for ORF amplification
caggagctgcacttcctttgggcttcacgatattcttgat

SEQ ID NO: 11552 - DNA, 40 bp, Artificial Sequence
  PCR primer for ORF amplification
caggagctgcacttcccaaaagtttcctgcgatcactttt

SEQ ID NO: 11553 - DNA, 40 bp, Artificial Sequence
  PCR primer for ORF amplification
caggagctgcacttccctcttccaaccttcttagcaagta

SEQ ID NO: 11554 - DNA, 40 bp, Artificial Sequence
  PCR primer for ORF amplification
caggagctgcacttccagcggagtcggagttcttagctct

SEQ ID NO: 11555 - DNA, 40 bp, Artificial Sequence
  PCR primer for ORF amplification
caggagctgcacttccagcggagtcggaagtcttagctct

SEQ ID NO: 11556 - DNA, 40 bp, Artificial Sequence
  PCR primer for ORF amplification
caggagctgcacttccgaatataacatcgtcttcttgatc

SEQ ID NO: 11557 - DNA, 40 bp, Artificial Sequence
  PCR primer for ORF amplification
caggagctgcacttccaaatgctaaaaataataatgaacc

SEQ ID NO: 11558 - DNA, 40 bp, Artificial Sequence
  PCR primer for ORF amplification
caggagctgcacttcccttttcatggcttgtatttttact

SEQ ID NO: 11559 - DNA, 40 bp, Artificial Sequence
  PCR primer for ORF amplification
caggagctgcacttccatccaattcagttgtctcatctag

SEQ ID NO: 11560 - DNA, 40 bp, Artificial Sequence
  PCR primer for ORF amplification
caggagctgcacttcccctagaattccttcgtaaaatctt

SEQ ID NO: 11561 - DNA, 40 bp, Artificial Sequence
  PCR primer for ORF amplification
caggagctgcacttccgttttgtttaacaaatgctacact

SEQ ID NO: 11562 - DNA, 40 bp, Artificial Sequence
  PCR primer for ORF amplification
caggagctgcacttcctgctgtgataggacaagaatgaaa

SEQ ID NO: 11563 - DNA, 40 bp, Artificial Sequence
  PCR primer for ORF amplification
caggagctgcacttcctgatttggtaaagagcttcagaag

SEQ ID NO: 11564 - DNA, 40 bp, Artificial Sequence
  PCR primer for ORF amplification
caggagctgcacttccaatgattctagcttcattttttgg

SEQ ID NO: 11565 - DNA, 40 bp, Artificial Sequence
  PCR primer for ORF amplification
caggagctgcacttccccattggaacaacgggtccgtagt

SEQ ID NO: 11566 - DNA, 40 bp, Artificial Sequence
  PCR primer for ORF amplification
caggagctgcacttccatcaaatattgtcttattattgat

SEQ ID NO: 11567 - DNA, 40 bp, Artificial Sequence
  PCR primer for ORF amplification
caggagctgcacttcctacggtgatggtggataagtcgaa

SEQ ID NO: 11568 - DNA, 40 bp, Artificial Sequence
  PCR primer for ORF amplification
caggagctgcacttcccgagtcgaagccggccctgacaac

SEQ ID NO: 11569 - DNA, 40 bp, Artificial Sequence
  PCR primer for ORF amplification
caggagctgcacttcccgtggagagtttgaccttcttctt

SEQ ID NO: 11570 - DNA, 40 bp, Artificial Sequence
  PCR primer for ORF amplification
caggagctgcacttcccttttcggtaacttcaacactacc

SEQ ID NO: 11571 - DNA, 40 bp, Artificial Sequence
  PCR primer for ORF amplification
caggagctgcacttccggttttaaaaccaccacttttcgt

SEQ ID NO: 11572 - DNA, 40 bp, Artificial Sequence
  PCR primer for ORF amplification
caggagctgcacttcctttcatatcttcatcagcttcttc

SEQ ID NO: 11573 - DNA, 40 bp, Artificial Sequence
  PCR primer for ORF amplification
caggagctgcacttccttcttcgtcattaaatttaggagc

SEQ ID NO: 11574 - DNA, 40 bp, Artificial Sequence
  PCR primer for ORF amplification
caggagctgcacttcctgtttctctaaattcatatggtcc

SEQ ID NO: 11575 - DNA, 40 bp, Artificial Sequence
  PCR primer for ORF amplification
caggagctgcacttccttgatttgcgacttcgtcgtagtc

SEQ ID NO: 11576 - DNA, 40 bp, Artificial Sequence
  PCR primer for ORF amplification
caggagctgcacttcctttccttgctaggtttgccaaagc

SEQ ID NO: 11577 - DNA, 40 bp, Artificial Sequence
  PCR primer for ORF amplification
caggagctgcacttccttctgatttaggtcggagttcgtg

SEQ ID NO: 11578 - DNA, 40 bp, Artificial Sequence
  PCR primer for ORF amplification
caggagctgcacttccacttttccttttatttagcatctt

SEQ ID NO: 11579 - DNA, 40 bp, Artificial Sequence
  PCR primer for ORF amplification
caggagctgcacttccatgtaagtatactgcatcttttaa

SEQ ID NO: 11580 - DNA, 40 bp, Artificial Sequence
  PCR primer for ORF amplification
caggagctgcacttccaatgtgggtaccgttgttagcaga

SEQ ID NO: 11581 - DNA, 40 bp, Artificial Sequence
  PCR primer for ORF amplification
caggagctgcacttccacccctaactaattgagatttgat

SEQ ID NO: 11582 - DNA, 40 bp, Artificial Sequence
  PCR primer for ORF amplification
caggagctgcacttcccagcgggtactctgacgccagatc

SEQ ID NO: 11583 - DNA, 40 bp, Artificial Sequence
  PCR primer for ORF amplification
caggagctgcacttcctgacatttcaacatccgcttcttc

SEQ ID NO: 11584 - DNA, 40 bp, Artificial Sequence
  PCR primer for ORF amplification
caggagctgcacttccaacttgtattagacgagggacgga

SEQ ID NO: 11585 - DNA, 40 bp, Artificial Sequence
  PCR primer for ORF amplification
caggagctgcacttccggcatcttgctttaaaaattgcgc

SEQ ID NO: 11586 - DNA, 40 bp, Artificial Sequence
  PCR primer for ORF amplification
caggagctgcacttccttctaaaactatgtcaccttcttt

SEQ ID NO: 11587 - DNA, 40 bp, Artificial Sequence
  PCR primer for ORF amplification
caggagctgcacttccaccttgcttttcattccatctaca

SEQ ID NO: 11588 - DNA, 40 bp, Artificial Sequence
  PCR primer for ORF amplification
caggagctgcacttcctcctagcatacttctcttacgacc

SEQ ID NO: 11589 - DNA, 40 bp, Artificial Sequence
  PCR primer for ORF amplification
caggagctgcacttccaaccgtcatttcaccaataatttg

SEQ ID NO: 11590 - DNA, 40 bp, Artificial Sequence
  PCR primer for ORF amplification
caggagctgcacttcctacaagcaaaaccgcattgacaca

SEQ ID NO: 11591 - DNA, 40 bp, Artificial Sequence
  PCR primer for ORF amplification
caggagctgcacttcccttatgcaagaccttattctcagg

SEQ ID NO: 11592 - DNA, 40 bp, Artificial Sequence
  PCR primer for ORF amplification
caggagctgcacttccttcctcctggggttgcttcgactg

SEQ ID NO: 11593 - DNA, 40 bp, Artificial Sequence
  PCR primer for ORF amplification
caggagctgcacttccagccgttatatcgacttgttcttc

SEQ ID NO: 11594 - DNA, 40 bp, Artificial Sequence
  PCR primer for ORF amplification
caggagctgcacttccacaaatattgtcaaaaatatactt

SEQ ID NO: 11595 - DNA, 40 bp, Artificial Sequence
  PCR primer for ORF amplification
caggagctgcacttcccacaaagcgtcttccgggtagtgt

SEQ ID NO: 11596 - DNA, 40 bp, Artificial Sequence
  PCR primer for ORF amplification
caggagctgcacttcccttttcatgtgttaaatagtacgc

SEQ ID NO: 11597 - DNA, 40 bp, Artificial Sequence
  PCR primer for ORF amplification
caggagctgcacttccaatggccttaacttcttttaactt

SEQ ID NO: 11598 - DNA, 40 bp, Artificial Sequence
  PCR primer for ORF amplification
caggagctgcacttcctttcgacttggtgaatcttaaata

SEQ ID NO: 11599 - DNA, 40 bp, Artificial Sequence
  PCR primer for ORF amplification
caggagctgcacttccggcagtccctaggacagtgccgga

SEQ ID NO: 11600 - DNA, 40 bp, Artificial Sequence
  PCR primer for ORF amplification
caggagctgcacttcctgccgtttttataatggagactaa

SEQ ID NO: 11601 - DNA, 40 bp, Artificial Sequence
  PCR primer for ORF amplification
caggagctgcacttccggtattgtgaacgaaggggggtga

SEQ ID NO: 11602 - DNA, 40 bp, Artificial Sequence
  PCR primer for ORF amplification
caggagctgcacttccaatcaatggtttttcctcaattgg

SEQ ID NO: 11603 - DNA, 40 bp, Artificial Sequence
  PCR primer for ORF amplification
caggagctgcacttcctttcaatgaaccagtttggaatct

SEQ ID NO: 11604 - DNA, 40 bp, Artificial Sequence
  PCR primer for ORF amplification
caggagctgcacttccatgtagatcttctatgtacctgtt

SEQ ID NO: 11605 - DNA, 40 bp, Artificial Sequence
  PCR primer for ORF amplification
caggagctgcacttccatctgttttgttccctttgaagat

SEQ ID NO: 11606 - DNA, 40 bp, Artificial Sequence
  PCR primer for ORF amplification
caggagctgcacttccgccctgcaccggccccagtcgctc

SEQ ID NO: 11607 - DNA, 40 bp, Artificial Sequence
  PCR primer for ORF amplification
caggagctgcacttccgaagtggaggttctcggaagtggt

SEQ ID NO: 11608 - DNA, 40 bp, Artificial Sequence
  PCR primer for ORF amplification
caggagctgcacttccgaatctcaacttggagaagaacca

SEQ ID NO: 11609 - DNA, 40 bp, Artificial Sequence
  PCR primer for ORF amplification
caggagctgcacttccagcggatcttgctgtttccaaagc

SEQ ID NO: 11610 - DNA, 40 bp, Artificial Sequence
  PCR primer for ORF amplification
caggagctgcacttccgagaaacgaactatcctcgttgct

SEQ ID NO: 11611 - DNA, 40 bp, Artificial Sequence
  PCR primer for ORF amplification
caggagctgcacttcctttatagcattgcgcgtgagacaa

SEQ ID NO: 11612 - DNA, 40 bp, Artificial Sequence
  PCR primer for ORF amplification
caggagctgcacttccttttatcccgagcgcacaaatatc

SEQ ID NO: 11613 - DNA, 40 bp, Artificial Sequence
  PCR primer for ORF amplification
caggagctgcacttcctataacccttctatgagttatttt

SEQ ID NO: 11614 - DNA, 40 bp, Artificial Sequence
  PCR primer for ORF amplification
caggagctgcacttccttgatttgctatttcggtcttggc

SEQ ID NO: 11615 - DNA, 40 bp, Artificial Sequence
  PCR primer for ORF amplification
caggagctgcacttccatggaaaaactcgttaaccgttat

SEQ ID NO: 11616 - DNA, 40 bp, Artificial Sequence
  PCR primer for ORF amplification
caggagctgcacttccattgtttttttttattgggtttgt

SEQ ID NO: 11617 - DNA, 40 bp, Artificial Sequence
  PCR primer for ORF amplification
caggagctgcacttcctgtttttttgtctgctgcagctgc

SEQ ID NO: 11618 - DNA, 40 bp, Artificial Sequence
  PCR primer for ORF amplification
caggagctgcacttcctaaattctccagtgatcgtactac

SEQ ID NO: 11619 - DNA, 40 bp, Artificial Sequence
  PCR primer for ORF amplification
caggagctgcacttcccataaagtcgtcatcaccgaattc

SEQ ID NO: 11620 - DNA, 40 bp, Artificial Sequence
  PCR primer for ORF amplification
caggagctgcacttccctttcttctgaaagaagtaccttc

SEQ ID NO: 11621 - DNA, 40 bp, Artificial Sequence
  PCR primer for ORF amplification
caggagctgcacttcctacatcggcttgttcttgttcggc

SEQ ID NO: 11622 - DNA, 40 bp, Artificial Sequence
  PCR primer for ORF amplification
caggagctgcacttccaattttttgagtaccgtagccttt

SEQ ID NO: 11623 - DNA, 40 bp, Artificial Sequence
  PCR primer for ORF amplification
caggagctgcacttcccaatttacccaaggaatcgatcat

SEQ ID NO: 11624 - DNA, 40 bp, Artificial Sequence
  PCR primer for ORF amplification
caggagctgcacttcccttcgatataccagagaatatcct

SEQ ID NO: 11625 - DNA, 40 bp, Artificial Sequence
  PCR primer for ORF amplification
caggagctgcacttccataatcctcctgtagggtgtagct

SEQ ID NO: 11626 - DNA, 40 bp, Artificial Sequence
  PCR primer for ORF amplification
caggagctgcacttccgtggaaaaacttcttcatcttttc

SEQ ID NO: 11627 - DNA, 40 bp, Artificial Sequence
  PCR primer for ORF amplification
caggagctgcacttccggcaaatgccaaagatttcttaat

SEQ ID NO: 11628 - DNA, 40 bp, Artificial Sequence
  PCR primer for ORF amplification
caggagctgcacttccagatcttggcttttccttcttttc

SEQ ID NO: 11629 - DNA, 40 bp, Artificial Sequence
  PCR primer for ORF amplification
caggagctgcacttccaaagaccaaatggtatagctggta

SEQ ID NO: 11630 - DNA, 40 bp, Artificial Sequence
  PCR primer for ORF amplification
caggagctgcacttccattgtataaatctacaaatttatc

SEQ ID NO: 11631 - DNA, 40 bp, Artificial Sequence
  PCR primer for ORF amplification
caggagctgcacttccaaagcgacctcgctttgtggtacc

SEQ ID NO: 11632 - DNA, 40 bp, Artificial Sequence
  PCR primer for ORF amplification
caggagctgcacttccacgccatatattactatctaaagt

SEQ ID NO: 11633 - DNA, 40 bp, Artificial Sequence
  PCR primer for ORF amplification
caggagctgcacttcctaaaacatcgatggcttgactact

SEQ ID NO: 11634 - DNA, 40 bp, Artificial Sequence
  PCR primer for ORF amplification
caggagctgcacttccctttggtgcttcaccttcggcggc

SEQ ID NO: 11635 - DNA, 40 bp, Artificial Sequence
  PCR primer for ORF amplification
caggagctgcacttcctccacggaagatatgatgaggtga

SEQ ID NO: 11636 - DNA, 40 bp, Artificial Sequence
  PCR primer for ORF amplification
caggagctgcacttccgttttgctggccgcatcttctcaa

SEQ ID NO: 11637 - DNA, 40 bp, Artificial Sequence
  PCR primer for ORF amplification
caggagctgcacttccacactccctgcgccaattctgact

SEQ ID NO: 11638 - DNA, 40 bp, Artificial Sequence
  PCR primer for ORF amplification
caggagctgcacttccaagggtttggaagccagcggcaac

SEQ ID NO: 11639 - DNA, 40 bp, Artificial Sequence
  PCR primer for ORF amplification
caggagctgcacttccctttatatagatataagagccttc

SEQ ID NO: 11640 - DNA, 40 bp, Artificial Sequence
  PCR primer for ORF amplification
caggagctgcacttcctctgtgcctcaaagcattaacttt

SEQ ID NO: 11641 - DNA, 40 bp, Artificial Sequence
  PCR primer for ORF amplification
caggagctgcacttcctcctttaacgcgcttgttcgaaaa

SEQ ID NO: 11642 - DNA, 40 bp, Artificial Sequence
  PCR primer for ORF amplification
caggagctgcacttcctttgtcttggtgttgttcaggctg

SEQ ID NO: 11643 - DNA, 40 bp, Artificial Sequence
  PCR primer for ORF amplification
caggagctgcacttccctgcggcattgtgacttgaacatg

SEQ ID NO: 11644 - DNA, 40 bp, Artificial Sequence
  PCR primer for ORF amplification
caggagctgcacttcctttgccttctgccgcattcttacc

SEQ ID NO: 11645 - DNA, 40 bp, Artificial Sequence
  PCR primer for ORF amplification
caggagctgcacttccaactctctttctgtaacgtctgtc

SEQ ID NO: 11646 - DNA, 40 bp, Artificial Sequence
  PCR primer for ORF amplification
caggagctgcacttcctttataaggatattcaacttgtct

SEQ ID NO: 11647 - DNA, 40 bp, Artificial Sequence
  PCR primer for ORF amplification
caggagctgcacttccagtgagatcaataacttcgataag

SEQ ID NO: 11648 - DNA, 40 bp, Artificial Sequence
  PCR primer for ORF amplification
caggagctgcacttccaaaatcggtgcgttgtcttttcaa

SEQ ID NO: 11649 - DNA, 40 bp, Artificial Sequence
  PCR primer for ORF amplification
caggagctgcacttccgactcctcatcagtagaagactac

SEQ ID NO: 11650 - DNA, 40 bp, Artificial Sequence
  PCR primer for ORF amplification
caggagctgcacttccaggggcggaggacgaagaggacgg

SEQ ID NO: 11651 - DNA, 40 bp, Artificial Sequence
  PCR primer for ORF amplification
caggagctgcacttccatgttgtgggtgagattgtactga

SEQ ID NO: 11652 - DNA, 40 bp, Artificial Sequence
  PCR primer for ORF amplification
caggagctgcacttccaaatttagcaaattgtttgttagc

SEQ ID NO: 11653 - DNA, 40 bp, Artificial Sequence
  PCR primer for ORF amplification
caggagctgcacttccagtttttttgattgcatcttgaat

SEQ ID NO: 11654 - DNA, 40 bp, Artificial Sequence
  PCR primer for ORF amplification
caggagctgcacttcctaagagcatagcagcggcaccggc

SEQ ID NO: 11655 - DNA, 40 bp, Artificial Sequence
  PCR primer for ORF amplification
caggagctgcacttcctctgtaaatctcatcaaacggtct

SEQ ID NO: 11656 - DNA, 40 bp, Artificial Sequence
  PCR primer for ORF amplification
caggagctgcacttcctaaatccaaagtaattaatgcaga

SEQ ID NO: 11657 - DNA, 40 bp, Artificial Sequence
  PCR primer for ORF amplification
caggagctgcacttccatcttcagacacagattccttgtc

SEQ ID NO: 11658 - DNA, 40 bp, Artificial Sequence
  PCR primer for ORF amplification
caggagctgcacttccctccatttttagttttccgctctc

SEQ ID NO: 11659 - DNA, 40 bp, Artificial Sequence
  PCR primer for ORF amplification
caggagctgcacttccaaacatatcaagccatttaaaata

SEQ ID NO: 11660 - DNA, 40 bp, Artificial Sequence
  PCR primer for ORF amplification
caggagctgcacttccagccttagccaaagccttcttgac

SEQ ID NO: 11661 - DNA, 40 bp, Artificial Sequence; identical to SEQ ID NO: 11660
  PCR primer for ORF amplification

SEQ ID NO: 11662 - DNA, 40 bp, Artificial Sequence; identical to SEQ ID NO: 10318
  PCR primer for ORF amplification

SEQ ID NO: 11663 - DNA, 40 bp, Artificial Sequence
  PCR primer for ORF amplification
caggagctgcacttcctaacttgtggcgcctgtttccctc

SEQ ID NO: 11664 - DNA, 40 bp, Artificial Sequence
  PCR primer for ORF amplification
caggagctgcacttcccacatcgccatgctgggattcctc

SEQ ID NO: 11665 - DNA, 40 bp, Artificial Sequence
  PCR primer for ORF amplification
caggagctgcacttccaattccgaggggttcgtgaacaat

SEQ ID NO: 11666 - DNA, 40 bp, Artificial Sequence
  PCR primer for ORF amplification
caggagctgcacttccgtcgtttgttatcataaagatctc

SEQ ID NO: 11667 - DNA, 40 bp, Artificial Sequence
  PCR primer for ORF amplification
caggagctgcacttccaacggcgctataaccgcctctttg

SEQ ID NO: 11668 - DNA, 40 bp, Artificial Sequence
  PCR primer for ORF amplification
caggagctgcacttcccaaccgtcttctggtgaatatgag

SEQ ID NO: 11669 - DNA, 40 bp, Artificial Sequence
  PCR primer for ORF amplification
caggagctgcacttccgtacactggtgaggcggtcagtct

SEQ ID NO: 11670 - DNA, 40 bp, Artificial Sequence
  PCR primer for ORF amplification
caggagctgcacttccctcatcaccatcgttgaaatccag

SEQ ID NO: 11671 - DNA, 40 bp, Artificial Sequence
  PCR primer for ORF amplification
caggagctgcacttccatcagcgttacgacgagcaacctt

SEQ ID NO: 11672 - DNA, 40 bp, Artificial Sequence
  PCR primer for ORF amplification
caggagctgcacttccaataaaagagtttttaacttgaac

SEQ ID NO: 11673 - DNA, 40 bp, Artificial Sequence
  PCR primer for ORF amplification
caggagctgcacttcctagaatagtgcaagtggaagcgtt

SEQ ID NO: 11674 - DNA, 40 bp, Artificial Sequence
  PCR primer for ORF amplification
caggagctgcacttccaggacccaccagggtgaaatcaac

SEQ ID NO: 11675 - DNA, 40 bp, Artificial Sequence
  PCR primer for ORF amplification
caggagctgcacttcctaaaccatcattttcgatgaaata

SEQ ID NO: 11676 - DNA, 40 bp, Artificial Sequence
  PCR primer for ORF amplification
caggagctgcacttccttcttcgacatctatttggtcgtt

SEQ ID NO: 11677 - DNA, 40 bp, Artificial Sequence
  PCR primer for ORF amplification
caggagctgcacttccttttaacttcttctttggacgcaa

SEQ ID NO: 11678 - DNA, 40 bp, Artificial Sequence
  PCR primer for ORF amplification
caggagctgcacttcccacaggtatcttccaaaacactgt

SEQ ID NO: 11679 - DNA, 40 bp, Artificial Sequence
  PCR primer for ORF amplification
caggagctgcacttcctcttctaactactttgtacttatt

SEQ ID NO: 11680 - DNA, 40 bp, Artificial Sequence
  PCR primer for ORF amplification
caggagctgcacttcctagcacattttgtgggctcttaag

SEQ ID NO: 11681 - DNA, 40 bp, Artificial Sequence
  PCR primer for ORF amplification
caggagctgcacttccgcgataaaatagttttgttgactc

SEQ ID NO: 11682 - DNA, 40 bp, Artificial Sequence
  PCR primer for ORF amplification
caggagctgcacttcctattatgctaccatagctggaaat

SEQ ID NO: 11683 - DNA, 40 bp, Artificial Sequence
  PCR primer for ORF amplification
caggagctgcacttccataattgtaaaagcttaatttctt

SEQ ID NO: 11684 - DNA, 40 bp, Artificial Sequence
  PCR primer for ORF amplification
caggagctgcacttccagccaaagatggcaagttagaaac

SEQ ID NO: 11685 - DNA, 40 bp, Artificial Sequence
  PCR primer for ORF amplification
caggagctgcacttcctttggttggttcaccttgagtttg

SEQ ID NO: 11686 - DNA, 40 bp, Artificial Sequence
  PCR primer for ORF amplification
caggagctgcacttccacaaacgtgctccaaaggtgtatt

SEQ ID NO: 11687 - DNA, 40 bp, Artificial Sequence
  PCR primer for ORF amplification
caggagctgcacttcctcctacacgccatacttccaaagc

SEQ ID NO: 11688 - DNA, 40 bp, Artificial Sequence
  PCR primer for ORF amplification
caggagctgcacttcctcttaaccatttcaacacataata

SEQ ID NO: 11689 - DNA, 40 bp, Artificial Sequence
  PCR primer for ORF amplification
caggagctgcacttccaatacgttttttatattcaccagg

SEQ ID NO: 11690 - DNA, 40 bp, Artificial Sequence
  PCR primer for ORF amplification
caggagctgcacttccttccttaaccttaggtttggacca

SEQ ID NO: 11691 - DNA, 40 bp, Artificial Sequence
  PCR primer for ORF amplification
caggagctgcacttcctagatataagtaattgtgtagtat

SEQ ID NO: 11692 - DNA, 40 bp, Artificial Sequence
  PCR primer for ORF amplification
caggagctgcacttccaacactaaccggtgaaggaagtat

SEQ ID NO: 11693 - DNA, 40 bp, Artificial Sequence
  PCR primer for ORF amplification
caggagctgcacttcccatacggtttttcatagctctcaa

SEQ ID NO: 11694 - DNA, 40 bp, Artificial Sequence
  PCR primer for ORF amplification
caggagctgcacttccttcgtcttcttccaaagtttgagc

SEQ ID NO: 11695 - DNA, 40 bp, Artificial Sequence
  PCR primer for ORF amplification
caggagctgcacttcccacaatattttcaatacttatggc

SEQ ID NO: 11696 - DNA, 40 bp, Artificial Sequence
  PCR primer for ORF amplification
caggagctgcacttcctttgtggtcgtcttcattcactcc

SEQ ID NO: 11697 - DNA, 40 bp, Artificial Sequence
  PCR primer for ORF amplification
caggagctgcacttccgtactctatagcatgtaacgtcaa

SEQ ID NO: 11698 - DNA, 40 bp, Artificial Sequence
  PCR primer for ORF amplification
caggagctgcacttccgctttttaccttcttcttgacttg

SEQ ID NO: 11699 - DNA, 40 bp, Artificial Sequence; identical to SEQ ID NO: 11405
  PCR primer for ORF amplification

SEQ ID NO: 11700 - DNA, 40 bp, Artificial Sequence
  PCR primer for ORF amplification
caggagctgcacttccagacgagcagtactcgctaagcaa

SEQ ID NO: 11701 - DNA, 40 bp, Artificial Sequence
  PCR primer for ORF amplification
caggagctgcacttccgctctcctggttcgagaacttgtt

SEQ ID NO: 11702 - DNA, 40 bp, Artificial Sequence
  PCR primer for ORF amplification
caggagctgcacttcccaatttaatatcactcagatcttc

SEQ ID NO: 11703 - DNA, 40 bp, Artificial Sequence
  PCR primer for ORF amplification
caggagctgcacttccgtagcgttcttttaatctagatgc

SEQ ID NO: 11704 - DNA, 40 bp, Artificial Sequence
  PCR primer for ORF amplification
caggagctgcacttccgttttgttcggctttttcattgat

SEQ ID NO: 11705 - DNA, 40 bp, Artificial Sequence
  PCR primer for ORF amplification
caggagctgcacttccattagatttttcgtcggcgttatt

SEQ ID NO: 11706 - DNA, 40 bp, Artificial Sequence
  PCR primer for ORF amplification
caggagctgcacttccaggagcatttggcattgtgtgcgc

SEQ ID NO: 11707 - DNA, 40 bp, Artificial Sequence
  PCR primer for ORF amplification
caggagctgcacttccaccaaatccagcccattctattga

SEQ ID NO: 11708 - DNA, 40 bp, Artificial Sequence
  PCR primer for ORF amplification
caggagctgcacttccgaacctgtgtcttcttttcctccc

SEQ ID NO: 11709 - DNA, 40 bp, Artificial Sequence
  PCR primer for ORF amplification
caggagctgcacttcctttatggcgctggtataattcaat

SEQ ID NO: 11710 - DNA, 40 bp, Artificial Sequence
  PCR primer for ORF amplification
caggagctgcacttccctccttgtgctcctcatcgtcatc

SEQ ID NO: 11711 - DNA, 40 bp, Artificial Sequence
  PCR primer for ORF amplification
caggagctgcacttcctacttttctcatgttgattttcct

SEQ ID NO: 11712 - DNA, 40 bp, Artificial Sequence
  PCR primer for ORF amplification
caggagctgcacttccttccaacttaccgccctttctttg

SEQ ID NO: 11713 - DNA, 40 bp, Artificial Sequence
  PCR primer for ORF amplification
caggagctgcacttccgaacttagctaaatttgtagaaga

SEQ ID NO: 11714 - DNA, 40 bp, Artificial Sequence
  PCR primer for ORF amplification
caggagctgcacttcctggctttggaattttcaagctctt

SEQ ID NO: 11715 - DNA, 40 bp, Artificial Sequence; identical to SEQ ID NO: 11521
  PCR primer for ORF amplification

SEQ ID NO: 11716 - DNA, 40 bp, Artificial Sequence
  PCR primer for ORF amplification
caggagctgcacttccaagctcgtcatgactactggtatc

SEQ ID NO: 11717 - DNA, 40 bp, Artificial Sequence
  PCR primer for ORF amplification
caggagctgcacttccaaattctataggctgtccattcat

SEQ ID NO: 11718 - DNA, 40 bp, Artificial Sequence
  PCR primer for ORF amplification
caggagctgcacttcctgctttaagtatttcctcaagtgt

SEQ ID NO: 11719 - DNA, 40 bp, Artificial Sequence
  PCR primer for ORF amplification
caggagctgcacttccatcgtggtggcaaaaaaatattct

SEQ ID NO: 11720 - DNA, 40 bp, Artificial Sequence
  PCR primer for ORF amplification
caggagctgcacttccgatttttttcctctttgtgtaatg

SEQ ID NO: 11721 - DNA, 40 bp, Artificial Sequence
  PCR primer for ORF amplification
caggagctgcacttccgttaactgaatgaaacaataatgt

SEQ ID NO: 11722 - DNA, 40 bp, Artificial Sequence
  PCR primer for ORF amplification
caggagctgcacttccattatccctataaaatgaaaccga

SEQ ID NO: 11723 - DNA, 40 bp, Artificial Sequence
  PCR primer for ORF amplification
caggagctgcacttccaatgacacgagagaaggagacaat

SEQ ID NO: 11724 - DNA, 40 bp, Artificial Sequence
  PCR primer for ORF amplification
caggagctgcacttccgcttggaggtaaacgatatatatc

SEQ ID NO: 11725 - DNA, 40 bp, Artificial Sequence
  PCR primer for ORF amplification
caggagctgcacttcccgtctccaaagcagttctactgta

SEQ ID NO: 11726 - DNA, 40 bp, Artificial Sequence
  PCR primer for ORF amplification
caggagctgcacttccaaatcccttccactcttcctcttc

SEQ ID NO: 11727 - DNA, 40 bp, Artificial Sequence
  PCR primer for ORF amplification
caggagctgcacttcccgcgtatctggcaacttcttctgt

SEQ ID NO: 11728 - DNA, 40 bp, Artificial Sequence
  PCR primer for ORF amplification
caggagctgcacttccaaccgccggtgtctcgaactcgca

SEQ ID NO: 11729 - DNA, 40 bp, Artificial Sequence
  PCR primer for ORF amplification
caggagctgcacttcctttgagagactttcctcgttttat

SEQ ID NO: 11730 - DNA, 40 bp, Artificial Sequence
  PCR primer for ORF amplification
caggagctgcacttccttttgttttttccttctccgactg

SEQ ID NO: 11731 - DNA, 40 bp, Artificial Sequence
  PCR primer for ORF amplification
caggagctgcacttcctctcttgacccatgttggcatctt

SEQ ID NO: 11732 - DNA, 40 bp, Artificial Sequence
  PCR primer for ORF amplification
caggagctgcacttcctttcttagacttcttttcagactt

SEQ ID NO: 11733 - DNA, 40 bp, Artificial Sequence
  PCR primer for ORF amplification
caggagctgcacttccgtctagcttcgacgttggggctgg

SEQ ID NO: 11734 - DNA, 40 bp, Artificial Sequence
  PCR primer for ORF amplification
caggagctgcacttcccagacgtttggcaaacttccacaa

SEQ ID NO: 11735 - DNA, 40 bp, Artificial Sequence
  PCR primer for ORF amplification
caggagctgcacttcctctcttctgggccaccacccacca

SEQ ID NO: 11736 - DNA, 40 bp, Artificial Sequence
  PCR primer for ORF amplification
caggagctgcacttccctctagtgctcttctcatgaactg

SEQ ID NO: 11737 - DNA, 40 bp, Artificial Sequence
  PCR primer for ORF amplification
caggagctgcacttccattctgtatataatatagcatatc

SEQ ID NO: 11738 - DNA, 40 bp, Artificial Sequence
  PCR primer for ORF amplification
caggagctgcacttcctgatatcataccatcgtcaatatt

SEQ ID NO: 11739 - DNA, 40 bp, Artificial Sequence
  PCR primer for ORF amplification
caggagctgcacttccctcggtatttttcttaacgtagtc

SEQ ID NO: 11740 - DNA, 40 bp, Artificial Sequence
  PCR primer for ORF amplification
caggagctgcacttccattcgttgaacgtgccgcatcctt

SEQ ID NO: 11741 - DNA, 40 bp, Artificial Sequence
  PCR primer for ORF amplification
caggagctgcacttccattctgcttcttggtcacttgtgg

SEQ ID NO: 11742 - DNA, 40 bp, Artificial Sequence
  PCR primer for ORF amplification
caggagctgcacttccaaacccatgttgactcatgatctg

SEQ ID NO: 11743 - DNA, 40 bp, Artificial Sequence
  PCR primer for ORF amplification
caggagctgcacttccagctcttcttctaccagtggtctt

SEQ ID NO: 11744 - DNA, 40 bp, Artificial Sequence
  PCR primer for ORF amplification
caggagctgcacttccacagaaaacatcagctttcatgta

SEQ ID NO: 11745 - DNA, 40 bp, Artificial Sequence
  PCR primer for ORF amplification
caggagctgcacttcctctatttctgcacctagtttcatt

SEQ ID NO: 11746 - DNA, 40 bp, Artificial Sequence
  PCR primer for ORF amplification
caggagctgcacttccatccaatattggtgttcttgcatc

SEQ ID NO: 11747 - DNA, 40 bp, Artificial Sequence
  PCR primer for ORF amplification
caggagctgcacttccgaacaggtcggacacaacgtgtgg

SEQ ID NO: 11748 - DNA, 40 bp, Artificial Sequence
  PCR primer for ORF amplification
caggagctgcacttccgtatcctacccaactgaacctttt

SEQ ID NO: 11749 - DNA, 40 bp, Artificial Sequence
  PCR primer for ORF amplification
caggagctgcacttccttttttacttttctttaaccttgt

SEQ ID NO: 11750 - DNA, 40 bp, Artificial Sequence
  PCR primer for ORF amplification
caggagctgcacttccaatgtaaccgattctgttagcaat

SEQ ID NO: 11751 - DNA, 40 bp, Artificial Sequence
  PCR primer for ORF amplification
caggagctgcacttccatcctgagttgtgaatgcttgata

SEQ ID NO: 11752 - DNA, 40 bp, Artificial Sequence
  PCR primer for ORF amplification
caggagctgcacttcctaaacgatgcttcctttgtttcga

SEQ ID NO: 11753 - DNA, 40 bp, Artificial Sequence
  PCR primer for ORF amplification
caggagctgcacttcctatgtataccggcaatagtaactt

SEQ ID NO: 11754 - DNA, 40 bp, Artificial Sequence
  PCR primer for ORF amplification
caggagctgcacttccagtaaaagagcttttgaaaccagt

SEQ ID NO: 11755 - DNA, 40 bp, Artificial Sequence
  PCR primer for ORF amplification
caggagctgcacttccattatccgctaaaagaaattctgt

SEQ ID NO: 11756 - DNA, 40 bp, Artificial Sequence
  PCR primer for ORF amplification
caggagctgcacttccgaggaagacaaccatgaccgttac

SEQ ID NO: 11757 - DNA, 40 bp, Artificial Sequence
  PCR primer for ORF amplification
caggagctgcacttcctttatttgaagtatgataaatttt

SEQ ID NO: 11758 - DNA, 40 bp, Artificial Sequence
  PCR primer for ORF amplification
caggagctgcacttccgggcgagaacgatagagaccagcc

SEQ ID NO: 11759 - DNA, 40 bp, Artificial Sequence
  PCR primer for ORF amplification
caggagctgcacttccccattgtagaggcaaccagttgtt

SEQ ID NO: 11760 - DNA, 40 bp, Artificial Sequence
  PCR primer for ORF amplification
caggagctgcacttccgcgttcgccaactaatttctttaa

SEQ ID NO: 11761 - DNA, 40 bp, Artificial Sequence
  PCR primer for ORF amplification
caggagctgcacttccgtaatatctatcgctttggtttgg

SEQ ID NO: 11762 - DNA, 40 bp, Artificial Sequence
  PCR primer for ORF amplification
caggagctgcacttccaactagattatctatatagtcttc

SEQ ID NO: 11763 - DNA, 40 bp, Artificial Sequence
  PCR primer for ORF amplification
caggagctgcacttccgttacgttttcttttcagtttgtt

SEQ ID NO: 11764 - DNA, 40 bp, Artificial Sequence
  PCR primer for ORF amplification
caggagctgcacttccgatgttggatgggtacaagaagat

SEQ ID NO: 11765 - DNA, 40 bp, Artificial Sequence
  PCR primer for ORF amplification
caggagctgcacttccagtcaaagatattgagttttttaa

SEQ ID NO: 11766 - DNA, 40 bp, Artificial Sequence
  PCR primer for ORF amplification
caggagctgcacttcctggcgcgtctgtgcattcccaatc

SEQ ID NO: 11767 - DNA, 40 bp, Artificial Sequence
  PCR primer for ORF amplification
caggagctgcacttccgaagaacaccttatcattgctagg

SEQ ID NO: 11768 - DNA, 40 bp, Artificial Sequence
  PCR primer for ORF amplification
caggagctgcacttccaatgttagatgggtacaagaaaat

SEQ ID NO: 11769 - DNA, 40 bp, Artificial Sequence
  PCR primer for ORF amplification
caggagctgcacttcccaattttacaacaccagatttcca

SEQ ID NO: 11770 - DNA, 40 bp, Artificial Sequence
  PCR primer for ORF amplification
caggagctgcacttccagcaattctgtcttcaacatcatg

SEQ ID NO: 11771 - DNA, 40 bp, Artificial Sequence
  PCR primer for ORF amplification
caggagctgcacttccttttaaaagtttaaaagcgtttct

SEQ ID NO: 11772 - DNA, 40 bp, Artificial Sequence
  PCR primer for ORF amplification
caggagctgcacttccgtcgagtaggataggttcattaga

SEQ ID NO: 11773 - DNA, 40 bp, Artificial Sequence
  PCR primer for ORF amplification
caggagctgcacttccccaagtggaaatttctgtttccaa

SEQ ID NO: 11774 - DNA, 40 bp, Artificial Sequence
  PCR primer for ORF amplification
caggagctgcacttccacttaatacagcaagcaataccac

SEQ ID NO: 11775 - DNA, 40 bp, Artificial Sequence
  PCR primer for ORF amplification
caggagctgcacttccgccaaatctcaaaccttccctgtc

SEQ ID NO: 11776 - DNA, 40 bp, Artificial Sequence
  PCR primer for ORF amplification
caggagctgcacttccagcgtcgaaggacaaagaccaacc

SEQ ID NO: 11777 - DNA, 40 bp, Artificial Sequence
  PCR primer for ORF amplification
caggagctgcacttccattggtcgacacagccgcgggctt

SEQ ID NO: 11778 - DNA, 40 bp, Artificial Sequence
  PCR primer for ORF amplification
caggagctgcacttccaaagattaccctttcagtagatgg

SEQ ID NO: 11779 - DNA, 40 bp, Artificial Sequence
  PCR primer for ORF amplification
caggagctgcacttccacatgcaaatgcaccgcgagtggc

SEQ ID NO: 11780 - DNA, 40 bp, Artificial Sequence
  PCR primer for ORF amplification
caggagctgcacttccagccttaatagcgtactttctttg

SEQ ID NO: 11781 - DNA, 40 bp, Artificial Sequence
  PCR primer for ORF amplification
caggagctgcacttcctagcaagcttgaagagtacatatg

SEQ ID NO: 11782 - DNA, 40 bp, Artificial Sequence
  PCR primer for ORF amplification
caggagctgcacttcccgctctcatttctccagccgttgg

SEQ ID NO: 11783 - DNA, 40 bp, Artificial Sequence
  PCR primer for ORF amplification
caggagctgcacttcctaaatccaaggtcaaaatccttct

SEQ ID NO: 11784 - DNA, 40 bp, Artificial Sequence
  PCR primer for ORF amplification
caggagctgcacttccatgctcttgatccctagattgaaa

SEQ ID NO: 11785 - DNA, 40 bp, Artificial Sequence
  PCR primer for ORF amplification
caggagctgcacttccagaattagaagggatgtctttttt

SEQ ID NO: 11786 - DNA, 40 bp, Artificial Sequence
  PCR primer for ORF amplification
caggagctgcacttccaaacacaaacacctggtcttccat

SEQ ID NO: 11787 - DNA, 40 bp, Artificial Sequence
  PCR primer for ORF amplification
caggagctgcacttccttgtaagcgcttcactccagttct

SEQ ID NO: 11788 - DNA, 40 bp, Artificial Sequence
  PCR primer for ORF amplification
caggagctgcacttccgaagtcgtccggatcaaacagatc

SEQ ID NO: 11789 - DNA, 40 bp, Artificial Sequence
  PCR primer for ORF amplification
caggagctgcacttccgataaaacccttctctattagaaa

SEQ ID NO: 11790 - DNA, 40 bp, Artificial Sequence
  PCR primer for ORF amplification
caggagctgcacttccgctatgtttcttggatttttcctg

SEQ ID NO: 11791 - DNA, 40 bp, Artificial Sequence
  PCR primer for ORF amplification
caggagctgcacttcccatagcgtttttaagctttcttaa

SEQ ID NO: 11792 - DNA, 40 bp, Artificial Sequence
  PCR primer for ORF amplification
caggagctgcacttcccggcatgtgaaggcaatatacgta

SEQ ID NO: 11793 - DNA, 40 bp, Artificial Sequence
  PCR primer for ORF amplification
caggagctgcacttccagcaaaatcgattacaataccggg

SEQ ID NO: 11794 - DNA, 40 bp, Artificial Sequence
  PCR primer for ORF amplification
caggagctgcacttccctggtcgttccagaatttatataa

SEQ ID NO: 11795 - DNA, 40 bp, Artificial Sequence
  PCR primer for ORF amplification
caggagctgcacttcctataaggtcatcttccacttcgct

SEQ ID NO: 11796 - DNA, 40 bp, Artificial Sequence
  PCR primer for ORF amplification
caggagctgcacttcccattctccttctcttaccaacggt

SEQ ID NO: 11797 - DNA, 40 bp, Artificial Sequence
  PCR primer for ORF amplification
caggagctgcacttcctaagtacgtcaataagcctaagac

SEQ ID NO: 11798 - DNA, 40 bp, Artificial Sequence
  PCR primer for ORF amplification
caggagctgcacttccccaggtcattctctgcaaagcctt

SEQ ID NO: 11799 - DNA, 40 bp, Artificial Sequence
  PCR primer for ORF amplification
caggagctgcacttccagattggagagcatgctgcaaaaa

SEQ ID NO: 11800 - DNA, 40 bp, Artificial Sequence
  PCR primer for ORF amplification
caggagctgcacttcccaatatggctggcgttggtaatct

SEQ ID NO: 11801 - DNA, 40 bp, Artificial Sequence
  PCR primer for ORF amplification
caggagctgcacttcctttcttcttttggcctaattgtga

SEQ ID NO: 11802 - DNA, 40 bp, Artificial Sequence
  PCR primer for ORF amplification
caggagctgcacttccgattgtttgaccaaaagatctcag

SEQ ID NO: 11803 - DNA, 40 bp, Artificial Sequence
  PCR primer for ORF amplification
caggagctgcacttccgtcaaaaaatccatcatcatcatc

SEQ ID NO: 11804 - DNA, 40 bp, Artificial Sequence
  PCR primer for ORF amplification
caggagctgcacttccattcaactttttttctttcaaatc

SEQ ID NO: 11805 - DNA, 40 bp, Artificial Sequence
  PCR primer for ORF amplification
caggagctgcacttccttccaatttaccaccctttctttg

SEQ ID NO: 11806 - DNA, 40 bp, Artificial Sequence
  PCR primer for ORF amplification
caggagctgcacttccagcagcaatacgcttttgggcggc

SEQ ID NO: 11807 - DNA, 40 bp, Artificial Sequence
  PCR primer for ORF amplification
caggagctgcacttccaaatacggcatcatggaaaggaca

SEQ ID NO: 11808 - DNA, 40 bp, Artificial Sequence
  PCR primer for ORF amplification
caggagctgcacttccgtattggccttgttgcggttcttg

SEQ ID NO: 11809 - DNA, 40 bp, Artificial Sequence
  PCR primer for ORF amplification
caggagctgcacttcctacccactccgcttccacttgagc

SEQ ID NO: 11810 - DNA, 40 bp, Artificial Sequence
  PCR primer for ORF amplification
caggagctgcacttccaaatgtagcccttttttgttttct

SEQ ID NO: 11811 - DNA, 40 bp, Artificial Sequence
  PCR primer for ORF amplification
caggagctgcacttccaacagaaccggagatgaagaacca

SEQ ID NO: 11812 - DNA, 40 bp, Artificial Sequence
  PCR primer for ORF amplification
caggagctgcacttccgccaataacgttgttgaaagatcc

SEQ ID NO: 11813 - DNA, 40 bp, Artificial Sequence
  PCR primer for ORF amplification
caggagctgcacttccacaatcgacgagaccaactgtttg

SEQ ID NO: 11814 - DNA, 40 bp, Artificial Sequence
  PCR primer for ORF amplification
caggagctgcacttccttctgatattacagtactcttctg

SEQ ID NO: 11815 - DNA, 40 bp, Artificial Sequence
  PCR primer for ORF amplification
caggagctgcacttccacggccaatgttcaaaagcaagga

SEQ ID NO: 11816 - DNA, 40 bp, Artificial Sequence
  PCR primer for ORF amplification
caggagctgcacttcctaaagactgtaaacctctgattac

SEQ ID NO: 11817 - DNA, 40 bp, Artificial Sequence
  PCR primer for ORF amplification
caggagctgcacttccacggtaagatttttggaatctaga

SEQ ID NO: 11818 - DNA, 40 bp, Artificial Sequence; identical to SEQ ID NO: 10818
  PCR primer for ORF amplification

SEQ ID NO: 11819 - DNA, 40 bp, Artificial Sequence
  PCR primer for ORF amplification
caggagctgcacttccttctaggtgaatatcaccctcttg

SEQ ID NO: 11820 - DNA, 40 bp, Artificial Sequence
  PCR primer for ORF amplification
caggagctgcacttcctagcattctatgaatttgcctgtc

SEQ ID NO: 11821 - DNA, 40 bp, Artificial Sequence
  PCR primer for ORF amplification
caggagctgcacttcctgcaacagtcaaaggatcgcaatc

SEQ ID NO: 11822 - DNA, 40 bp, Artificial Sequence
  PCR primer for ORF amplification
caggagctgcacttcccattaggccatcaaaccatttctg

SEQ ID NO: 11823 - DNA, 40 bp, Artificial Sequence
  PCR primer for ORF amplification
caggagctgcacttccatcaagtatgtctttgtgaatttc

SEQ ID NO: 11824 - DNA, 40 bp, Artificial Sequence
  PCR primer for ORF amplification
caggagctgcacttccctcatcatgacagtaaattaggag

SEQ ID NO: 11825 - DNA, 40 bp, Artificial Sequence
  PCR primer for ORF amplification
caggagctgcacttccatcttcgaagctaatcttggcaga

SEQ ID NO: 11826 - DNA, 40 bp, Artificial Sequence
  PCR primer for ORF amplification
caggagctgcacttcccaatttcataatgagaaaaataaa

SEQ ID NO: 11827 - DNA, 40 bp, Artificial Sequence
  PCR primer for ORF amplification
caggagctgcacttcctagttttccttttggcaaccgtgg

SEQ ID NO: 11828 - DNA, 40 bp, Artificial Sequence
  PCR primer for ORF amplification
caggagctgcacttcccataccttcatcggacaaaggatg

SEQ ID NO: 11829 - DNA, 40 bp, Artificial Sequence
  PCR primer for ORF amplification
caggagctgcacttccagtagcagccacggttggacgatc

SEQ ID NO: 11830 - DNA, 40 bp, Artificial Sequence
  PCR primer for ORF amplification
caggagctgcacttccgaatacgcctggccctgtaatcct

SEQ ID NO: 11831 - DNA, 40 bp, Artificial Sequence
  PCR primer for ORF amplification
caggagctgcacttccgttgaaagtgtttctgtgaatttt

SEQ ID NO: 11832 - DNA, 40 bp, Artificial Sequence
  PCR primer for ORF amplification
caggagctgcacttcctataccaatctctttgtcaggaat

SEQ ID NO: 11833 - DNA, 40 bp, Artificial Sequence
  PCR primer for ORF amplification
caggagctgcacttcctaacacatcatcaagtaaatccaa

SEQ ID NO: 11834 - DNA, 40 bp, Artificial Sequence
  PCR primer for ORF amplification
caggagctgcacttccgatgaaagtttcgtatggaactgg

SEQ ID NO: 11835 - DNA, 40 bp, Artificial Sequence
  PCR primer for ORF amplification
caggagctgcacttccagcagagatacgtttttgggcagc

SEQ ID NO: 11836 - DNA, 40 bp, Artificial Sequence
  PCR primer for ORF amplification
caggagctgcacttccacgcgttttgacaacggctgggac

SEQ ID NO: 11837 - DNA, 40 bp, Artificial Sequence
  PCR primer for ORF amplification
caggagctgcacttccttttctttctcgttctatatgcag

SEQ ID NO: 11838 - DNA, 40 bp, Artificial Sequence
  PCR primer for ORF amplification
caggagctgcacttcccaaatagtcttttttattggcagt

SEQ ID NO: 11839 - DNA, 40 bp, Artificial Sequence
  PCR primer for ORF amplification
caggagctgcacttcctaatacatactttacggctaaata

SEQ ID NO: 11840 - DNA, 40 bp, Artificial Sequence
  PCR primer for ORF amplification
caggagctgcacttccgttaaaagggattctaatggagtg

SEQ ID NO: 11841 - DNA, 40 bp, Artificial Sequence
  PCR primer for ORF amplification
caggagctgcacttcctttcttgaatgttttgattactgc

SEQ ID NO: 11842 - DNA, 40 bp, Artificial Sequence
  PCR primer for ORF amplification
caggagctgcacttccattttctgcaaacatactgatgat

SEQ ID NO: 11843 - DNA, 40 bp, Artificial Sequence
  PCR primer for ORF amplification
caggagctgcacttccctgaaaaatatttattttttcagt

SEQ ID NO: 11844 - DNA, 40 bp, Artificial Sequence
  PCR primer for ORF amplification
caggagctgcacttccaacatcaacgaagaaattcttaag

SEQ ID NO: 11845 - DNA, 40 bp, Artificial Sequence
  PCR primer for ORF amplification
caggagctgcacttccttcaatacatctcgttttcgtaga

SEQ ID NO: 11846 - DNA, 40 bp, Artificial Sequence
  PCR primer for ORF amplification
caggagctgcacttccagcgttgctagcgttagtgtacaa

SEQ ID NO: 11847 - DNA, 40 bp, Artificial Sequence
  PCR primer for ORF amplification
caggagctgcacttccatcggcgttacgacgagcaacctt

SEQ ID NO: 11848 - DNA, 40 bp, Artificial Sequence
  PCR primer for ORF amplification
caggagctgcacttcctttttggtcttgtttcaaagtgtc

SEQ ID NO: 11849 - DNA, 40 bp, Artificial Sequence
  PCR primer for ORF amplification
caggagctgcacttcccattataatacacttgttttttct

SEQ ID NO: 11850 - DNA, 40 bp, Artificial Sequence
  PCR primer for ORF amplification
caggagctgcacttccatagacaaaacccaagattttacc

SEQ ID NO: 11851 - DNA, 40 bp, Artificial Sequence
  PCR primer for ORF amplification
caggagctgcacttcccttatgtttcggtatttccgtgag

SEQ ID NO: 11852 - DNA, 40 bp, Artificial Sequence
  PCR primer for ORF amplification
caggagctgcacttccatgcgcatttacatcggagtacac

SEQ ID NO: 11853 - DNA, 40 bp, Artificial Sequence
  PCR primer for ORF amplification
caggagctgcacttcctataaccgaatattcagtttcttc

SEQ ID NO: 11854 - DNA, 40 bp, Artificial Sequence
  PCR primer for ORF amplification
caggagctgcacttccttctcttttcctacataagtaata

SEQ ID NO: 11855 - DNA, 40 bp, Artificial Sequence
  PCR primer for ORF amplification
caggagctgcacttcctttttttcgtgatttaggttcttt

SEQ ID NO: 11856 - DNA, 40 bp, Artificial Sequence
  PCR primer for ORF amplification
caggagctgcacttccattaagggaagactcactatcatt

SEQ ID NO: 11857 - DNA, 40 bp, Artificial Sequence
  PCR primer for ORF amplification
caggagctgcacttccattgaataaatatctgcccaactt

SEQ ID NO: 11858 - DNA, 40 bp, Artificial Sequence
  PCR primer for ORF amplification
caggagctgcacttccatataacagtattttcacggagct

SEQ ID NO: 11859 - DNA, 40 bp, Artificial Sequence
  PCR primer for ORF amplification
caggagctgcacttcctttaaacaaggcatcgtttgataa

SEQ ID NO: 11860 - DNA, 40 bp, Artificial Sequence; identical to SEQ ID NO: 11743
  PCR primer for ORF amplification

SEQ ID NO: 11861 - DNA, 40 bp, Artificial Sequence
  PCR primer for ORF amplification
caggagctgcacttcctaatttagatgtcatactctttat

SEQ ID NO: 11862 - DNA, 40 bp, Artificial Sequence
  PCR primer for ORF amplification
caggagctgcacttccggcaatttcaaatccacttgagta

SEQ ID NO: 11863 - DNA, 40 bp, Artificial Sequence
  PCR primer for ORF amplification
caggagctgcacttcctttctcctctccgaaaaatgggaa

SEQ ID NO: 11864 - DNA, 40 bp, Artificial Sequence
  PCR primer for ORF amplification
caggagctgcacttccaagtgcagaaagagtctcaaagat

SEQ ID NO: 11865 - DNA, 40 bp, Artificial Sequence
  PCR primer for ORF amplification
caggagctgcacttcctctattcgtagaaaaatgaatgat

SEQ ID NO: 11866 - DNA, 40 bp, Artificial Sequence
  PCR primer for ORF amplification
caggagctgcacttccaaaaggtttggcacatttgcgctt

SEQ ID NO: 11867 - DNA, 40 bp, Artificial Sequence
  PCR primer for ORF amplification
caggagctgcacttccgtattctaactcacccgcaacgtg

SEQ ID NO: 11868 - DNA, 40 bp, Artificial Sequence
  PCR primer for ORF amplification
caggagctgcacttccttcttcttcacttatgtcgtcttc

SEQ ID NO: 11869 - DNA, 40 bp, Artificial Sequence
  PCR primer for ORF amplification
caggagctgcacttccaaaacctctcacaagacaaaacat

SEQ ID NO: 11870 - DNA, 40 bp, Artificial Sequence
  PCR primer for ORF amplification
caggagctgcacttcctatcttattcaaaattaattcagc

SEQ ID NO: 11871 - DNA, 40 bp, Artificial Sequence
  PCR primer for ORF amplification
caggagctgcacttccgcattcaaactctaaaataacaaa

SEQ ID NO: 11872 - DNA, 40 bp, Artificial Sequence
  PCR primer for ORF amplification
caggagctgcacttccttcactaagatgttcaattaatat

SEQ ID NO: 11873 - DNA, 40 bp, Artificial Sequence
  PCR primer for ORF amplification
caggagctgcacttcctacatcgttgtagagagttatatc

SEQ ID NO: 11874 - DNA, 40 bp, Artificial Sequence
  PCR primer for ORF amplification
caggagctgcacttccaggcttgtgtcttttggaagcatg

SEQ ID NO: 11875 - DNA, 40 bp, Artificial Sequence
  PCR primer for ORF amplification
caggagctgcacttccatctggctttgatcgcttgttata

SEQ ID NO: 11876 - DNA, 40 bp, Artificial Sequence
  PCR primer for ORF amplification
caggagctgcacttccttttggagattctatctggggttg

SEQ ID NO: 11877 - DNA, 40 bp, Artificial Sequence
  PCR primer for ORF amplification
caggagctgcacttccatttaattccttggctgcccaggt

SEQ ID NO: 11878 - DNA, 40 bp, Artificial Sequence
  PCR primer for ORF amplification
caggagctgcacttccccattctctgtccaaaaacctaga

SEQ ID NO: 11879 - DNA, 40 bp, Artificial Sequence
  PCR primer for ORF amplification
caggagctgcacttccatcaacttcccaccgggtgcaatg

SEQ ID NO: 11880 - DNA, 40 bp, Artificial Sequence
  PCR primer for ORF amplification
caggagctgcacttcctgtgtcctttggagctggcgaaga

SEQ ID NO: 11881 - DNA, 40 bp, Artificial Sequence
  PCR primer for ORF amplification
caggagctgcacttccctcaacgtcctcgatgatttgttt

SEQ ID NO: 11882 - DNA, 40 bp, Artificial Sequence
  PCR primer for ORF amplification
caggagctgcacttccactttccttggatgatttttcatt

SEQ ID NO: 11883 - DNA, 40 bp, Artificial Sequence
  PCR primer for ORF amplification
caggagctgcacttcctttcttttttagtaggtacgtcat

SEQ ID NO: 11884 - DNA, 40 bp, Artificial Sequence
  PCR primer for ORF amplification
caggagctgcacttccgagctcagaggaagctttatcgcc

SEQ ID NO: 11885 - DNA, 40 bp, Artificial Sequence
  PCR primer for ORF amplification
caggagctgcacttccaactttgatcttaccatcaataac

SEQ ID NO: 11886 - DNA, 40 bp, Artificial Sequence
  PCR primer for ORF amplification
caggagctgcacttccactattctgtgttgattgtctcct

SEQ ID NO: 11887 - DNA, 40 bp, Artificial Sequence
  PCR primer for ORF amplification
caggagctgcacttccaataagagcaactttgtcgtctct

SEQ ID NO: 11888 - DNA, 40 bp, Artificial Sequence
  PCR primer for ORF amplification
caggagctgcacttccgacagaattgctagcattctcatt

SEQ ID NO: 11889 - DNA, 40 bp, Artificial Sequence
  PCR primer for ORF amplification
caggagctgcacttcctaattttgacgaaaagaccttaat

SEQ ID NO: 11890 - DNA, 40 bp, Artificial Sequence
  PCR primer for ORF amplification
caggagctgcacttccaacaacaacaccagagttggaagc

SEQ ID NO: 11891 - DNA, 40 bp, Artificial Sequence
  PCR primer for ORF amplification
caggagctgcacttccggtccattttaaatttttaatata

SEQ ID NO: 11892 - DNA, 40 bp, Artificial Sequence
  PCR primer for ORF amplification
caggagctgcacttccttcttgcttttcttcagaaccagt

SEQ ID NO: 11893 - DNA, 40 bp, Artificial Sequence
  PCR primer for ORF amplification
caggagctgcacttcctaagtaagcgcgaaacaactgcat

SEQ ID NO: 11894 - DNA, 40 bp, Artificial Sequence
  PCR primer for ORF amplification
caggagctgcacttcctttacgtgaatagatcactttacc

SEQ ID NO: 11895 - DNA, 40 bp, Artificial Sequence
  PCR primer for ORF amplification
caggagctgcacttcctatgtagtttggggtggatcgaat

SEQ ID NO: 11896 - DNA, 40 bp, Artificial Sequence
  PCR primer for ORF amplification
caggagctgcacttccgtcatatttcaaatggccatcaac

SEQ ID NO: 11897 - DNA, 40 bp, Artificial Sequence
  PCR primer for ORF amplification
caggagctgcacttccctttcttgtttccacaacggatgg

SEQ ID NO: 11898 - DNA, 40 bp, Artificial Sequence
  PCR primer for ORF amplification
caggagctgcacttcctattttctttgaaactctttctac

SEQ ID NO: 11899 - DNA, 40 bp, Artificial Sequence
  PCR primer for ORF amplification
caggagctgcacttccagacgtctccacttcggtatccga

SEQ ID NO: 11900 - DNA, 40 bp, Artificial Sequence
  PCR primer for ORF amplification
caggagctgcacttccatgagccagtttcaatgagaaatc

SEQ ID NO: 11901 - DNA, 40 bp, Artificial Sequence
  PCR primer for ORF amplification
caggagctgcacttcctttgaataagaaggagtaccatgc

SEQ ID NO: 11902 - DNA, 40 bp, Artificial Sequence
  PCR primer for ORF amplification
caggagctgcacttcctttttttaacatatttgaaatttc

SEQ ID NO: 11903 - DNA, 40 bp, Artificial Sequence
  PCR primer for ORF amplification
caggagctgcacttccattaaacatagttttcaaagaact

SEQ ID NO: 11904 - DNA, 40 bp, Artificial Sequence
  PCR primer for ORF amplification
caggagctgcacttcctaaataaaactttttcttttcttt

SEQ ID NO: 11905 - DNA, 40 bp, Artificial Sequence
  PCR primer for ORF amplification
caggagctgcacttccctcttgcaagttggctatctccat

SEQ ID NO: 11906 - DNA, 40 bp, Artificial Sequence
  PCR primer for ORF amplification
caggagctgcacttccgagcctgccgcgatcggccgtgtt

SEQ ID NO: 11907 - DNA, 40 bp, Artificial Sequence
  PCR primer for ORF amplification
caggagctgcacttccagcgttgtttttttccaattcatt

SEQ ID NO: 11908 - DNA, 40 bp, Artificial Sequence
  PCR primer for ORF amplification
caggagctgcacttccttcttttaatttcgactttaatga

SEQ ID NO: 11909 - DNA, 40 bp, Artificial Sequence
  PCR primer for ORF amplification
caggagctgcacttccaactttccttttcttagagcttgg

SEQ ID NO: 11910 - DNA, 40 bp, Artificial Sequence
  PCR primer for ORF amplification
caggagctgcacttccgtaacccaaagcggctaattgttt

SEQ ID NO: 11911 - DNA, 40 bp, Artificial Sequence
  PCR primer for ORF amplification
caggagctgcacttccggatttcacgaaattttcttctgc

SEQ ID NO: 11912 - DNA, 40 bp, Artificial Sequence
  PCR primer for ORF amplification
caggagctgcacttccattatctattagtattttctcgta

SEQ ID NO: 11913 - DNA, 40 bp, Artificial Sequence
  PCR primer for ORF amplification
caggagctgcacttccaaatgcaccaaattctccccttaa

SEQ ID NO: 11914 - DNA, 40 bp, Artificial Sequence
  PCR primer for ORF amplification
caggagctgcacttcctaccctagaagtattacgtgattt

SEQ ID NO: 11915 - DNA, 40 bp, Artificial Sequence
  PCR primer for ORF amplification
caggagctgcacttccatatatgtaagatgccttcgcaat

SEQ ID NO: 11916 - DNA, 40 bp, Artificial Sequence
  PCR primer for ORF amplification
caggagctgcacttccgttggacgtatcatatttcctcac

SEQ ID NO: 11917 - DNA, 40 bp, Artificial Sequence
  PCR primer for ORF amplification
caggagctgcacttcccttattgtacgttacagccggtaa

SEQ ID NO: 11918 - DNA, 40 bp, Artificial Sequence
  PCR primer for ORF amplification
caggagctgcacttccccacccaatttcggaaagtcttac

SEQ ID NO: 11919 - DNA, 40 bp, Artificial Sequence
  PCR primer for ORF amplification
caggagctgcacttccttgaatagcttgatatttcaattc

SEQ ID NO: 11920 - DNA, 40 bp, Artificial Sequence
  PCR primer for ORF amplification
caggagctgcacttcctacacgacaattagaaatttcgaa

SEQ ID NO: 11921 - DNA, 40 bp, Artificial Sequence
  PCR primer for ORF amplification
caggagctgcacttccttgttgaccagccaaagcagcgat

SEQ ID NO: 11922 - DNA, 40 bp, Artificial Sequence
  PCR primer for ORF amplification
caggagctgcacttccagtgtatggattgaattttctctt

SEQ ID NO: 11923 - DNA, 40 bp, Artificial Sequence
  PCR primer for ORF amplification
caggagctgcacttccctgatgaacttcaccagcgggttc

SEQ ID NO: 11924 - DNA, 40 bp, Artificial Sequence
  PCR primer for ORF amplification
caggagctgcacttccattgtcgtcgttagagttggccaa

SEQ ID NO: 11925 - DNA, 40 bp, Artificial Sequence
  PCR primer for ORF amplification
caggagctgcacttcccggacacacttcttgttcctccca

SEQ ID NO: 11926 - DNA, 40 bp, Artificial Sequence
  PCR primer for ORF amplification
caggagctgcacttccatcgtccttattcttctgtttcga

SEQ ID NO: 11927 - DNA, 40 bp, Artificial Sequence
  PCR primer for ORF amplification
caggagctgcacttccttctcttttttgtttttccaaaaa

SEQ ID NO: 11928 - DNA, 40 bp, Artificial Sequence
  PCR primer for ORF amplification
caggagctgcacttccccatccgatttcagaaagtcttgc

SEQ ID NO: 11929 - DNA, 40 bp, Artificial Sequence
  PCR primer for ORF amplification
caggagctgcacttccgtttaagctatagttcgcacggat

SEQ ID NO: 11930 - DNA, 40 bp, Artificial Sequence
  PCR primer for ORF amplification
caggagctgcacttcctgattcttggaagtaggggtggat

SEQ ID NO: 11931 - DNA, 40 bp, Artificial Sequence
  PCR primer for ORF amplification
caggagctgcacttccaatagcagcttgatcgcaacaagt

SEQ ID NO: 11932 - DNA, 40 bp, Artificial Sequence
  PCR primer for ORF amplification
caggagctgcacttccaactttggaatgcaatgtagatga

SEQ ID NO: 11933 - DNA, 40 bp, Artificial Sequence
  PCR primer for ORF amplification
caggagctgcacttcccttgtcttcctttggcatgccaac

SEQ ID NO: 11934 - DNA, 40 bp, Artificial Sequence
  PCR primer for ORF amplification
caggagctgcacttccactccagacgttcttaaataactc

SEQ ID NO: 11935 - DNA, 40 bp, Artificial Sequence; identical to SEQ ID NO: 11374
  PCR primer for ORF amplification

SEQ ID NO: 11936 - DNA, 40 bp, Artificial Sequence
  PCR primer for ORF amplification
caggagctgcacttcctaacaatagagcggcggcaccagc

SEQ ID NO: 11937 - DNA, 40 bp, Artificial Sequence
  PCR primer for ORF amplification
caggagctgcacttccagctaggggctcgacattatcggc

SEQ ID NO: 11938 - DNA, 40 bp, Artificial Sequence
  PCR primer for ORF amplification
caggagctgcacttcctattttcccccttggggactgtga

SEQ ID NO: 11939 - DNA, 40 bp, Artificial Sequence
  PCR primer for ORF amplification
caggagctgcacttccaatcaaacccaagtttcgcgcatg

SEQ ID NO: 11940 - DNA, 40 bp, Artificial Sequence
  PCR primer for ORF amplification
caggagctgcacttccgtattcgaataaatcccagacgct

SEQ ID NO: 11941 - DNA, 40 bp, Artificial Sequence
  PCR primer for ORF amplification
caggagctgcacttccgttggaattggaatttgaacaaac

SEQ ID NO: 11942 - DNA, 40 bp, Artificial Sequence
  PCR primer for ORF amplification
caggagctgcacttccatgagaatatagatatcttcctag

SEQ ID NO: 11943 - DNA, 40 bp, Artificial Sequence
  PCR primer for ORF amplification
caggagctgcacttccaaaatcaatgcttttatagtcatc

SEQ ID NO: 11944 - DNA, 40 bp, Artificial Sequence
  PCR primer for ORF amplification
caggagctgcacttccggctagcataactaagaccttttc

SEQ ID NO: 11945 - DNA, 40 bp, Artificial Sequence
  PCR primer for ORF amplification
caggagctgcacttccgacccttttgccaagtttgtaaaa

SEQ ID NO: 11946 - DNA, 40 bp, Artificial Sequence
  PCR primer for ORF amplification
caggagctgcacttccagaagcaaatttccatgaactaca

SEQ ID NO: 11947 - DNA, 40 bp, Artificial Sequence
  PCR primer for ORF amplification
caggagctgcacttccccacagatagaaaaacatgaaagc

SEQ ID NO: 11948 - DNA, 40 bp, Artificial Sequence
  PCR primer for ORF amplification
caggagctgcacttccatagtcgggcgcttctttgggagc

SEQ ID NO: 11949 - DNA, 40 bp, Artificial Sequence
  PCR primer for ORF amplification
caggagctgcacttccatttgagttgtctttccttgtgtc

SEQ ID NO: 11950 - DNA, 40 bp, Artificial Sequence
  PCR primer for ORF amplification
caggagctgcacttcctttgctcaacaggttatcgaatct

SEQ ID NO: 11951 - DNA, 40 bp, Artificial Sequence
  PCR primer for ORF amplification
caggagctgcacttccattgaattctggagggagaatgtc

SEQ ID NO: 11952 - DNA, 40 bp, Artificial Sequence
  PCR primer for ORF amplification
caggagctgcacttccctcgtcgctgtcgtcttctgtggg

SEQ ID NO: 11953 - DNA, 40 bp, Artificial Sequence
  PCR primer for ORF amplification
caggagctgcacttcccttcctctttttacgttgatcgct

SEQ ID NO: 11954 - DNA, 40 bp, Artificial Sequence
  PCR primer for ORF amplification
caggagctgcacttccaccggtggttggtaagcctacata

SEQ ID NO: 11955 - DNA, 40 bp, Artificial Sequence
  PCR primer for ORF amplification
caggagctgcacttccttcattaatgaccttgtctgccca

SEQ ID NO: 11956 - DNA, 40 bp, Artificial Sequence
  PCR primer for ORF amplification
caggagctgcacttcctttggtattgttcaaaattttctt

SEQ ID NO: 11957 - DNA, 40 bp, Artificial Sequence
  PCR primer for ORF amplification
caggagctgcacttcccctacgattatgaaattcaaattg

SEQ ID NO: 11958 - DNA, 40 bp, Artificial Sequence
  PCR primer for ORF amplification
caggagctgcacttccaatgaaggtttcgtatggaactgg

SEQ ID NO: 11959 - DNA, 40 bp, Artificial Sequence
  PCR primer for ORF amplification
caggagctgcacttccttgctgatcctgtaagcactcata

SEQ ID NO: 11960 - DNA, 40 bp, Artificial Sequence
  PCR primer for ORF amplification
caggagctgcacttccttctgtcctaaacttaggggtact

SEQ ID NO: 11961 - DNA, 40 bp, Artificial Sequence
  PCR primer for ORF amplification
caggagctgcacttccgtcgtagcgttcgatgtagtctgt

SEQ ID NO: 11962 - DNA, 40 bp, Artificial Sequence
  PCR primer for ORF amplification
caggagctgcacttcctctattttggccaaaatcaacgtg

SEQ ID NO: 11963 - DNA, 40 bp, Artificial Sequence
  PCR primer for ORF amplification
caggagctgcacttcctttagctgctttcagtttgcgtat

SEQ ID NO: 11964 - DNA, 40 bp, Artificial Sequence
  PCR primer for ORF amplification
caggagctgcacttccttcatgacagtatctggaattgaa

SEQ ID NO: 11965 - DNA, 40 bp, Artificial Sequence
  PCR primer for ORF amplification
caggagctgcacttccctttagaatattcttgttttttat

SEQ ID NO: 11966 - DNA, 40 bp, Artificial Sequence
  PCR primer for ORF amplification
caggagctgcacttcctgatacaacaggaacattctgttc

SEQ ID NO: 11967 - DNA, 40 bp, Artificial Sequence
  PCR primer for ORF amplification
caggagctgcacttccattgaagataaaagagtaccattt

SEQ ID NO: 11968 - DNA, 40 bp, Artificial Sequence
  PCR primer for ORF amplification
caggagctgcacttccgggaaagagttcctctaaaacctc

SEQ ID NO: 11969 - DNA, 40 bp, Artificial Sequence
  PCR primer for ORF amplification
caggagctgcacttccaccttgcgcctgatcaaaacaatc

SEQ ID NO: 11970 - DNA, 40 bp, Artificial Sequence
  PCR primer for ORF amplification
caggagctgcacttcctataatattgagaatttcattagc

SEQ ID NO: 11971 - DNA, 40 bp, Artificial Sequence
  PCR primer for ORF amplification
caggagctgcacttccattttcatctatatgtagctttct

SEQ ID NO: 11972 - DNA, 40 bp, Artificial Sequence
  PCR primer for ORF amplification
caggagctgcacttccattcacgtgcaacagcaaccggat

SEQ ID NO: 11973 - DNA, 40 bp, Artificial Sequence
  PCR primer for ORF amplification
caggagctgcacttccaacagagacatcgtccgggcgctc

SEQ ID NO: 11974 - DNA, 40 bp, Artificial Sequence
  PCR primer for ORF amplification
caggagctgcacttccaaatttgaaaacttggtccttgga

SEQ ID NO: 11975 - DNA, 40 bp, Artificial Sequence
  PCR primer for ORF amplification
caggagctgcacttcctggattcttttcgaaaccctcatc

SEQ ID NO: 11976 - DNA, 40 bp, Artificial Sequence
  PCR primer for ORF amplification
caggagctgcacttccatgcatcttttttacagatgaacc

SEQ ID NO: 11977 - DNA, 40 bp, Artificial Sequence
  PCR primer for ORF amplification
caggagctgcacttcctatagaatatgaatcgccaatgct

SEQ ID NO: 11978 - DNA, 40 bp, Artificial Sequence
  PCR primer for ORF amplification
caggagctgcacttcctgaagcttcgctatcctgctgcaa

SEQ ID NO: 11979 - DNA, 40 bp, Artificial Sequence
  PCR primer for ORF amplification
caggagctgcacttccttgtcttggcgacgaccatggcat

SEQ ID NO: 11980 - DNA, 40 bp, Artificial Sequence
  PCR primer for ORF amplification
caggagctgcacttccatcttgggtcttttgagaaccacg

SEQ ID NO: 11981 - DNA, 40 bp, Artificial Sequence
  PCR primer for ORF amplification
caggagctgcacttccattacttaacgtttgacactcctt

SEQ ID NO: 11982 - DNA, 40 bp, Artificial Sequence
  PCR primer for ORF amplification
caggagctgcacttcctacatcgtttaatgcgacacatac

SEQ ID NO: 11983 - DNA, 40 bp, Artificial Sequence
  PCR primer for ORF amplification
caggagctgcacttccatatgtataaacatcaaattcatt

SEQ ID NO: 11984 - DNA, 40 bp, Artificial Sequence
  PCR primer for ORF amplification
caggagctgcacttccatttttcattaaaaaatgcttagc

SEQ ID NO: 11985 - DNA, 40 bp, Artificial Sequence
  PCR primer for ORF amplification
caggagctgcacttccaggcgtaggtagcgcttgcaactt

SEQ ID NO: 11986 - DNA, 40 bp, Artificial Sequence
  PCR primer for ORF amplification
caggagctgcacttcctacactcattttcatttgaattct

SEQ ID NO: 11987 - DNA, 40 bp, Artificial Sequence
  PCR primer for ORF amplification
caggagctgcacttccgaatttcaataggtgtggcttgtc

SEQ ID NO: 11988 - DNA, 40 bp, Artificial Sequence
  PCR primer for ORF amplification
caggagctgcacttccaaaaaatgcattgatagcatattc

SEQ ID NO: 11989 - DNA, 40 bp, Artificial Sequence
  PCR primer for ORF amplification
caggagctgcacttccttgcttgaaaaacgatgaccagcc

SEQ ID NO: 11990 - DNA, 40 bp, Artificial Sequence
  PCR primer for ORF amplification
caggagctgcacttccggaatcatccagtatgtgctgtag

SEQ ID NO: 11991 - DNA, 40 bp, Artificial Sequence
  PCR primer for ORF amplification
caggagctgcacttccatctctgttttcagcaatccactc

SEQ ID NO: 11992 - DNA, 40 bp, Artificial Sequence
  PCR primer for ORF amplification
caggagctgcacttcctgatgcctctgagcttgacatttt

SEQ ID NO: 11993 - DNA, 40 bp, Artificial Sequence
  PCR primer for ORF amplification
caggagctgcacttccctcgtcgtctgactcatcctcatc

SEQ ID NO: 11994 - DNA, 40 bp, Artificial Sequence
  PCR primer for ORF amplification
caggagctgcacttcccttcccgtgagctaacttcattct

SEQ ID NO: 11995 - DNA, 40 bp, Artificial Sequence
  PCR primer for ORF amplification
caggagctgcacttcctatatataggcctgattgtgcacc

SEQ ID NO: 11996 - DNA, 40 bp, Artificial Sequence
  PCR primer for ORF amplification
caggagctgcacttccgatctcgcgggcattttcagatgt

SEQ ID NO: 11997 - DNA, 40 bp, Artificial Sequence
  PCR primer for ORF amplification
caggagctgcacttcctacgcaagggttttgtggagtgca

SEQ ID NO: 11998 - DNA, 40 bp, Artificial Sequence
  PCR primer for ORF amplification
caggagctgcacttcccacaacaacaccggagttagatgc

SEQ ID NO: 11999 - DNA, 40 bp, Artificial Sequence
  PCR primer for ORF amplification
caggagctgcacttccgttggtctggcttggaatttcaaa

SEQ ID NO: 12000 - DNA, 40 bp, Artificial Sequence
  PCR primer for ORF amplification
caggagctgcacttccatcataccacatcttgattaactc

SEQ ID NO: 12001 - DNA, 40 bp, Artificial Sequence
  PCR primer for ORF amplification
caggagctgcacttccgacttcagccacagcagaggaact

SEQ ID NO: 12002 - DNA, 40 bp, Artificial Sequence
  PCR primer for ORF amplification
caggagctgcacttccttcatacgtctcatccaagaagga

SEQ ID NO: 12003 - DNA, 40 bp, Artificial Sequence
  PCR primer for ORF amplification
caggagctgcacttccattcatatcagggttggatagctt

SEQ ID NO: 12004 - DNA, 40 bp, Artificial Sequence
  PCR primer for ORF amplification
caggagctgcacttcccggtatatatatgtctgggtcggt

SEQ ID NO: 12005 - DNA, 40 bp, Artificial Sequence
  PCR primer for ORF amplification
caggagctgcacttcctcttttattatcgaatgagacttt

SEQ ID NO: 12006 - DNA, 40 bp, Artificial Sequence
  PCR primer for ORF amplification
caggagctgcacttccttcattgtctctggagttctttct

SEQ ID NO: 12007 - DNA, 40 bp, Artificial Sequence
  PCR primer for ORF amplification
caggagctgcacttccattcttgatcctgcctgctctctc

SEQ ID NO: 12008 - DNA, 40 bp, Artificial Sequence
  PCR primer for ORF amplification
caggagctgcacttccattatcctgcatccaagacatgaa

SEQ ID NO: 12009 - DNA, 40 bp, Artificial Sequence
  PCR primer for ORF amplification
caggagctgcacttcctttaattgccactgaattaacacc

SEQ ID NO: 12010 - DNA, 40 bp, Artificial Sequence
  PCR primer for ORF amplification
caggagctgcacttccgtgagaccatttagaccctgtcaa

SEQ ID NO: 12011 - DNA, 40 bp, Artificial Sequence
  PCR primer for ORF amplification
caggagctgcacttccttgtgccacttcttgctcagcatt

SEQ ID NO: 12012 - DNA, 40 bp, Artificial Sequence
  PCR primer for ORF amplification
caggagctgcacttccagaatcatgcaatgaattataatg

SEQ ID NO: 12013 - DNA, 40 bp, Artificial Sequence
  PCR primer for ORF amplification
caggagctgcacttccatgaaataaatcgtctcttctctg

SEQ ID NO: 12014 - DNA, 40 bp, Artificial Sequence
  PCR primer for ORF amplification
caggagctgcacttccaaaaacaacctggttcctataaaa

SEQ ID NO: 12015 - DNA, 40 bp, Artificial Sequence
  PCR primer for ORF amplification
caggagctgcacttcccatgaatcttttgaccaactcctc

SEQ ID NO: 12016 - DNA, 40 bp, Artificial Sequence
  PCR primer for ORF amplification
caggagctgcacttcctttgaattttttaccgaacaatat

SEQ ID NO: 12017 - DNA, 40 bp, Artificial Sequence
  PCR primer for ORF amplification
caggagctgcacttccccggtaccaattatctagggttct

SEQ ID NO: 12018 - DNA, 40 bp, Artificial Sequence
  PCR primer for ORF amplification
caggagctgcacttcctattagaatatttccatgtgctac

SEQ ID NO: 12019 - DNA, 40 bp, Artificial Sequence
  PCR primer for ORF amplification
caggagctgcacttccgtgtccgtacttcagatccctgaa

SEQ ID NO: 12020 - DNA, 40 bp, Artificial Sequence
  PCR primer for ORF amplification
caggagctgcacttccacccaataacctcatcgctaattc

SEQ ID NO: 12021 - DNA, 40 bp, Artificial Sequence
  PCR primer for ORF amplification
caggagctgcacttccgcttgaatagtaaactttcctgac

SEQ ID NO: 12022 - DNA, 40 bp, Artificial Sequence
  PCR primer for ORF amplification
caggagctgcacttccaactttaatgccccaatggatggc

SEQ ID NO: 12023 - DNA, 40 bp, Artificial Sequence
  PCR primer for ORF amplification
caggagctgcacttccatcctctctaatagaaactatttt

SEQ ID NO: 12024 - DNA, 40 bp, Artificial Sequence
  PCR primer for ORF amplification
caggagctgcacttcctaagaaatagtccatttgagattt

SEQ ID NO: 12025 - DNA, 40 bp, Artificial Sequence
  PCR primer for ORF amplification
caggagctgcacttccattcagtataaattttttatttct

SEQ ID NO: 12026 - DNA, 40 bp, Artificial Sequence
  PCR primer for ORF amplification
caggagctgcacttcctgcacttctcttcggatttattgc

SEQ ID NO: 12027 - DNA, 40 bp, Artificial Sequence
  PCR primer for ORF amplification
caggagctgcacttcccgatttgaagtaatttgaccaatt

SEQ ID NO: 12028 - DNA, 40 bp, Artificial Sequence
  PCR primer for ORF amplification
caggagctgcacttccttgttttacactcttatcttcatc

SEQ ID NO: 12029 - DNA, 40 bp, Artificial Sequence
  PCR primer for ORF amplification
caggagctgcacttccgtcgaggctccgatgaaccgttct

SEQ ID NO: 12030 - DNA, 40 bp, Artificial Sequence
  PCR primer for ORF amplification
caggagctgcacttccaataacgatgttatctattagtct

SEQ ID NO: 12031 - DNA, 40 bp, Artificial Sequence
  PCR primer for ORF amplification
caggagctgcacttccccacttgtatacgccgcctgtaac

SEQ ID NO: 12032 - DNA, 40 bp, Artificial Sequence
  PCR primer for ORF amplification
caggagctgcacttccgtcgcgtaccgtcactggcccggc

SEQ ID NO: 12033 - DNA, 40 bp, Artificial Sequence
  PCR primer for ORF amplification
caggagctgcacttccacaaattatacaacaaccaccact

SEQ ID NO: 12034 - DNA, 40 bp, Artificial Sequence
  PCR primer for ORF amplification
caggagctgcacttcctttagacgcatttctcatcgaaag

SEQ ID NO: 12035 - DNA, 40 bp, Artificial Sequence
  PCR primer for ORF amplification
caggagctgcacttccaccaggtggtagttgggaaatgtc

SEQ ID NO: 12036 - DNA, 40 bp, Artificial Sequence
  PCR primer for ORF amplification
caggagctgcacttccagagaatttccatctgttaccaca

SEQ ID NO: 12037 - DNA, 40 bp, Artificial Sequence
  PCR primer for ORF amplification
caggagctgcacttcctagggcaaagaagttattgtcatc

SEQ ID NO: 12038 - DNA, 40 bp, Artificial Sequence
  PCR primer for ORF amplification
caggagctgcacttccaaagggatcctcatatggatcctc

SEQ ID NO: 12039 - DNA, 40 bp, Artificial Sequence
  PCR primer for ORF amplification
caggagctgcacttcctctttgttgatgactgttttgtcc

SEQ ID NO: 12040 - DNA, 40 bp, Artificial Sequence
  PCR primer for ORF amplification
caggagctgcacttccttgtctattgtatatttcatcatc

SEQ ID NO: 12041 - DNA, 40 bp, Artificial Sequence
  PCR primer for ORF amplification
caggagctgcacttccccttttaaataaatgaacgggtat

SEQ ID NO: 12042 - DNA, 40 bp, Artificial Sequence
  PCR primer for ORF amplification
caggagctgcacttcccttgaattttttgccaaacattat

SEQ ID NO: 12043 - DNA, 40 bp, Artificial Sequence
  PCR primer for ORF amplification
caggagctgcacttccgttagtcttcttttgagcattgtt

SEQ ID NO: 12044 - DNA, 40 bp, Artificial Sequence
  PCR primer for ORF amplification
caggagctgcacttccttcgttactggaagtgaaaggact

SEQ ID NO: 12045 - DNA, 40 bp, Artificial Sequence
  PCR primer for ORF amplification
caggagctgcacttccctttcttggttttggtggattgaa

SEQ ID NO: 12046 - DNA, 40 bp, Artificial Sequence
  PCR primer for ORF amplification
caggagctgcacttcctttgccccttccatcgattcttgc

SEQ ID NO: 12047 - DNA, 40 bp, Artificial Sequence
  PCR primer for ORF amplification
caggagctgcacttccaacgtaataccatttttgcacctc

SEQ ID NO: 12048 - DNA, 40 bp, Artificial Sequence
  PCR primer for ORF amplification
caggagctgcacttccgctggtaacagtaaatttaccaaa

SEQ ID NO: 12049 - DNA, 40 bp, Artificial Sequence
  PCR primer for ORF amplification
caggagctgcacttccttgttttttaccatacttgacttc

SEQ ID NO: 12050 - DNA, 40 bp, Artificial Sequence
  PCR primer for ORF amplification
caggagctgcacttccttgggtagagtcccaatctctttt

SEQ ID NO: 12051 - DNA, 40 bp, Artificial Sequence
  PCR primer for ORF amplification
caggagctgcacttcccacacttagcctcgaataacgatc

SEQ ID NO: 12052 - DNA, 40 bp, Artificial Sequence
  PCR primer for ORF amplification
caggagctgcacttccccaaccttccatggtatagtcatg

SEQ ID NO: 12053 - DNA, 40 bp, Artificial Sequence
  PCR primer for ORF amplification
caggagctgcacttccaaatattataaacctgaacaatag

SEQ ID NO: 12054 - DNA, 40 bp, Artificial Sequence
  PCR primer for ORF amplification
caggagctgcacttccaaatacaaatggaatcaagaatgc

SEQ ID NO: 12055 - DNA, 40 bp, Artificial Sequence
  PCR primer for ORF amplification
caggagctgcacttccagatagagagacgagtgcatcgat

SEQ ID NO: 12056 - DNA, 40 bp, Artificial Sequence
  PCR primer for ORF amplification
caggagctgcacttccttcccagtcatcatcgtcgtcgtc

SEQ ID NO: 12057 - DNA, 40 bp, Artificial Sequence
  PCR primer for ORF amplification
caggagctgcacttccaactgatctagtgagtttcccgct

SEQ ID NO: 12058 - DNA, 40 bp, Artificial Sequence
  PCR primer for ORF amplification
caggagctgcacttccattgtttttgttgatcttcttctt

SEQ ID NO: 12059 - DNA, 40 bp, Artificial Sequence
  PCR primer for ORF amplification
caggagctgcacttccttggaaaaactctttggctttttt

SEQ ID NO: 12060 - DNA, 40 bp, Artificial Sequence
  PCR primer for ORF amplification
caggagctgcacttccgtaaatcttcttcttttcatcaac

SEQ ID NO: 12061 - DNA, 40 bp, Artificial Sequence
  PCR primer for ORF amplification
caggagctgcacttccaggattttttatgaaaccctcatt

SEQ ID NO: 12062 - DNA, 40 bp, Artificial Sequence
  PCR primer for ORF amplification
caggagctgcacttcctaattcccccattacggcagcaat

SEQ ID NO: 12063 - DNA, 40 bp, Artificial Sequence
  PCR primer for ORF amplification
caggagctgcacttccattcatcgatatgccacctctgta

SEQ ID NO: 12064 - DNA, 40 bp, Artificial Sequence
  PCR primer for ORF amplification
caggagctgcacttcccaaacctttctttttgatatgaga

SEQ ID NO: 12065 - DNA, 40 bp, Artificial Sequence
  PCR primer for ORF amplification
caggagctgcacttccgtccttgtgttcggctttaaaatg

SEQ ID NO: 12066 - DNA, 40 bp, Artificial Sequence
  PCR primer for ORF amplification
caggagctgcacttcctaagaaatagccggctctttgatt

SEQ ID NO: 12067 - DNA, 40 bp, Artificial Sequence
  PCR primer for ORF amplification
caggagctgcacttccaagcctatgcttaaggttctcgta

SEQ ID NO: 12068 - DNA, 40 bp, Artificial Sequence
  PCR primer for ORF amplification
caggagctgcacttccatgaccaccaccaccaatttcaat

SEQ ID NO: 12069 - DNA, 40 bp, Artificial Sequence
  PCR primer for ORF amplification
caggagctgcacttcctcccaaagaggaagcaccagtaat

SEQ ID NO: 12070 - DNA, 40 bp, Artificial Sequence
  PCR primer for ORF amplification
caggagctgcacttcccttttcgttaattgaagagaggaa

SEQ ID NO: 12071 - DNA, 40 bp, Artificial Sequence
  PCR primer for ORF amplification
caggagctgcacttcctaactcattattggttaaggtgta

SEQ ID NO: 12072 - DNA, 40 bp, Artificial Sequence
  PCR primer for ORF amplification
caggagctgcacttccggacaagaattcttttatgtaatc

SEQ ID NO: 12073 - DNA, 40 bp, Artificial Sequence
  PCR primer for ORF amplification
caggagctgcacttcccaaccttgcgtaaatataatctgt

SEQ ID NO: 12074 - DNA, 40 bp, Artificial Sequence
  PCR primer for ORF amplification
caggagctgcacttccttggaaaattgggaaggatcccca

SEQ ID NO: 12075 - DNA, 40 bp, Artificial Sequence
  PCR primer for ORF amplification
caggagctgcacttcccttgaatacttcgaaaggagacca

SEQ ID NO: 12076 - DNA, 40 bp, Artificial Sequence
  PCR primer for ORF amplification
caggagctgcacttccaatcctcgaattttccctatattt

SEQ ID NO: 12077 - DNA, 40 bp, Artificial Sequence
  PCR primer for ORF amplification
caggagctgcacttccatcgaataaaccgaaacccatgtc

SEQ ID NO: 12078 - DNA, 40 bp, Artificial Sequence
  PCR primer for ORF amplification
caggagctgcacttcccgtgctcacgttctgctgtaggtg

SEQ ID NO: 12079 - DNA, 40 bp, Artificial Sequence
  PCR primer for ORF amplification
caggagctgcacttcccttcgatccgcccaggaatcccga

SEQ ID NO: 12080 - DNA, 40 bp, Artificial Sequence
  PCR primer for ORF amplification
caggagctgcacttccagacttgaaattaattaattcggg

SEQ ID NO: 12081 - DNA, 40 bp, Artificial Sequence
  PCR primer for ORF amplification
caggagctgcacttccaaagacgaagacttgatcgtcgcc

SEQ ID NO: 12082 - DNA, 40 bp, Artificial Sequence
  PCR primer for ORF amplification
caggagctgcacttcctactttttgagcagcgtagttgta

SEQ ID NO: 12083 - DNA, 40 bp, Artificial Sequence
  PCR primer for ORF amplification
caggagctgcacttccaaaaacaaaaactttatcggttcc

SEQ ID NO: 12084 - DNA, 40 bp, Artificial Sequence
  PCR primer for ORF amplification
caggagctgcacttcccaatttgaatttaaaccttttttc

SEQ ID NO: 12085 - DNA, 40 bp, Artificial Sequence
  PCR primer for ORF amplification
caggagctgcacttccaatcatcacaattcttggttcttc

SEQ ID NO: 12086 - DNA, 40 bp, Artificial Sequence
  PCR primer for ORF amplification
caggagctgcacttccattcagtctctgaatagccataaa

SEQ ID NO: 12087 - DNA, 40 bp, Artificial Sequence
  PCR primer for ORF amplification
caggagctgcacttccacttatacttcttttagagaaaat

SEQ ID NO: 12088 - DNA, 40 bp, Artificial Sequence
  PCR primer for ORF amplification
caggagctgcacttccttcttcagagatgcagtacgatat

SEQ ID NO: 12089 - DNA, 40 bp, Artificial Sequence
  PCR primer for ORF amplification
caggagctgcacttcccttgataaatttctgaaagttttc

SEQ ID NO: 12090 - DNA, 40 bp, Artificial Sequence
  PCR primer for ORF amplification
caggagctgcacttcctaagaaccaaattaaaaccgttaa

SEQ ID NO: 12091 - DNA, 40 bp, Artificial Sequence
  PCR primer for ORF amplification
caggagctgcacttccattcaagtttttgttaagataatc

SEQ ID NO: 12092 - DNA, 40 bp, Artificial Sequence
  PCR primer for ORF amplification
caggagctgcacttcctgaaaagtcacagtccaaggagta

SEQ ID NO: 12093 - DNA, 40 bp, Artificial Sequence
  PCR primer for ORF amplification
caggagctgcacttcctcctgttgttttcttatataaagc

SEQ ID NO: 12094 - DNA, 40 bp, Artificial Sequence
  PCR primer for ORF amplification
caggagctgcacttcctggtttagcttcggtcgtggtgtg

SEQ ID NO: 12095 - DNA, 40 bp, Artificial Sequence
  PCR primer for ORF amplification
caggagctgcacttcctcgaattaaattgcctaaggggtc

SEQ ID NO: 12096 - DNA, 40 bp, Artificial Sequence
  PCR primer for ORF amplification
caggagctgcacttccaatgctgttcaacttcccacggaa

SEQ ID NO: 12097 - DNA, 40 bp, Artificial Sequence
  PCR primer for ORF amplification
caggagctgcacttccggtatttcgaggagtactagtttc

SEQ ID NO: 12098 - DNA, 40 bp, Artificial Sequence
  PCR primer for ORF amplification
caggagctgcacttccatctatatcatgttgatcttgagg

SEQ ID NO: 12099 - DNA, 40 bp, Artificial Sequence
  PCR primer for ORF amplification
caggagctgcacttccatgtttggcaactggggtttcacc

SEQ ID NO: 12100 - DNA, 40 bp, Artificial Sequence
  PCR primer for ORF amplification
caggagctgcacttccgttgcaattagctttgtgcccact

SEQ ID NO: 12101 - DNA, 40 bp, Artificial Sequence
  PCR primer for ORF amplification
caggagctgcacttcctaaaatcaaaccacagctttgaaa

SEQ ID NO: 12102 - DNA, 40 bp, Artificial Sequence
  PCR primer for ORF amplification
caggagctgcacttccatacgtcattaggaaatgttttgc

SEQ ID NO: 12103 - DNA, 40 bp, Artificial Sequence
  PCR primer for ORF amplification
caggagctgcacttccacccattaaccacattagaacatt

SEQ ID NO: 12104 - DNA, 40 bp, Artificial Sequence
  PCR primer for ORF amplification
caggagctgcacttccgtacatccgcaaataatggatggc

SEQ ID NO: 12105 - DNA, 40 bp, Artificial Sequence
  PCR primer for ORF amplification
caggagctgcacttccaaatttcaacatgtgtggcttgtc

SEQ ID NO: 12106 - DNA, 40 bp, Artificial Sequence
  PCR primer for ORF amplification
caggagctgcacttcccgctaccgcttcttgagactgttg

SEQ ID NO: 12107 - DNA, 40 bp, Artificial Sequence
  PCR primer for ORF amplification
caggagctgcacttccaatagacaaaccttggtggaattt

SEQ ID NO: 12108 - DNA, 40 bp, Artificial Sequence
  PCR primer for ORF amplification
caggagctgcacttccgtagaaggttgatggtctcttgta

SEQ ID NO: 12109 - DNA, 40 bp, Artificial Sequence
  PCR primer for ORF amplification
caggagctgcacttccaagggttattctataaccaggagt

SEQ ID NO: 12110 - DNA, 40 bp, Artificial Sequence
  PCR primer for ORF amplification
caggagctgcacttccttgttcattcttagtgactttgtc

SEQ ID NO: 12111 - DNA, 40 bp, Artificial Sequence
  PCR primer for ORF amplification
caggagctgcacttccaccatttacgtcgtaaatgtctac

SEQ ID NO: 12112 - DNA, 40 bp, Artificial Sequence
  PCR primer for ORF amplification
caggagctgcacttccaacccatctccataaacagcaatc

SEQ ID NO: 12113 - DNA, 40 bp, Artificial Sequence
  PCR primer for ORF amplification
caggagctgcacttccagggtggatatgagaatgcattaa

SEQ ID NO: 12114 - DNA, 40 bp, Artificial Sequence
  PCR primer for ORF amplification
caggagctgcacttcctagtaaattggtgagaacattacc

SEQ ID NO: 12115 - DNA, 40 bp, Artificial Sequence
  PCR primer for ORF amplification
caggagctgcacttccaactatcctaaaagcttcttgtac

SEQ ID NO: 12116 - DNA, 40 bp, Artificial Sequence
  PCR primer for ORF amplification
caggagctgcacttccgttcagattatttattttgtggtg

SEQ ID NO: 12117 - DNA, 40 bp, Artificial Sequence
  PCR primer for ORF amplification
caggagctgcacttccagcactgttgttaaaatgtctagc

SEQ ID NO: 12118 - DNA, 40 bp, Artificial Sequence
  PCR primer for ORF amplification
caggagctgcacttcccataaatccattatcatacaccac

SEQ ID NO: 12119 - DNA, 40 bp, Artificial Sequence
  PCR primer for ORF amplification
caggagctgcacttccccagctttgatatttcttaataca

SEQ ID NO: 12120 - DNA, 40 bp, Artificial Sequence
  PCR primer for ORF amplification
caggagctgcacttcccttctcctttttaacttcaattga

SEQ ID NO: 12121 - DNA, 40 bp, Artificial Sequence
  PCR primer for ORF amplification
caggagctgcacttccattttggtttggcttgtatgcttc

SEQ ID NO: 12122 - DNA, 40 bp, Artificial Sequence
  PCR primer for ORF amplification
caggagctgcacttccgattatttctctaccattcaggac

SEQ ID NO: 12123 - DNA, 40 bp, Artificial Sequence
  PCR primer for ORF amplification
caggagctgcacttccaaatgcagcagaaaaatcgatcgc

SEQ ID NO: 12124 - DNA, 40 bp, Artificial Sequence
  PCR primer for ORF amplification
caggagctgcacttcctcgttggtaaggataaatccaatt

SEQ ID NO: 12125 - DNA, 40 bp, Artificial Sequence
  PCR primer for ORF amplification
caggagctgcacttcccatttttgttacctgcatgatcaa

SEQ ID NO: 12126 - DNA, 40 bp, Artificial Sequence
  PCR primer for ORF amplification
caggagctgcacttcctggcatttgattgacgttcctgtt

SEQ ID NO: 12127 - DNA, 40 bp, Artificial Sequence
  PCR primer for ORF amplification
caggagctgcacttcctgtagtgtttaagactttgtttct

SEQ ID NO: 12128 - DNA, 40 bp, Artificial Sequence
  PCR primer for ORF amplification
caggagctgcacttcctattttaatggtttttggcttgcc

SEQ ID NO: 12129 - DNA, 40 bp, Artificial Sequence
  PCR primer for ORF amplification
caggagctgcacttccaaatacagttgaaagagttgtcag

SEQ ID NO: 12130 - DNA, 40 bp, Artificial Sequence
  PCR primer for ORF amplification
caggagctgcacttccaattgtccattcatcgaaatagac

SEQ ID NO: 12131 - DNA, 40 bp, Artificial Sequence
  PCR primer for ORF amplification
caggagctgcacttccgttattcttttttgtttcatcatc

SEQ ID NO: 12132 - DNA, 40 bp, Artificial Sequence
  PCR primer for ORF amplification
caggagctgcacttcctactatgctaagaaaactctttac

SEQ ID NO: 12133 - DNA, 40 bp, Artificial Sequence
  PCR primer for ORF amplification
caggagctgcacttccaaagcccatttccttcatagcatc

SEQ ID NO: 12134 - DNA, 40 bp, Artificial Sequence
  PCR primer for ORF amplification
caggagctgcacttccttcgctctttgaagcgagatcttc

SEQ ID NO: 12135 - DNA, 40 bp, Artificial Sequence
  PCR primer for ORF amplification
caggagctgcacttccagcgtcttcctttagcaaagcgtc

SEQ ID NO: 12136 - DNA, 40 bp, Artificial Sequence
  PCR primer for ORF amplification
caggagctgcacttccggagacaatcccgttctccatctt

SEQ ID NO: 12137 - DNA, 40 bp, Artificial Sequence
  PCR primer for ORF amplification
caggagctgcacttcctgtttgcgtttcaccagacaacag

SEQ ID NO: 12138 - DNA, 40 bp, Artificial Sequence
  PCR primer for ORF amplification
caggagctgcacttccctcatcctgttctttcccctccag

SEQ ID NO: 12139 - DNA, 40 bp, Artificial Sequence
  PCR primer for ORF amplification
caggagctgcacttccccaagcattatcataccctcctga

SEQ ID NO: 12140 - DNA, 40 bp, Artificial Sequence
  PCR primer for ORF amplification
caggagctgcacttcctgaaaaatggataccaacctggtg

SEQ ID NO: 12141 - DNA, 40 bp, Artificial Sequence
  PCR primer for ORF amplification
caggagctgcacttcccaagttggttgtattattattatt

SEQ ID NO: 12142 - DNA, 40 bp, Artificial Sequence
  PCR primer for ORF amplification
caggagctgcacttccaacaggcgcatgtgtaaataaata

SEQ ID NO: 12143 - DNA, 40 bp, Artificial Sequence
  PCR primer for ORF amplification
caggagctgcacttcctttgaacttcttaccaaacaagat

SEQ ID NO: 12144 - DNA, 40 bp, Artificial Sequence
  PCR primer for ORF amplification
caggagctgcacttccattttccatggactgtgatagcga

SEQ ID NO: 12145 - DNA, 40 bp, Artificial Sequence
  PCR primer for ORF amplification
caggagctgcacttcccttgtgtcttaatgaaaccgtatg

SEQ ID NO: 12146 - DNA, 40 bp, Artificial Sequence
  PCR primer for ORF amplification
caggagctgcacttcccaattcgtcgtgcttgtttcctga

SEQ ID NO: 12147 - DNA, 40 bp, Artificial Sequence
  PCR primer for ORF amplification
caggagctgcacttccaagagtgctcaataattgatctac

SEQ ID NO: 12148 - DNA, 40 bp, Artificial Sequence
  PCR primer for ORF amplification
caggagctgcacttccgttagacacggagtgaaggatttc

SEQ ID NO: 12149 - DNA, 40 bp, Artificial Sequence
  PCR primer for ORF amplification
caggagctgcacttccatcgcagcgagcccttttaggtct

SEQ ID NO: 12150 - DNA, 40 bp, Artificial Sequence
  PCR primer for ORF amplification
caggagctgcacttcccaaaaaatctattaatttatcaac

SEQ ID NO: 12151 - DNA, 40 bp, Artificial Sequence
  PCR primer for ORF amplification
caggagctgcacttccgttaaagggcgaatcagtagcagc

SEQ ID NO: 12152 - DNA, 40 bp, Artificial Sequence
  PCR primer for ORF amplification
caggagctgcacttccagataaataacttgaaaagtccac

SEQ ID NO: 12153 - DNA, 40 bp, Artificial Sequence
  PCR primer for ORF amplification
caggagctgcacttccttctagggaagttaagtatttctc

SEQ ID NO: 12154 - DNA, 40 bp, Artificial Sequence
  PCR primer for ORF amplification
caggagctgcacttcctgcagttgcttgctccacggagct

SEQ ID NO: 12155 - DNA, 40 bp, Artificial Sequence
  PCR primer for ORF amplification
caggagctgcacttccagcgatcaattcaacaacaccacc

SEQ ID NO: 12156 - DNA, 40 bp, Artificial Sequence
  PCR primer for ORF amplification
caggagctgcacttccgttggccttcttgccgtcattttc

SEQ ID NO: 12157 - DNA, 40 bp, Artificial Sequence
  PCR primer for ORF amplification
caggagctgcacttccaattttgtttttctcttgagattt

SEQ ID NO: 12158 - DNA, 40 bp, Artificial Sequence
  PCR primer for ORF amplification
caggagctgcacttcctgaattactaaacacgtccagttt

SEQ ID NO: 12159 - DNA, 40 bp, Artificial Sequence
  PCR primer for ORF amplification
caggagctgcacttcctaagggataattcttaaataaata

SEQ ID NO: 12160 - DNA, 40 bp, Artificial Sequence
  PCR primer for ORF amplification
caggagctgcacttccaaatgtacaaaataagtcttcttc

SEQ ID NO: 12161 - DNA, 40 bp, Artificial Sequence
  PCR primer for ORF amplification
caggagctgcacttccattcgatagtaggcggtcaaaaat

SEQ ID NO: 12162 - DNA, 40 bp, Artificial Sequence
  PCR primer for ORF amplification
caggagctgcacttcctttttctttagacagttctacgtt

SEQ ID NO: 12163 - DNA, 40 bp, Artificial Sequence
  PCR primer for ORF amplification
caggagctgcacttccttcttcagacttcttagacttctt

SEQ ID NO: 12164 - DNA, 40 bp, Artificial Sequence
  PCR primer for ORF amplification
caggagctgcacttcctgtcgttaacatgttatcgcgttc

SEQ ID NO: 12165 - DNA, 40 bp, Artificial Sequence
  PCR primer for ORF amplification
caggagctgcacttccggagcggttcccaccatatctccc

SEQ ID NO: 12166 - DNA, 40 bp, Artificial Sequence
  PCR primer for ORF amplification
caggagctgcacttcctttcttcttttcagcttcagcttc

SEQ ID NO: 12167 - DNA, 40 bp, Artificial Sequence
  PCR primer for ORF amplification
caggagctgcacttccctcagtcaaattctcatcatcata

SEQ ID NO: 12168 - DNA, 40 bp, Artificial Sequence
  PCR primer for ORF amplification
caggagctgcacttcctgatgactgaacattgatctgttg

SEQ ID NO: 12169 - DNA, 40 bp, Artificial Sequence
  PCR primer for ORF amplification
caggagctgcacttccgtatctaaatggttgagagtatgc

SEQ ID NO: 12170 - DNA, 40 bp, Artificial Sequence
  PCR primer for ORF amplification
caggagctgcacttccatagttgtattcgtttggtttttg

SEQ ID NO: 12171 - DNA, 40 bp, Artificial Sequence
  PCR primer for ORF amplification
caggagctgcacttcctaacaataaataagttcctgactt

SEQ ID NO: 12172 - DNA, 40 bp, Artificial Sequence
  PCR primer for ORF amplification
caggagctgcacttcctgcttgattttgactttggttgag

SEQ ID NO: 12173 - DNA, 40 bp, Artificial Sequence
  PCR primer for ORF amplification
caggagctgcacttccaagctcctcggatataacacatcc

SEQ ID NO: 12174 - DNA, 40 bp, Artificial Sequence
  PCR primer for ORF amplification
caggagctgcacttcctaacgtgttgaatgcttggatctt

SEQ ID NO: 12175 - DNA, 40 bp, Artificial Sequence
  PCR primer for ORF amplification
caggagctgcacttccgaggagtgtgatcaatttgtcgat

SEQ ID NO: 12176 - DNA, 40 bp, Artificial Sequence
  PCR primer for ORF amplification
caggagctgcacttccaagaaaatgaatggttcgaaggaa

SEQ ID NO: 12177 - DNA, 40 bp, Artificial Sequence
  PCR primer for ORF amplification
caggagctgcacttccctgtggttgagctttgttagctgc

SEQ ID NO: 12178 - DNA, 40 bp, Artificial Sequence
  PCR primer for ORF amplification
caggagctgcacttccttccttttcataaaccactttatc

SEQ ID NO: 12179 - DNA, 40 bp, Artificial Sequence
  PCR primer for ORF amplification
caggagctgcacttccgttgctacctagaaggatatattt

SEQ ID NO: 12180 - DNA, 40 bp, Artificial Sequence
  PCR primer for ORF amplification
caggagctgcacttccgtggtccaaagccttgatgttcat

SEQ ID NO: 12181 - DNA, 40 bp, Artificial Sequence
  PCR primer for ORF amplification
caggagctgcacttccacttataatacaacagccacccga

SEQ ID NO: 12182 - DNA, 40 bp, Artificial Sequence
  PCR primer for ORF amplification
caggagctgcacttcctgaagtgatgaagaaatcattcaa

SEQ ID NO: 12183 - DNA, 40 bp, Artificial Sequence
  PCR primer for ORF amplification
caggagctgcacttccacgttgaatggcgttgctagacat

SEQ ID NO: 12184 - DNA, 40 bp, Artificial Sequence
  PCR primer for ORF amplification
caggagctgcacttccgttaccaatgagcttatttattag

SEQ ID NO: 12185 - DNA, 40 bp, Artificial Sequence
  PCR primer for ORF amplification
caggagctgcacttccacccagtaacttaacaaagaacca

SEQ ID NO: 12186 - DNA, 40 bp, Artificial Sequence
  PCR primer for ORF amplification
caggagctgcacttcctctcctaaaggtatccaaaaattg

SEQ ID NO: 12187 - DNA, 40 bp, Artificial Sequence
  PCR primer for ORF amplification
caggagctgcacttccctttaatggctttggctttggtgt

SEQ ID NO: 12188 - DNA, 40 bp, Artificial Sequence
  PCR primer for ORF amplification
caggagctgcacttccattcaacttggctaataaagagtc

SEQ ID NO: 12189 - DNA, 40 bp, Artificial Sequence
  PCR primer for ORF amplification
caggagctgcacttcccaaggctttggatacttggttccc

SEQ ID NO: 12190 - DNA, 40 bp, Artificial Sequence
  PCR primer for ORF amplification
caggagctgcacttcctttcttcaagttatgccattcagt

SEQ ID NO: 12191 - DNA, 40 bp, Artificial Sequence
  PCR primer for ORF amplification
caggagctgcacttcctatggacattccctttttttggtt

SEQ ID NO: 12192 - DNA, 40 bp, Artificial Sequence
  PCR primer for ORF amplification
caggagctgcacttcctgcatgtcttgtagaactatttat

SEQ ID NO: 12193 - DNA, 40 bp, Artificial Sequence
  PCR primer for ORF amplification
caggagctgcacttccaaatctcaacttagagaagaacca

SEQ ID NO: 12194 - DNA, 40 bp, Artificial Sequence
  PCR primer for ORF amplification
caggagctgcacttccggctttattatttagtttatgaat

SEQ ID NO: 12195 - DNA, 40 bp, Artificial Sequence
  PCR primer for ORF amplification
caggagctgcacttccaattgcagatgctggtctaagata

SEQ ID NO: 12196 - DNA, 40 bp, Artificial Sequence
  PCR primer for ORF amplification
caggagctgcacttccatgagtttcacttggaatttcgaa

SEQ ID NO: 12197 - DNA, 40 bp, Artificial Sequence
  PCR primer for ORF amplification
caggagctgcacttccggagtatttatctacagctgatgc

SEQ ID NO: 12198 - DNA, 40 bp, Artificial Sequence
  PCR primer for ORF amplification
caggagctgcacttccaataaaatctttacaatcatcgct

SEQ ID NO: 12199 - DNA, 40 bp, Artificial Sequence
  PCR primer for ORF amplification
caggagctgcacttcctagacttggttgtaattcgttaga

SEQ ID NO: 12200 - DNA, 40 bp, Artificial Sequence
  PCR primer for ORF amplification
caggagctgcacttccattatggcctaaaactctcgactc

SEQ ID NO: 12201 - DNA, 40 bp, Artificial Sequence
  PCR primer for ORF amplification
caggagctgcacttccacggtaagatttttggaatctgga

SEQ ID NO: 12202 - DNA, 40 bp, Artificial Sequence
  PCR primer for ORF amplification
caggagctgcacttccaatggtaaccgtagcataaattgt

SEQ ID NO: 12203 - DNA, 40 bp, Artificial Sequence
  PCR primer for ORF amplification
caggagctgcacttccttgattcggttgttgattgatatc

SEQ ID NO: 12204 - DNA, 40 bp, Artificial Sequence
  PCR primer for ORF amplification
caggagctgcacttccccaagtcatcctttgcaatgcttt

SEQ ID NO: 12205 - DNA, 40 bp, Artificial Sequence
  PCR primer for ORF amplification
caggagctgcacttccatagtgatactctgttggtttttg

SEQ ID NO: 12206 - DNA, 40 bp, Artificial Sequence
  PCR primer for ORF amplification
caggagctgcacttccacagtcaattaaatctatagcttg

SEQ ID NO: 12207 - DNA, 40 bp, Artificial Sequence
  PCR primer for ORF amplification
caggagctgcacttccttgcttaaaagcagcaatcgcagc

SEQ ID NO: 12208 - DNA, 40 bp, Artificial Sequence; identical to SEQ ID NO: 10335
  PCR primer for ORF amplification

SEQ ID NO: 12209 - DNA, 40 bp, Artificial Sequence
  PCR primer for ORF amplification
caggagctgcacttcctttgtatggatactttttgaattt

SEQ ID NO: 12210 - DNA, 40 bp, Artificial Sequence
  PCR primer for ORF amplification
caggagctgcacttccattataaataattttgccctgttt

SEQ ID NO: 12211 - DNA, 40 bp, Artificial Sequence
  PCR primer for ORF amplification
caggagctgcacttccattagcagttggagcatattctag

SEQ ID NO: 12212 - DNA, 40 bp, Artificial Sequence
  PCR primer for ORF amplification
caggagctgcacttccaaatccttttcttgccaagtcatc

SEQ ID NO: 12213 - DNA, 40 bp, Artificial Sequence
  PCR primer for ORF amplification
caggagctgcacttccttgttgactaacagggaagatttg

SEQ ID NO: 12214 - DNA, 40 bp, Artificial Sequence
  PCR primer for ORF amplification
caggagctgcacttcctactggagcatgggtgaacaaata

SEQ ID NO: 12215 - DNA, 40 bp, Artificial Sequence
  PCR primer for ORF amplification
caggagctgcacttccaatcgttgggccatcttccttccc

SEQ ID NO: 12216 - DNA, 40 bp, Artificial Sequence
  PCR primer for ORF amplification
caggagctgcacttccagagcattgtacttgaattaattc

SEQ ID NO: 12217 - DNA, 40 bp, Artificial Sequence
  PCR primer for ORF amplification
caggagctgcacttccccaatttcttacagaatcacatac

SEQ ID NO: 12218 - DNA, 40 bp, Artificial Sequence
  PCR primer for ORF amplification
caggagctgcacttccatcactatcactcgattcaccatc

SEQ ID NO: 12219 - DNA, 40 bp, Artificial Sequence
  PCR primer for ORF amplification
caggagctgcacttccggcaatcaaaccatgaggaacgac

SEQ ID NO: 12220 - DNA, 40 bp, Artificial Sequence
  PCR primer for ORF amplification
caggagctgcacttccagcgtcgtcttcgtcattcataga

SEQ ID NO: 12221 - DNA, 40 bp, Artificial Sequence
  PCR primer for ORF amplification
caggagctgcacttccagcagcaaagtgtttcaaaatttg

SEQ ID NO: 12222 - DNA, 40 bp, Artificial Sequence
  PCR primer for ORF amplification
caggagctgcacttccaaatttagcaaattgcttgttggc

SEQ ID NO: 12223 - DNA, 40 bp, Artificial Sequence
  PCR primer for ORF amplification
caggagctgcacttcctttcgaattttgattttgattttg

SEQ ID NO: 12224 - DNA, 40 bp, Artificial Sequence
  PCR primer for ORF amplification
caggagctgcacttcctttaggaacggatttaactataat

SEQ ID NO: 12225 - DNA, 40 bp, Artificial Sequence
  PCR primer for ORF amplification
caggagctgcacttccctcatcatagccaccgccaaaaga

SEQ ID NO: 12226 - DNA, 40 bp, Artificial Sequence
  PCR primer for ORF amplification
caggagctgcacttccaatacctctgttaaaatagacctt

SEQ ID NO: 12227 - DNA, 40 bp, Artificial Sequence
  PCR primer for ORF amplification
caggagctgcacttccgtcagaccttagtctgaaaggagc

SEQ ID NO: 12228 - DNA, 40 bp, Artificial Sequence
  PCR primer for ORF amplification
caggagctgcacttcctttgattctgtctaaattaatttc

SEQ ID NO: 12229 - DNA, 40 bp, Artificial Sequence
  PCR primer for ORF amplification
caggagctgcacttcctatgtatttacaggctaaattata

SEQ ID NO: 12230 - DNA, 40 bp, Artificial Sequence
  PCR primer for ORF amplification
caggagctgcacttccacacctttttttcctgagccaaat

SEQ ID NO: 12231 - DNA, 40 bp, Artificial Sequence
  PCR primer for ORF amplification
caggagctgcacttcctttcttcaaaccgcttctcatgta

SEQ ID NO: 12232 - DNA, 40 bp, Artificial Sequence
  PCR primer for ORF amplification
caggagctgcacttccggcaaaagtggggaatttaccatc

SEQ ID NO: 12233 - DNA, 40 bp, Artificial Sequence
  PCR primer for ORF amplification
caggagctgcacttcctatgccatacttcttgaacagtga

SEQ ID NO: 12234 - DNA, 40 bp, Artificial Sequence; identical to SEQ ID NO: 11694
  PCR primer for ORF amplification

SEQ ID NO: 12235 - DNA, 40 bp, Artificial Sequence
  PCR primer for ORF amplification
caggagctgcacttcccttagcaaatcctatggtaacgtc

SEQ ID NO: 12236 - DNA, 40 bp, Artificial Sequence
  PCR primer for ORF amplification
caggagctgcacttcctacatcccccacagcatctcgcag

SEQ ID NO: 12237 - DNA, 40 bp, Artificial Sequence
  PCR primer for ORF amplification
caggagctgcacttccagtggttggatcaacagaagtagt

SEQ ID NO: 12238 - DNA, 40 bp, Artificial Sequence
  PCR primer for ORF amplification
caggagctgcacttcctactctatgggaataatctttcaa

SEQ ID NO: 12239 - DNA, 40 bp, Artificial Sequence
  PCR primer for ORF amplification
caggagctgcacttcctatattttcggcctttaatttttt

SEQ ID NO: 12240 - DNA, 40 bp, Artificial Sequence
  PCR primer for ORF amplification
caggagctgcacttcctttaacccactctcttggtttggt

SEQ ID NO: 12241 - DNA, 40 bp, Artificial Sequence
  PCR primer for ORF amplification
caggagctgcacttccaagtccagaacatcccactacgtc

SEQ ID NO: 12242 - DNA, 40 bp, Artificial Sequence
  PCR primer for ORF amplification
caggagctgcacttcctgtatcttgcaggtattccataat

SEQ ID NO: 12243 - DNA, 40 bp, Artificial Sequence
  PCR primer for ORF amplification
caggagctgcacttccccactgagccttcataaggatata

SEQ ID NO: 12244 - DNA, 40 bp, Artificial Sequence
  PCR primer for ORF amplification
caggagctgcacttcctaatttttgcatagcagcaatatc

SEQ ID NO: 12245 - DNA, 40 bp, Artificial Sequence
  PCR primer for ORF amplification
caggagctgcacttccttcaaaatccagcgtctcctccgc

SEQ ID NO: 12246 - DNA, 40 bp, Artificial Sequence
  PCR primer for ORF amplification
caggagctgcacttcccggattctttttcaaaatattgac

SEQ ID NO: 12247 - DNA, 40 bp, Artificial Sequence
  PCR primer for ORF amplification
caggagctgcacttccagtggaagccagcttgcgttgtcc

SEQ ID NO: 12248 - DNA, 40 bp, Artificial Sequence
  PCR primer for ORF amplification
caggagctgcacttccagctaatggcataacgttgtcagc

SEQ ID NO: 12249 - DNA, 40 bp, Artificial Sequence
  PCR primer for ORF amplification
caggagctgcacttccttcatcgtacacgtaaaaatctac

SEQ ID NO: 12250 - DNA, 40 bp, Artificial Sequence
  PCR primer for ORF amplification
caggagctgcacttccctcttcccccagaaatctcatgac

SEQ ID NO: 12251 - DNA, 40 bp, Artificial Sequence; identical to SEQ ID NO: 10654
  PCR primer for ORF amplification

SEQ ID NO: 12252 - DNA, 40 bp, Artificial Sequence
  PCR primer for ORF amplification
caggagctgcacttccctgaacgaagttcttcagggtgtc

SEQ ID NO: 12253 - DNA, 40 bp, Artificial Sequence
  PCR primer for ORF amplification
caggagctgcacttccattccttttttttggaggaggtaa

SEQ ID NO: 12254 - DNA, 40 bp, Artificial Sequence
  PCR primer for ORF amplification
caggagctgcacttcctttaaatttggcaaattgatccag

SEQ ID NO: 12255 - DNA, 40 bp, Artificial Sequence
  PCR primer for ORF amplification
caggagctgcacttccttcattcaaagtagcttcctccac

SEQ ID NO: 12256 - DNA, 40 bp, Artificial Sequence
  PCR primer for ORF amplification
caggagctgcacttcccagtttttttttgcagtcgtcgca

SEQ ID NO: 12257 - DNA, 40 bp, Artificial Sequence
  PCR primer for ORF amplification
caggagctgcacttcccgctgctttttctagagaccagaa

SEQ ID NO: 12258 - DNA, 40 bp, Artificial Sequence
  PCR primer for ORF amplification
caggagctgcacttccaatagaatttaacagatccaacgc

SEQ ID NO: 12259 - DNA, 40 bp, Artificial Sequence
  PCR primer for ORF amplification
caggagctgcacttcccaccttgaaacccttagatcttct

SEQ ID NO: 12260 - DNA, 40 bp, Artificial Sequence
  PCR primer for ORF amplification
caggagctgcacttcctatatcgaaaccacggtctcttag

SEQ ID NO: 12261 - DNA, 40 bp, Artificial Sequence
  PCR primer for ORF amplification
caggagctgcacttccgttgaccaaagcggaggcagtggc

SEQ ID NO: 12262 - DNA, 40 bp, Artificial Sequence
  PCR primer for ORF amplification
caggagctgcacttcctaacaaatcatcttcttgttgctg

SEQ ID NO: 12263 - DNA, 40 bp, Artificial Sequence
  PCR primer for ORF amplification
caggagctgcacttccaagtattacacactttgacttctt

SEQ ID NO: 12264 - DNA, 40 bp, Artificial Sequence
  PCR primer for ORF amplification
caggagctgcacttccatatatccttccctctttcatgac

SEQ ID NO: 12265 - DNA, 40 bp, Artificial Sequence
  PCR primer for ORF amplification
caggagctgcacttccagccttggcaacgtgttcaaccaa

SEQ ID NO: 12266 - DNA, 40 bp, Artificial Sequence
  PCR primer for ORF amplification
caggagctgcacttccagcagtatcttcgacagcttgctc

SEQ ID NO: 12267 - DNA, 40 bp, Artificial Sequence
  PCR primer for ORF amplification
caggagctgcacttccaaaaacaattgggtaccctggatt

SEQ ID NO: 12268 - DNA, 40 bp, Artificial Sequence
  PCR primer for ORF amplification
caggagctgcacttccctgcattaataacaatgagtccag

SEQ ID NO: 12269 - DNA, 40 bp, Artificial Sequence
  PCR primer for ORF amplification
caggagctgcacttccgtagaaagtggaaggtctcttgta

SEQ ID NO: 12270 - DNA, 40 bp, Artificial Sequence
  PCR primer for ORF amplification
caggagctgcacttccagccttggcaacatattcgatcaa

SEQ ID NO: 12271 - DNA, 40 bp, Artificial Sequence
  PCR primer for ORF amplification
caggagctgcacttccaaaaaatacagcatcaagatctcc

SEQ ID NO: 12272 - DNA, 40 bp, Artificial Sequence
  PCR primer for ORF amplification
caggagctgcacttcctgttcttcttttcctcaatgggcc

SEQ ID NO: 12273 - DNA, 40 bp, Artificial Sequence
  PCR primer for ORF amplification
caggagctgcacttccttcttcgtcttcggcttcttcagc

SEQ ID NO: 12274 - DNA, 40 bp, Artificial Sequence
  PCR primer for ORF amplification
caggagctgcacttccgttacgtatttttattgaagacgg

SEQ ID NO: 12275 - DNA, 40 bp, Artificial Sequence
  PCR primer for ORF amplification
caggagctgcacttccgagcacgatccacgtggtggcaca

SEQ ID NO: 12276 - DNA, 40 bp, Artificial Sequence
  PCR primer for ORF amplification
caggagctgcacttccgcgtatgcccttcttacggcgtct

SEQ ID NO: 12277 - DNA, 40 bp, Artificial Sequence
  PCR primer for ORF amplification
caggagctgcacttcccaataaggtttcacccaatgcaca

SEQ ID NO: 12278 - DNA, 40 bp, Artificial Sequence
  PCR primer for ORF amplification
caggagctgcacttccagacctggaagagaagcctagtaa

SEQ ID NO: 12279 - DNA, 40 bp, Artificial Sequence
  PCR primer for ORF amplification
caggagctgcacttccttttctgcgtaaagcgtcaaaccg

SEQ ID NO: 12280 - DNA, 40 bp, Artificial Sequence; identical to SEQ ID NO: 12166
  PCR primer for ORF amplification

SEQ ID NO: 12281 - DNA, 40 bp, Artificial Sequence
  PCR primer for ORF amplification
caggagctgcacttcctgcatctttctgaacatctttata

SEQ ID NO: 12282 - DNA, 40 bp, Artificial Sequence
  PCR primer for ORF amplification
caggagctgcacttcccattttttcttcaaccagtttgta

SEQ ID NO: 12283 - DNA, 40 bp, Artificial Sequence
  PCR primer for ORF amplification
caggagctgcacttccttgtggtatttcaagaactagctt

SEQ ID NO: 12284 - DNA, 40 bp, Artificial Sequence
  PCR primer for ORF amplification
caggagctgcacttccatcaaagatttttgcaagcagcgt

SEQ ID NO: 12285 - DNA, 40 bp, Artificial Sequence
  PCR primer for ORF amplification
caggagctgcacttccacatttcttattatctctatatat

SEQ ID NO: 12286 - DNA, 40 bp, Artificial Sequence
  PCR primer for ORF amplification
caggagctgcacttcctaaagtttgtagaacagcctctaa

SEQ ID NO: 12287 - DNA, 40 bp, Artificial Sequence
  PCR primer for ORF amplification
caggagctgcacttcctttgtgataatatctctcatttct

SEQ ID NO: 12288 - DNA, 40 bp, Artificial Sequence
  PCR primer for ORF amplification
caggagctgcacttcctgtagttaggtctccctcacaatc

SEQ ID NO: 12289 - DNA, 40 bp, Artificial Sequence
  PCR primer for ORF amplification
caggagctgcacttcctttactagcaacaaagttgacacc

SEQ ID NO: 12290 - DNA, 40 bp, Artificial Sequence
  PCR primer for ORF amplification
caggagctgcacttccttgaaaaaaagtagttaaatactt

SEQ ID NO: 12291 - DNA, 40 bp, Artificial Sequence
  PCR primer for ORF amplification
caggagctgcacttccgtttgtatatgacagcctacttct

SEQ ID NO: 12292 - DNA, 40 bp, Artificial Sequence
  PCR primer for ORF amplification
caggagctgcacttcctatattggcccaaaagggatcatt

SEQ ID NO: 12293 - DNA, 40 bp, Artificial Sequence
  PCR primer for ORF amplification
caggagctgcacttcccaattcggataagtggtctattat

SEQ ID NO: 12294 - DNA, 40 bp, Artificial Sequence
  PCR primer for ORF amplification
caggagctgcacttccttggttcacggaaagactgttaag

SEQ ID NO: 12295 - DNA, 40 bp, Artificial Sequence
  PCR primer for ORF amplification
caggagctgcacttccttgtgctttttgtactggacttct

SEQ ID NO: 12296 - DNA, 40 bp, Artificial Sequence; identical to SEQ ID NO: 12259
  PCR primer for ORF amplification

SEQ ID NO: 12297 - DNA, 40 bp, Artificial Sequence
  PCR primer for ORF amplification
caggagctgcacttcctatcatttctggatgaggaatacc

SEQ ID NO: 12298 - DNA, 40 bp, Artificial Sequence
  PCR primer for ORF amplification
caggagctgcacttccttgggtaattggacagtttttcaa

SEQ ID NO: 12299 - DNA, 40 bp, Artificial Sequence
  PCR primer for ORF amplification
caggagctgcacttccagcggtaactttcttttcaatcaa

SEQ ID NO: 12300 - DNA, 40 bp, Artificial Sequence
  PCR primer for ORF amplification
caggagctgcacttccatgaggtaggaaacgacctaaata

SEQ ID NO: 12301 - DNA, 40 bp, Artificial Sequence
  PCR primer for ORF amplification
caggagctgcacttcctgctggagtcgtggctcgtttctg

SEQ ID NO: 12302 - DNA, 40 bp, Artificial Sequence
  PCR primer for ORF amplification
caggagctgcacttccatttgcatcgataatttctacaga

SEQ ID NO: 12303 - DNA, 40 bp, Artificial Sequence
  PCR primer for ORF amplification
caggagctgcacttccaataacgtatacgccctctgtgat

SEQ ID NO: 12304 - DNA, 40 bp, Artificial Sequence
  PCR primer for ORF amplification
caggagctgcacttccgtctgaatcagaatctgtgtcttt

SEQ ID NO: 12305 - DNA, 40 bp, Artificial Sequence
  PCR primer for ORF amplification
caggagctgcacttcccatgaggttcatgttcatgttagt

SEQ ID NO: 12306 - DNA, 40 bp, Artificial Sequence
  PCR primer for ORF amplification
caggagctgcacttcctattaaatctgtgagattggccag

SEQ ID NO: 12307 - DNA, 40 bp, Artificial Sequence
  PCR primer for ORF amplification
caggagctgcacttccatagaaaacaaattcagcagatcc

SEQ ID NO: 12308 - DNA, 40 bp, Artificial Sequence
  PCR primer for ORF amplification
caggagctgcacttccccaatagtttggaaataagtatct

SEQ ID NO: 12309 - DNA, 40 bp, Artificial Sequence
  PCR primer for ORF amplification
caggagctgcacttccttgccgcaggaccagaatttcctg

SEQ ID NO: 12310 - DNA, 40 bp, Artificial Sequence
  PCR primer for ORF amplification
caggagctgcacttccgacctcaaaagacaattcaggtag

SEQ ID NO: 12311 - DNA, 40 bp, Artificial Sequence
  PCR primer for ORF amplification
caggagctgcacttcccatgataattggtttagaactgag

SEQ ID NO: 12312 - DNA, 40 bp, Artificial Sequence
  PCR primer for ORF amplification
caggagctgcacttccgagggtaataccaaaattgttcaa

SEQ ID NO: 12313 - DNA, 40 bp, Artificial Sequence
  PCR primer for ORF amplification
caggagctgcacttcctaatacgtatagagtgaggagaca

SEQ ID NO: 12314 - DNA, 40 bp, Artificial Sequence
  PCR primer for ORF amplification
caggagctgcacttcctttacgtaaaggttgggcttgttg

SEQ ID NO: 12315 - DNA, 40 bp, Artificial Sequence
  PCR primer for ORF amplification
caggagctgcacttccaccgaaaagtttggcgaacacttc

SEQ ID NO: 12316 - DNA, 40 bp, Artificial Sequence
  PCR primer for ORF amplification
caggagctgcacttcctaagaataacatagcaacaccagc

SEQ ID NO: 12317 - DNA, 40 bp, Artificial Sequence
  PCR primer for ORF amplification
caggagctgcacttccggccaaagacatcttagccagctc

SEQ ID NO: 12318 - DNA, 40 bp, Artificial Sequence
  PCR primer for ORF amplification
caggagctgcacttccccgccaaataggtctatcactctt

SEQ ID NO: 12319 - DNA, 40 bp, Artificial Sequence
  PCR primer for ORF amplification
caggagctgcacttcctaggagcaggttgggtatactggt

SEQ ID NO: 12320 - DNA, 40 bp, Artificial Sequence
  PCR primer for ORF amplification
caggagctgcacttccattggagaatgaactcgctagtga

SEQ ID NO: 12321 - DNA, 40 bp, Artificial Sequence
  PCR primer for ORF amplification
caggagctgcacttccttgtactagatgtggtaaatctcc

SEQ ID NO: 12322 - DNA, 40 bp, Artificial Sequence
  PCR primer for ORF amplification
caggagctgcacttccgcctcttatatatgtcgcatcaat

SEQ ID NO: 12323 - DNA, 40 bp, Artificial Sequence
  PCR primer for ORF amplification
caggagctgcacttcctggtttcgtcaccttctttttggc

SEQ ID NO: 12324 - DNA, 40 bp, Artificial Sequence
  PCR primer for ORF amplification
caggagctgcacttccgtcatctatcagcaaatattcatc

SEQ ID NO: 12325 - DNA, 40 bp, Artificial Sequence
  PCR primer for ORF amplification
caggagctgcacttcctttcaagtccttgaaattaccttt

SEQ ID NO: 12326 - DNA, 40 bp, Artificial Sequence
  PCR primer for ORF amplification
caggagctgcacttcctcctatagtaacataacctgaagc

SEQ ID NO: 12327 - DNA, 40 bp, Artificial Sequence
  PCR primer for ORF amplification
caggagctgcacttccatttttcttgttctttcgttggat

SEQ ID NO: 12328 - DNA, 40 bp, Artificial Sequence
  PCR primer for ORF amplification
caggagctgcacttccagctgttgtttgttggggaagaga

SEQ ID NO: 12329 - DNA, 40 bp, Artificial Sequence
  PCR primer for ORF amplification
caggagctgcacttccttgtttcgtgatcttgtagatccg

SEQ ID NO: 12330 - DNA, 40 bp, Artificial Sequence
  PCR primer for ORF amplification
caggagctgcacttccatcctcatcagaggagaggtaatc

SEQ ID NO: 12331 - DNA, 40 bp, Artificial Sequence
  PCR primer for ORF amplification
caggagctgcacttccgcctgcaaaggaacttgctagtga

SEQ ID NO: 12332 - DNA, 40 bp, Artificial Sequence
  PCR primer for ORF amplification
caggagctgcacttccttcaaacttcgttttgaaaaactt

SEQ ID NO: 12333 - DNA, 40 bp, Artificial Sequence
  PCR primer for ORF amplification
caggagctgcacttcccgcagattttgccttcggtatatt

SEQ ID NO: 12334 - DNA, 40 bp, Artificial Sequence
  PCR primer for ORF amplification
caggagctgcacttcctttttcctctttttcggtggattc

SEQ ID NO: 12335 - DNA, 40 bp, Artificial Sequence
  PCR primer for ORF amplification
caggagctgcacttcctgaagcgtggtggtagtactctgc

SEQ ID NO: 12336 - DNA, 40 bp, Artificial Sequence
  PCR primer for ORF amplification
caggagctgcacttccagctggaagagccaatctcttgaa

SEQ ID NO: 12337 - DNA, 40 bp, Artificial Sequence
  PCR primer for ORF amplification
caggagctgcacttcccatgaaacttaaacacgatacatg

SEQ ID NO: 12338 - DNA, 40 bp, Artificial Sequence
  PCR primer for ORF amplification
caggagctgcacttccattgactaaaacccaaataacgaa

SEQ ID NO: 12339 - DNA, 40 bp, Artificial Sequence
  PCR primer for ORF amplification
caggagctgcacttcctttagagtaagatattttttcgga

SEQ ID NO: 12340 - DNA, 40 bp, Artificial Sequence
  PCR primer for ORF amplification
caggagctgcacttcctccaatcgttgacattttgtctgc

SEQ ID NO: 12341 - DNA, 40 bp, Artificial Sequence
  PCR primer for ORF amplification
caggagctgcacttccccaaagcgagcggcactccagcag

SEQ ID NO: 12342 - DNA, 40 bp, Artificial Sequence
  PCR primer for ORF amplification
caggagctgcacttccgccaccccatgaaaatcccaattg

SEQ ID NO: 12343 - DNA, 40 bp, Artificial Sequence
  PCR primer for ORF amplification
caggagctgcacttcctattttcttctttggttgtaatgg

SEQ ID NO: 12344 - DNA, 40 bp, Artificial Sequence
  PCR primer for ORF amplification
caggagctgcacttcctacgttggctttaacagtttcgtt

SEQ ID NO: 12345 - DNA, 40 bp, Artificial Sequence
  PCR primer for ORF amplification
caggagctgcacttcccagctcagattccagagtgtcggg

SEQ ID NO: 12346 - DNA, 40 bp, Artificial Sequence
  PCR primer for ORF amplification
caggagctgcacttccgatgttttcagaaccggaggtatg

SEQ ID NO: 12347 - DNA, 40 bp, Artificial Sequence
  PCR primer for ORF amplification
caggagctgcacttccttctatcaagtctttttgaccata

SEQ ID NO: 12348 - DNA, 40 bp, Artificial Sequence
  PCR primer for ORF amplification
caggagctgcacttccttccttaccgtcgagcagttgatc

SEQ ID NO: 12349 - DNA, 40 bp, Artificial Sequence
  PCR primer for ORF amplification
caggagctgcacttcctgggatggagtcttcgacctgtcc

SEQ ID NO: 12350 - DNA, 40 bp, Artificial Sequence
  PCR primer for ORF amplification
caggagctgcacttcccacatcgtcctcaatactattttt

SEQ ID NO: 12351 - DNA, 40 bp, Artificial Sequence
  PCR primer for ORF amplification
caggagctgcacttccacagttgagcaaatcgatagcttg

SEQ ID NO: 12352 - DNA, 40 bp, Artificial Sequence
  PCR primer for ORF amplification
caggagctgcacttccgttctcatagtcaaatattatgta

SEQ ID NO: 12353 - DNA, 40 bp, Artificial Sequence
  PCR primer for ORF amplification
caggagctgcacttccttgtgagtcggaggggctgtttgt

SEQ ID NO: 12354 - DNA, 40 bp, Artificial Sequence
  PCR primer for ORF amplification
caggagctgcacttccacttgcccaacgctgaaacatggt

SEQ ID NO: 12355 - DNA, 40 bp, Artificial Sequence
  PCR primer for ORF amplification
caggagctgcacttcccaccgcaaaacgatatcgagtctt

SEQ ID NO: 12356 - DNA, 40 bp, Artificial Sequence
  PCR primer for ORF amplification
caggagctgcacttccaaattccattattgggccagaacc

SEQ ID NO: 12357 - DNA, 40 bp, Artificial Sequence
  PCR primer for ORF amplification
caggagctgcacttccaccagagtgctctgtttgatacat

SEQ ID NO: 12358 - DNA, 40 bp, Artificial Sequence
  PCR primer for ORF amplification
caggagctgcacttccattcaaggtggggaatggtaacct

SEQ ID NO: 12359 - DNA, 40 bp, Artificial Sequence
  PCR primer for ORF amplification
caggagctgcacttccttgttgtttgcaaccgtcggttaa

SEQ ID NO: 12360 - DNA, 40 bp, Artificial Sequence
  PCR primer for ORF amplification
caggagctgcacttccctcttgggcacttaggtaccgttc

SEQ ID NO: 12361 - DNA, 40 bp, Artificial Sequence
  PCR primer for ORF amplification
caggagctgcacttccatcctcgtgccgctccacaaaatc

SEQ ID NO: 12362 - DNA, 40 bp, Artificial Sequence
  PCR primer for ORF amplification
caggagctgcacttccagggtttaccatacgctcttccaa

SEQ ID NO: 12363 - DNA, 40 bp, Artificial Sequence
  PCR primer for ORF amplification
caggagctgcacttccgttttcttcatctaaccagtctag

SEQ ID NO: 12364 - DNA, 40 bp, Artificial Sequence
  PCR primer for ORF amplification
caggagctgcacttccgtagacaatctttctaccggtgaa

SEQ ID NO: 12365 - DNA, 40 bp, Artificial Sequence
  PCR primer for ORF amplification
caggagctgcacttcccttaatatccttaatgcttccgtc

SEQ ID NO: 12366 - DNA, 40 bp, Artificial Sequence
  PCR primer for ORF amplification
caggagctgcacttccgttttttattctcacctttccaaa

SEQ ID NO: 12367 - DNA, 40 bp, Artificial Sequence
  PCR primer for ORF amplification
caggagctgcacttccacatctttgcctctggggtttgta

SEQ ID NO: 12368 - DNA, 40 bp, Artificial Sequence
  PCR primer for ORF amplification
caggagctgcacttccaatatcgaatttgtactgagtctt

SEQ ID NO: 12369 - DNA, 40 bp, Artificial Sequence
  PCR primer for ORF amplification
caggagctgcacttcctattctgccctcaaattttaaaat

SEQ ID NO: 12370 - DNA, 40 bp, Artificial Sequence
  PCR primer for ORF amplification
caggagctgcacttccatgacgaattacacttctataact

SEQ ID NO: 12371 - DNA, 40 bp, Artificial Sequence
  PCR primer for ORF amplification
caggagctgcacttcctttacttttctttatcgccccctt

SEQ ID NO: 12372 - DNA, 40 bp, Artificial Sequence
  PCR primer for ORF amplification
caggagctgcacttcccctatccctcaactccatcactaa

SEQ ID NO: 12373 - DNA, 40 bp, Artificial Sequence
  PCR primer for ORF amplification
caggagctgcacttccttcatctcctgtaaccgaaactga

SEQ ID NO: 12374 - DNA, 40 bp, Artificial Sequence
  PCR primer for ORF amplification
caggagctgcacttccgtacccccaaactcttattctttt

SEQ ID NO: 12375 - DNA, 40 bp, Artificial Sequence
  PCR primer for ORF amplification
caggagctgcacttcctctgaaggggggccttgtatttat

SEQ ID NO: 12376 - DNA, 40 bp, Artificial Sequence
  PCR primer for ORF amplification
caggagctgcacttccatggtatttatagccgcattgttt

SEQ ID NO: 12377 - DNA, 40 bp, Artificial Sequence
  PCR primer for ORF amplification
caggagctgcacttcctagcttggaagagtctaggatgaa

SEQ ID NO: 12378 - DNA, 40 bp, Artificial Sequence
  PCR primer for ORF amplification
caggagctgcacttccaaatgaattggcatggtctaaaaa

SEQ ID NO: 12379 - DNA, 40 bp, Artificial Sequence
  PCR primer for ORF amplification
caggagctgcacttccaacatcgagaagacctttcgattc

SEQ ID NO: 12380 - DNA, 40 bp, Artificial Sequence
  PCR primer for ORF amplification
caggagctgcacttccatttcccttgattatattcaaaag

SEQ ID NO: 12381 - DNA, 40 bp, Artificial Sequence
  PCR primer for ORF amplification
caggagctgcacttccaaaagtttcctcgtcgatgatcaa

SEQ ID NO: 12382 - DNA, 40 bp, Artificial Sequence
  PCR primer for ORF amplification
caggagctgcacttcctccaggatccttgaaagatttcac

SEQ ID NO: 12383 - DNA, 40 bp, Artificial Sequence
  PCR primer for ORF amplification
caggagctgcacttcctttcttctgtcttttagcagaggg

SEQ ID NO: 12384 - DNA, 40 bp, Artificial Sequence
  PCR primer for ORF amplification
caggagctgcacttccgcctaccacgtaccatcggtcatg

SEQ ID NO: 12385 - DNA, 40 bp, Artificial Sequence
  PCR primer for ORF amplification
caggagctgcacttcctcttcttttccccaaggtaccact

SEQ ID NO: 12386 - DNA, 40 bp, Artificial Sequence
  PCR primer for ORF amplification
caggagctgcacttcctatatatatatatagtgtgcgttc

SEQ ID NO: 12387 - DNA, 40 bp, Artificial Sequence
  PCR primer for ORF amplification
caggagctgcacttcctaatctgttctgcttcttcaaaat

SEQ ID NO: 12388 - DNA, 40 bp, Artificial Sequence
  PCR primer for ORF amplification
caggagctgcacttccctcagagtcggtggctacatcctc

SEQ ID NO: 12389 - DNA, 40 bp, Artificial Sequence
  PCR primer for ORF amplification
caggagctgcacttccatactttaaattgtccaagtttgg

SEQ ID NO: 12390 - DNA, 40 bp, Artificial Sequence
  PCR primer for ORF amplification
caggagctgcacttcctttatatttaccaagtttttcagt

SEQ ID NO: 12391 - DNA, 40 bp, Artificial Sequence
  PCR primer for ORF amplification
caggagctgcacttccagctttcctggaagagaccttggt

SEQ ID NO: 12392 - DNA, 40 bp, Artificial Sequence
  PCR primer for ORF amplification
caggagctgcacttcctattgccagcgtcgatgttgatga

SEQ ID NO: 12393 - DNA, 40 bp, Artificial Sequence
  PCR primer for ORF amplification
caggagctgcacttcctatatataccatttggcccagttt

SEQ ID NO: 12394 - DNA, 40 bp, Artificial Sequence
  PCR primer for ORF amplification
caggagctgcacttcctttcttttcaacgcccggtaagtt

SEQ ID NO: 12395 - DNA, 40 bp, Artificial Sequence
  PCR primer for ORF amplification
caggagctgcacttcctgcgagcgtggcggagttggcttt

SEQ ID NO: 12396 - DNA, 40 bp, Artificial Sequence
  PCR primer for ORF amplification
caggagctgcacttccgaagtcatcatcaaagttaatttc

SEQ ID NO: 12397 - DNA, 40 bp, Artificial Sequence
  PCR primer for ORF amplification
caggagctgcacttccataaacggaaatataattgttgat

SEQ ID NO: 12398 - DNA, 40 bp, Artificial Sequence
  PCR primer for ORF amplification
caggagctgcacttccacatctagcatatatctgcaataa

SEQ ID NO: 12399 - DNA, 40 bp, Artificial Sequence
  PCR primer for ORF amplification
caggagctgcacttccgttcttaagaggtatcttattttt

SEQ ID NO: 12400 - DNA, 40 bp, Artificial Sequence
  PCR primer for ORF amplification
caggagctgcacttcctaatagcatatccattcttgaaaa

SEQ ID NO: 12401 - DNA, 40 bp, Artificial Sequence
  PCR primer for ORF amplification
caggagctgcacttcccgccatttcgtatctgtcaccaac

SEQ ID NO: 12402 - DNA, 40 bp, Artificial Sequence
  PCR primer for ORF amplification
caggagctgcacttcccattgagaaaaaacttttataata

SEQ ID NO: 12403 - DNA, 40 bp, Artificial Sequence
  PCR primer for ORF amplification
caggagctgcacttccttgcgtggacccataattcaccct

SEQ ID NO: 12404 - DNA, 40 bp, Artificial Sequence
  PCR primer for ORF amplification
caggagctgcacttccatgctcatccatgagcgccataac

SEQ ID NO: 12405 - DNA, 40 bp, Artificial Sequence
  PCR primer for ORF amplification
caggagctgcacttccgcgacgggatttctttttgccatt

SEQ ID NO: 12406 - DNA, 40 bp, Artificial Sequence
  PCR primer for ORF amplification
caggagctgcacttcctctgaacatggatccctgcccttc

SEQ ID NO: 12407 - DNA, 40 bp, Artificial Sequence
  PCR primer for ORF amplification
caggagctgcacttccacctacataatctaggaacaatat

SEQ ID NO: 12408 - DNA, 40 bp, Artificial Sequence
  PCR primer for ORF amplification
caggagctgcacttccctcgctgatgcccttgcgcttggc

SEQ ID NO: 12409 - DNA, 40 bp, Artificial Sequence
  PCR primer for ORF amplification
caggagctgcacttccgagtcttccaccgggggtgacatt

SEQ ID NO: 12410 - DNA, 40 bp, Artificial Sequence
  PCR primer for ORF amplification
caggagctgcacttccttgttctaaaacctttgcccactg

SEQ ID NO: 12411 - DNA, 40 bp, Artificial Sequence
  PCR primer for ORF amplification
caggagctgcacttccttgcttgttctcattgtctggtgt

SEQ ID NO: 12412 - DNA, 40 bp, Artificial Sequence
  PCR primer for ORF amplification
caggagctgcacttccaaaccacctaccagcagcctgaag

SEQ ID NO: 12413 - DNA, 40 bp, Artificial Sequence
  PCR primer for ORF amplification
caggagctgcacttcctaaaccttgttgagctcttcttct

SEQ ID NO: 12414 - DNA, 40 bp, Artificial Sequence
  PCR primer for ORF amplification
caggagctgcacttccaatgggggttctagtttcaacaat

SEQ ID NO: 12415 - DNA, 40 bp, Artificial Sequence
  PCR primer for ORF amplification
caggagctgcacttccgccttctgtttgttctcttcttaa

SEQ ID NO: 12416 - DNA, 40 bp, Artificial Sequence
  PCR primer for ORF amplification
caggagctgcacttccattagcttcttgcatgtgctcttt

SEQ ID NO: 12417 - DNA, 40 bp, Artificial Sequence
  PCR primer for ORF amplification
caggagctgcacttcccctttttcttctgtgttgaggttt

SEQ ID NO: 12418 - DNA, 40 bp, Artificial Sequence
  PCR primer for ORF amplification
caggagctgcacttcctacaaactcgtcaacatttaaatt

SEQ ID NO: 12419 - DNA, 40 bp, Artificial Sequence
  PCR primer for ORF amplification
caggagctgcacttccggcttcattttgaacttctaacat

SEQ ID NO: 12420 - DNA, 40 bp, Artificial Sequence
  PCR primer for ORF amplification
caggagctgcacttccttcctttttaacctgtcttgcggc

SEQ ID NO: 12421 - DNA, 40 bp, Artificial Sequence
  PCR primer for ORF amplification
caggagctgcacttcccctaacaaaatccattccttgttt

SEQ ID NO: 12422 - DNA, 40 bp, Artificial Sequence
  PCR primer for ORF amplification
caggagctgcacttccaaactcaaaaagtggcatgtctaa

SEQ ID NO: 12423 - DNA, 40 bp, Artificial Sequence
  PCR primer for ORF amplification
caggagctgcacttccgattagtgatgtatagctaatggt

SEQ ID NO: 12424 - DNA, 40 bp, Artificial Sequence
  PCR primer for ORF amplification
caggagctgcacttccatgcgaatatttagtgactacttc

SEQ ID NO: 12425 - DNA, 40 bp, Artificial Sequence
  PCR primer for ORF amplification
caggagctgcacttccgtaaccgaaagaagccaattgctt

SEQ ID NO: 12426 - DNA, 40 bp, Artificial Sequence
  PCR primer for ORF amplification
caggagctgcacttccgcttttactttgaacttctagtaa

SEQ ID NO: 12427 - DNA, 40 bp, Artificial Sequence
  PCR primer for ORF amplification
caggagctgcacttccatgcattaaataagaaccttcgtt

SEQ ID NO: 12428 - DNA, 40 bp, Artificial Sequence
  PCR primer for ORF amplification
caggagctgcacttccctgtgacttgccaatatggtctaa

SEQ ID NO: 12429 - DNA, 40 bp, Artificial Sequence
  PCR primer for ORF amplification
caggagctgcacttcctcgtctagatgctcctttcttcgc

SEQ ID NO: 12430 - DNA, 40 bp, Artificial Sequence
  PCR primer for ORF amplification
caggagctgcacttcccaagtcatctgaaatgctgtccaa

SEQ ID NO: 12431 - DNA, 40 bp, Artificial Sequence
  PCR primer for ORF amplification
caggagctgcacttcctttagaagtgtcaacaacgtatct

SEQ ID NO: 12432 - DNA, 40 bp, Artificial Sequence; identical to SEQ ID NO: 12431
  PCR primer for ORF amplification

SEQ ID NO: 12433 - DNA, 40 bp, Artificial Sequence
  PCR primer for ORF amplification
caggagctgcacttcctttctctttctttacttcattttc

SEQ ID NO: 12434 - DNA, 40 bp, Artificial Sequence
  PCR primer for ORF amplification
caggagctgcacttccgaacttggctcgaatgtctcgttc

SEQ ID NO: 12435 - DNA, 40 bp, Artificial Sequence
  PCR primer for ORF amplification
caggagctgcacttccttgttgggcagtaattactgacat

SEQ ID NO: 12436 - DNA, 40 bp, Artificial Sequence
  PCR primer for ORF amplification
caggagctgcacttccattgatttctgcttgtaatgcttg

SEQ ID NO: 12437 - DNA, 40 bp, Artificial Sequence
  PCR primer for ORF amplification
caggagctgcacttcccaaaccttcgtccatccaggccaa

SEQ ID NO: 12438 - DNA, 40 bp, Artificial Sequence
  PCR primer for ORF amplification
caggagctgcacttcctggctgctcaattttaacgtagtc

SEQ ID NO: 12439 - DNA, 40 bp, Artificial Sequence
  PCR primer for ORF amplification
caggagctgcacttccaaattcaacgttggaaggaggttg

SEQ ID NO: 12440 - DNA, 40 bp, Artificial Sequence
  PCR primer for ORF amplification
caggagctgcacttccctcgtccgggaggcagcaatctat

SEQ ID NO: 12441 - DNA, 40 bp, Artificial Sequence
  PCR primer for ORF amplification
caggagctgcacttcctttgaatggtgccgataaccttag

SEQ ID NO: 12442 - DNA, 40 bp, Artificial Sequence
  PCR primer for ORF amplification
caggagctgcacttcccttacgtttaaaaaatccatcaat

SEQ ID NO: 12443 - DNA, 40 bp, Artificial Sequence
  PCR primer for ORF amplification
caggagctgcacttccaactaatggcttagattcattggg

SEQ ID NO: 12444 - DNA, 40 bp, Artificial Sequence
  PCR primer for ORF amplification
caggagctgcacttccttttgcctttcttttgaaaaagct

SEQ ID NO: 12445 - DNA, 40 bp, Artificial Sequence
  PCR primer for ORF amplification
caggagctgcacttccaatgaccatatcaacaggatattt

SEQ ID NO: 12446 - DNA, 40 bp, Artificial Sequence
  PCR primer for ORF amplification
caggagctgcacttcctaatacggcaccaaagccgaatgt

SEQ ID NO: 12447 - DNA, 40 bp, Artificial Sequence
  PCR primer for ORF amplification
caggagctgcacttcctttaaaaccgttcacaatcttggg

SEQ ID NO: 12448 - DNA, 40 bp, Artificial Sequence
  PCR primer for ORF amplification
caggagctgcacttcccaaaccttgttgagctcttcttct

SEQ ID NO: 12449 - DNA, 40 bp, Artificial Sequence
  PCR primer for ORF amplification
caggagctgcacttccagcctcatgtggattatcgctcct

SEQ ID NO: 12450 - DNA, 40 bp, Artificial Sequence
  PCR primer for ORF amplification
caggagctgcacttcctgtgggaggaggatgttttggtgt

SEQ ID NO: 12451 - DNA, 40 bp, Artificial Sequence
  PCR primer for ORF amplification
caggagctgcacttcctctattccttttcctactatcttg

SEQ ID NO: 12452 - DNA, 40 bp, Artificial Sequence
  PCR primer for ORF amplification
caggagctgcacttcccttatatgtacttaactgtttgct

SEQ ID NO: 12453 - DNA, 40 bp, Artificial Sequence
  PCR primer for ORF amplification
caggagctgcacttccaagccgtgctttgtccagcaactt

SEQ ID NO: 12454 - DNA, 40 bp, Artificial Sequence
  PCR primer for ORF amplification
caggagctgcacttcctttagaagtctcaacaacatatct

SEQ ID NO: 12455 - DNA, 40 bp, Artificial Sequence
  PCR primer for ORF amplification
caggagctgcacttcccacggtactgctttccgattttac

SEQ ID NO: 12456 - DNA, 40 bp, Artificial Sequence
  PCR primer for ORF amplification
caggagctgcacttccacaattcagaatctcatctgtaaa

SEQ ID NO: 12457 - DNA, 40 bp, Artificial Sequence
  PCR primer for ORF amplification
caggagctgcacttcctgcgtacttttctaacgttttagt

SEQ ID NO: 12458 - DNA, 40 bp, Artificial Sequence
  PCR primer for ORF amplification
caggagctgcacttcctatgtatttatgtttgtatttctg

SEQ ID NO: 12459 - DNA, 40 bp, Artificial Sequence
  PCR primer for ORF amplification
caggagctgcacttcctttgcttctcttgtaaactttgtt

SEQ ID NO: 12460 - DNA, 40 bp, Artificial Sequence
  PCR primer for ORF amplification
caggagctgcacttccaaaattttcatctatagcacgttt

SEQ ID NO: 12461 - DNA, 40 bp, Artificial Sequence
  PCR primer for ORF amplification
caggagctgcacttccgaaatcgtcccatttgtcctcgtc

SEQ ID NO: 12462 - DNA, 40 bp, Artificial Sequence
  PCR primer for ORF amplification
caggagctgcacttccatcctccaaatcatctaattcaaa

SEQ ID NO: 12463 - DNA, 40 bp, Artificial Sequence
  PCR primer for ORF amplification
caggagctgcacttccaaagtaacccccataatctagtga

SEQ ID NO: 12464 - DNA, 40 bp, Artificial Sequence
  PCR primer for ORF amplification
caggagctgcacttcctacgactacttgaatagattcgtt

SEQ ID NO: 12465 - DNA, 40 bp, Artificial Sequence
  PCR primer for ORF amplification
caggagctgcacttccactaaatatttcgttccaaatgag

SEQ ID NO: 12466 - DNA, 40 bp, Artificial Sequence
  PCR primer for ORF amplification
caggagctgcacttccgtttttgaaagaattgagatcgac

SEQ ID NO: 12467 - DNA, 40 bp, Artificial Sequence
  PCR primer for ORF amplification
caggagctgcacttccacccaaattggtattgaacccaga

SEQ ID NO: 12468 - DNA, 40 bp, Artificial Sequence
  PCR primer for ORF amplification
caggagctgcacttccgtcgttgcggatatggacgatatt

SEQ ID NO: 12469 - DNA, 40 bp, Artificial Sequence
  PCR primer for ORF amplification
caggagctgcacttcccaaacctcttcttaaaatttcctc

SEQ ID NO: 12470 - DNA, 40 bp, Artificial Sequence
  PCR primer for ORF amplification
caggagctgcacttccaaatgatattttgccatttttatg

SEQ ID NO: 12471 - DNA, 40 bp, Artificial Sequence
  PCR primer for ORF amplification
caggagctgcacttccgtcattgttgtaagtgttctgcaa

SEQ ID NO: 12472 - DNA, 40 bp, Artificial Sequence
  PCR primer for ORF amplification
caggagctgcacttccgagttgggatattttaaccaataa

SEQ ID NO: 12473 - DNA, 40 bp, Artificial Sequence
  PCR primer for ORF amplification
caggagctgcacttccagccttcaaagaagaagctcttct

SEQ ID NO: 12474 - DNA, 40 bp, Artificial Sequence
  PCR primer for ORF amplification
caggagctgcacttcctgggaaaatgctttccagagcgga

SEQ ID NO: 12475 - DNA, 40 bp, Artificial Sequence
  PCR primer for ORF amplification
caggagctgcacttccttcaccacgcaatgccttgatgac

SEQ ID NO: 12476 - DNA, 40 bp, Artificial Sequence
  PCR primer for ORF amplification
caggagctgcacttccattgctttttgttataacttggac

SEQ ID NO: 12477 - DNA, 40 bp, Artificial Sequence
  PCR primer for ORF amplification
caggagctgcacttccttccttatcttctaactcataaat

SEQ ID NO: 12478 - DNA, 40 bp, Artificial Sequence
  PCR primer for ORF amplification
caggagctgcacttccaattttgttatgatcaccgaaagg

SEQ ID NO: 12479 - DNA, 40 bp, Artificial Sequence
  PCR primer for ORF amplification
caggagctgcacttccattataaaatgcatcatagaaatc

SEQ ID NO: 12480 - DNA, 40 bp, Artificial Sequence
  PCR primer for ORF amplification
caggagctgcacttccaagtttagccttctttttagagga

SEQ ID NO: 12481 - DNA, 40 bp, Artificial Sequence
  PCR primer for ORF amplification
caggagctgcacttccatctagacagcacataacttttgc

SEQ ID NO: 12482 - DNA, 40 bp, Artificial Sequence
  PCR primer for ORF amplification
caggagctgcacttcctggcctttggtaatagagaccgcc

SEQ ID NO: 12483 - DNA, 40 bp, Artificial Sequence
  PCR primer for ORF amplification
caggagctgcacttcctttaggccttagactttctatgaa

SEQ ID NO: 12484 - DNA, 40 bp, Artificial Sequence
  PCR primer for ORF amplification
caggagctgcacttccgaatttcataaaaatatctagcaa

SEQ ID NO: 12485 - DNA, 40 bp, Artificial Sequence
  PCR primer for ORF amplification
caggagctgcacttccagttttggcagtgacggtgactgt

SEQ ID NO: 12486 - DNA, 40 bp, Artificial Sequence
  PCR primer for ORF amplification
caggagctgcacttccaaacaattcattgaattttatctc

SEQ ID NO: 12487 - DNA, 40 bp, Artificial Sequence
  PCR primer for ORF amplification
caggagctgcacttccttccgggccctcaatgatcgtctt

SEQ ID NO: 12488 - DNA, 40 bp, Artificial Sequence
  PCR primer for ORF amplification
caggagctgcacttcccttatgctgctccaggagatgtag

SEQ ID NO: 12489 - DNA, 40 bp, Artificial Sequence
  PCR primer for ORF amplification
caggagctgcacttcctttcatcgaaaaggcttccggagc

SEQ ID NO: 12490 - DNA, 40 bp, Artificial Sequence
  PCR primer for ORF amplification
caggagctgcacttcctaatctagaaatgtcaggctttgg

SEQ ID NO: 12491 - DNA, 40 bp, Artificial Sequence
  PCR primer for ORF amplification
caggagctgcacttccgaactgaattatttcacattgtct

SEQ ID NO: 12492 - DNA, 40 bp, Artificial Sequence
  PCR primer for ORF amplification
caggagctgcacttccctcgtccacaagagtggcagtttt

SEQ ID NO: 12493 - DNA, 40 bp, Artificial Sequence
  PCR primer for ORF amplification
caggagctgcacttcccatttcattcattttttttctctg

SEQ ID NO: 12494 - DNA, 40 bp, Artificial Sequence
  PCR primer for ORF amplification
caggagctgcacttccttcaggaccaaagataatagtctt

SEQ ID NO: 12495 - DNA, 40 bp, Artificial Sequence
  PCR primer for ORF amplification
caggagctgcacttccaatgccaaaattccatttcattct

SEQ ID NO: 12496 - DNA, 40 bp, Artificial Sequence
  PCR primer for ORF amplification
caggagctgcacttcctttcaaaggttcattacttagtat

SEQ ID NO: 12497 - DNA, 40 bp, Artificial Sequence
  PCR primer for ORF amplification
caggagctgcacttccgtacaattgtctattaccccaata

SEQ ID NO: 12498 - DNA, 40 bp, Artificial Sequence
  PCR primer for ORF amplification
caggagctgcacttccgccgccgaacctgcataatgaaat

SEQ ID NO: 12499 - DNA, 40 bp, Artificial Sequence
  PCR primer for ORF amplification
caggagctgcacttccggcgtttcttgactgaatgacatc

SEQ ID NO: 12500 - DNA, 40 bp, Artificial Sequence
  PCR primer for ORF amplification
caggagctgcacttcccacgggcggcacgactttacttag

SEQ ID NO: 12501 - DNA, 40 bp, Artificial Sequence
  PCR primer for ORF amplification
caggagctgcacttccttgctgttcgacgctagcaccatc

SEQ ID NO: 12502 - DNA, 40 bp, Artificial Sequence
  PCR primer for ORF amplification
caggagctgcacttcccagtctcctttgagctctatccca

SEQ ID NO: 12503 - DNA, 40 bp, Artificial Sequence
  PCR primer for ORF amplification
caggagctgcacttccttctttagcggctttttgtgaaga

SEQ ID NO: 12504 - DNA, 40 bp, Artificial Sequence
  PCR primer for ORF amplification
caggagctgcacttcctgctatatgtgcgacagcggttgg

SEQ ID NO: 12505 - DNA, 40 bp, Artificial Sequence
  PCR primer for ORF amplification
caggagctgcacttccagcgtcttccttcaataaagcatc

SEQ ID NO: 12506 - DNA, 40 bp, Artificial Sequence
  PCR primer for ORF amplification
caggagctgcacttccgtggagaggttgtcgctttgtaga

SEQ ID NO: 12507 - DNA, 40 bp, Artificial Sequence
  PCR primer for ORF amplification
caggagctgcacttcccgttcgaagatgtttggaaaggag

SEQ ID NO: 12508 - DNA, 40 bp, Artificial Sequence
  PCR primer for ORF amplification
caggagctgcacttccatcaaaaggtattggtttatgatg

SEQ ID NO: 12509 - DNA, 40 bp, Artificial Sequence
  PCR primer for ORF amplification
caggagctgcacttccaagtctttgagcaatcttgataac

SEQ ID NO: 12510 - DNA, 40 bp, Artificial Sequence
  PCR primer for ORF amplification
caggagctgcacttcctattttctgtattttttcaaagct

SEQ ID NO: 12511 - DNA, 40 bp, Artificial Sequence
  PCR primer for ORF amplification
caggagctgcacttcctaaagtgttagtggtacggaaagt

SEQ ID NO: 12512 - DNA, 40 bp, Artificial Sequence
  PCR primer for ORF amplification
caggagctgcacttccgttgccgttacctctcattttttc

SEQ ID NO: 12513 - DNA, 40 bp, Artificial Sequence
  PCR primer for ORF amplification
caggagctgcacttccaaagctgagtttctcaagagctct

SEQ ID NO: 12514 - DNA, 40 bp, Artificial Sequence
  PCR primer for ORF amplification
caggagctgcacttccagggtcctttgattctgactctaa

SEQ ID NO: 12515 - DNA, 40 bp, Artificial Sequence
  PCR primer for ORF amplification
caggagctgcacttccatctttgttctcctctgccgcctt

SEQ ID NO: 12516 - DNA, 40 bp, Artificial Sequence
  PCR primer for ORF amplification
caggagctgcacttccagaataggttttactaaacttgta

SEQ ID NO: 12517 - DNA, 40 bp, Artificial Sequence
  PCR primer for ORF amplification
caggagctgcacttcccatggtagataatttgttgatgat

SEQ ID NO: 12518 - DNA, 40 bp, Artificial Sequence
  PCR primer for ORF amplification
caggagctgcacttcccataacaacgcactcacttttctc

SEQ ID NO: 12519 - DNA, 40 bp, Artificial Sequence
  PCR primer for ORF amplification
caggagctgcacttccagtttcattctcactatcactgct

SEQ ID NO: 12520 - DNA, 40 bp, Artificial Sequence
  PCR primer for ORF amplification
caggagctgcacttccataacggccatttctttggctttt

SEQ ID NO: 12521 - DNA, 40 bp, Artificial Sequence
  PCR primer for ORF amplification
caggagctgcacttcctcgttcatcgtgtatttcgaactt

SEQ ID NO: 12522 - DNA, 40 bp, Artificial Sequence
  PCR primer for ORF amplification
caggagctgcacttccagcactttttaaattcacaatatt

SEQ ID NO: 12523 - DNA, 40 bp, Artificial Sequence
  PCR primer for ORF amplification
caggagctgcacttccgtctgaaaattctttgtcgtagcc

SEQ ID NO: 12524 - DNA, 40 bp, Artificial Sequence
  PCR primer for ORF amplification
caggagctgcacttcccataataatagcttcctttggaac

SEQ ID NO: 12525 - DNA, 40 bp, Artificial Sequence
  PCR primer for ORF amplification
caggagctgcacttcctaaaccttgttcctctaaagtctt

SEQ ID NO: 12526 - DNA, 40 bp, Artificial Sequence
  PCR primer for ORF amplification
caggagctgcacttccgaacaaataactttcaattcttga

SEQ ID NO: 12527 - DNA, 40 bp, Artificial Sequence
  PCR primer for ORF amplification
caggagctgcacttccacagcttgcaccagatccagatgg

SEQ ID NO: 12528 - DNA, 40 bp, Artificial Sequence
  PCR primer for ORF amplification
caggagctgcacttccctgttgtaattcagaaattggttt

SEQ ID NO: 12529 - DNA, 40 bp, Artificial Sequence
  PCR primer for ORF amplification
caggagctgcacttcctttatggaatttcttatcataatc

SEQ ID NO: 12530 - DNA, 40 bp, Artificial Sequence
  PCR primer for ORF amplification
caggagctgcacttccgtcaatttcgattacttccgggct

SEQ ID NO: 12531 - DNA, 40 bp, Artificial Sequence
  PCR primer for ORF amplification
caggagctgcacttccaccaccgtagacgccagaaaaaac

SEQ ID NO: 12532 - DNA, 40 bp, Artificial Sequence
  PCR primer for ORF amplification
caggagctgcacttccatcgtgtttcaaagtttcggtgaa

SEQ ID NO: 12533 - DNA, 40 bp, Artificial Sequence
  PCR primer for ORF amplification
caggagctgcacttccgtcatgcttcaaggtttcggcgaa

SEQ ID NO: 12534 - DNA, 40 bp, Artificial Sequence
  PCR primer for ORF amplification
caggagctgcacttccagcaaactcaaaagaacaatcact

SEQ ID NO: 12535 - DNA, 40 bp, Artificial Sequence
  PCR primer for ORF amplification
caggagctgcacttcctgtaaaaatatgttccctataaaa

SEQ ID NO: 12536 - DNA, 40 bp, Artificial Sequence
  PCR primer for ORF amplification
caggagctgcacttcctttgcttgcaaacttaatataata

SEQ ID NO: 12537 - DNA, 40 bp, Artificial Sequence
  PCR primer for ORF amplification
caggagctgcacttcccttcgaaccaattctgtggcactc

SEQ ID NO: 12538 - DNA, 40 bp, Artificial Sequence
  PCR primer for ORF amplification
caggagctgcacttccatcaagaggttgagatgacaacgt

SEQ ID NO: 12539 - DNA, 40 bp, Artificial Sequence
  PCR primer for ORF amplification
caggagctgcacttcctcgattattgggagtgggagttgc

SEQ ID NO: 12540 - DNA, 40 bp, Artificial Sequence
  PCR primer for ORF amplification
caggagctgcacttcctcgtgttagacttttgtaaagatc

SEQ ID NO: 12541 - DNA, 40 bp, Artificial Sequence; identical to SEQ ID NO: 10580
  PCR primer for ORF amplification

SEQ ID NO: 12542 - DNA, 40 bp, Artificial Sequence
  PCR primer for ORF amplification
caggagctgcacttcccaaatacttttcaaaatgtttatc

SEQ ID NO: 12543 - DNA, 40 bp, Artificial Sequence
  PCR primer for ORF amplification
caggagctgcacttcctttggataaccattttagcaactg

SEQ ID NO: 12544 - DNA, 40 bp, Artificial Sequence
  PCR primer for ORF amplification
caggagctgcacttccctggttacgggagcgtagtgactg

SEQ ID NO: 12545 - DNA, 40 bp, Artificial Sequence
  PCR primer for ORF amplification
caggagctgcacttcctttaccatcctccccacgctgtgc

SEQ ID NO: 12546 - DNA, 40 bp, Artificial Sequence
  PCR primer for ORF amplification
caggagctgcacttccctctctggagacaagttttcgtag

SEQ ID NO: 12547 - DNA, 40 bp, Artificial Sequence
  PCR primer for ORF amplification
caggagctgcacttcctatctttgcgcctttgagaaactt

SEQ ID NO: 12548 - DNA, 40 bp, Artificial Sequence
  PCR primer for ORF amplification
caggagctgcacttcccagtattttgaattctgttagtag

SEQ ID NO: 12549 - DNA, 40 bp, Artificial Sequence
  PCR primer for ORF amplification
caggagctgcacttccgcagcagacatcccggtcaacctg

SEQ ID NO: 12550 - DNA, 40 bp, Artificial Sequence
  PCR primer for ORF amplification
caggagctgcacttcctattgttaacttgttagcgcgagg

SEQ ID NO: 12551 - DNA, 40 bp, Artificial Sequence
  PCR primer for ORF amplification
caggagctgcacttccagtgtctaaatcttgtaaaagatt

SEQ ID NO: 12552 - DNA, 40 bp, Artificial Sequence
  PCR primer for ORF amplification
caggagctgcacttccagatacttgctgggatggcttttt

SEQ ID NO: 12553 - DNA, 40 bp, Artificial Sequence
  PCR primer for ORF amplification
caggagctgcacttccttcttcatcggcctcatcagcttc

SEQ ID NO: 12554 - DNA, 40 bp, Artificial Sequence
  PCR primer for ORF amplification
caggagctgcacttcctctatttactttctcggattcaaa

SEQ ID NO: 12555 - DNA, 40 bp, Artificial Sequence
  PCR primer for ORF amplification
caggagctgcacttccacgaggttcccatctcaccgacca

SEQ ID NO: 12556 - DNA, 40 bp, Artificial Sequence
  PCR primer for ORF amplification
caggagctgcacttccagcaaggattttcttaacttcttc

SEQ ID NO: 12557 - DNA, 40 bp, Artificial Sequence
  PCR primer for ORF amplification
caggagctgcacttccgtcacttgaatcggtaataccttt

SEQ ID NO: 12558 - DNA, 40 bp, Artificial Sequence
  PCR primer for ORF amplification
caggagctgcacttccgtagaagacaaagttagcagaacc

SEQ ID NO: 12559 - DNA, 40 bp, Artificial Sequence
  PCR primer for ORF amplification
caggagctgcacttcctatgttcccattaggcagttctat

SEQ ID NO: 12560 - DNA, 40 bp, Artificial Sequence
  PCR primer for ORF amplification
caggagctgcacttcctttcgtagctagcttagttttcga

SEQ ID NO: 12561 - DNA, 40 bp, Artificial Sequence
  PCR primer for ORF amplification
caggagctgcacttccgttgttcttcttggtatttgggtc

SEQ ID NO: 12562 - DNA, 40 bp, Artificial Sequence
  PCR primer for ORF amplification
caggagctgcacttccaaaaccgtatttcgccaaaacact

SEQ ID NO: 12563 - DNA, 40 bp, Artificial Sequence
  PCR primer for ORF amplification
caggagctgcacttccaatcaagtttcttgctagtaagat

SEQ ID NO: 12564 - DNA, 40 bp, Artificial Sequence
  PCR primer for ORF amplification
caggagctgcacttcccgtaaaacttaattcttgtctaga

SEQ ID NO: 12565 - DNA, 40 bp, Artificial Sequence
  PCR primer for ORF amplification
caggagctgcacttccctcctcattgttaaccttggtaat

SEQ ID NO: 12566 - DNA, 40 bp, Artificial Sequence
  PCR primer for ORF amplification
caggagctgcacttcctttcatcttaacaaccactttacc

SEQ ID NO: 12567 - DNA, 40 bp, Artificial Sequence
  PCR primer for ORF amplification
caggagctgcacttccccttttctttttctctttaacctc

SEQ ID NO: 12568 - DNA, 40 bp, Artificial Sequence
  PCR primer for ORF amplification
caggagctgcacttccgttcttgacataaagacggtaaaa

SEQ ID NO: 12569 - DNA, 40 bp, Artificial Sequence
  PCR primer for ORF amplification
caggagctgcacttccattagcaacgtcctcctttgaaga

SEQ ID NO: 12570 - DNA, 40 bp, Artificial Sequence
  PCR primer for ORF amplification
caggagctgcacttcctgcggggggatgcatttcatgcag

SEQ ID NO: 12571 - DNA, 40 bp, Artificial Sequence
  PCR primer for ORF amplification
caggagctgcacttcccagtctttgtagataatgaatctg

SEQ ID NO: 12572 - DNA, 40 bp, Artificial Sequence
  PCR primer for ORF amplification
caggagctgcacttccctgatgcaatttgtttccaaatac

SEQ ID NO: 12573 - DNA, 40 bp, Artificial Sequence
  PCR primer for ORF amplification
caggagctgcacttcccttcaaaagctgggccaacttttt

SEQ ID NO: 12574 - DNA, 40 bp, Artificial Sequence
  PCR primer for ORF amplification
caggagctgcacttcctgaaagtttatacacattatcgga

SEQ ID NO: 12575 - DNA, 40 bp, Artificial Sequence
  PCR primer for ORF amplification
caggagctgcacttcctgcagtgaggaaatccatggataa

SEQ ID NO: 12576 - DNA, 40 bp, Artificial Sequence
  PCR primer for ORF amplification
caggagctgcacttcctcctctattcatggtatttccgct

SEQ ID NO: 12577 - DNA, 40 bp, Artificial Sequence
  PCR primer for ORF amplification
caggagctgcacttcctgataattcattttttgctctact

SEQ ID NO: 12578 - DNA, 40 bp, Artificial Sequence
  PCR primer for ORF amplification
caggagctgcacttcctggaggtcggatatcaggcttggg

SEQ ID NO: 12579 - DNA, 40 bp, Artificial Sequence
  PCR primer for ORF amplification
caggagctgcacttccttcaattgacaagacttctttgac

SEQ ID NO: 12580 - DNA, 40 bp, Artificial Sequence
  PCR primer for ORF amplification
caggagctgcacttccttcgatattgttataatgaagttt

SEQ ID NO: 12581 - DNA, 40 bp, Artificial Sequence
  PCR primer for ORF amplification
caggagctgcacttcctaaccgcttattttcccaaaaggg

SEQ ID NO: 12582 - DNA, 40 bp, Artificial Sequence
  PCR primer for ORF amplification
caggagctgcacttccttcttgtctctcaaccactgaggc

SEQ ID NO: 12583 - DNA, 40 bp, Artificial Sequence
  PCR primer for ORF amplification
caggagctgcacttccgaatacttgattggggttcccttt

SEQ ID NO: 12584 - DNA, 40 bp, Artificial Sequence
  PCR primer for ORF amplification
caggagctgcacttcccgtacttgttttcttagtagatga

SEQ ID NO: 12585 - DNA, 40 bp, Artificial Sequence
  PCR primer for ORF amplification
caggagctgcacttccttctttcttagtcttcctcttctt

SEQ ID NO: 12586 - DNA, 40 bp, Artificial Sequence
  PCR primer for ORF amplification
caggagctgcacttccggtgataagataaaagttaaaacg

SEQ ID NO: 12587 - DNA, 40 bp, Artificial Sequence
  PCR primer for ORF amplification
caggagctgcacttccacgatgcatttcttctggaccatc

SEQ ID NO: 12588 - DNA, 40 bp, Artificial Sequence
  PCR primer for ORF amplification
caggagctgcacttcctgcaatctttttgcttgtgtttgt

SEQ ID NO: 12589 - DNA, 40 bp, Artificial Sequence
  PCR primer for ORF amplification
caggagctgcacttccccttctaactctgctaaaaaccct

SEQ ID NO: 12590 - DNA, 40 bp, Artificial Sequence; identical to SEQ ID NO: 12473
  PCR primer for ORF amplification

SEQ ID NO: 12591 - DNA, 40 bp, Artificial Sequence
  PCR primer for ORF amplification
caggagctgcacttcctggcttttctaattcttgcaagat

SEQ ID NO: 12592 - DNA, 40 bp, Artificial Sequence
  PCR primer for ORF amplification
caggagctgcacttccttccttctttctttcaccctttag

SEQ ID NO: 12593 - DNA, 40 bp, Artificial Sequence
  PCR primer for ORF amplification
caggagctgcacttccgtccgttggaaatgcgttacttaa

SEQ ID NO: 12594 - DNA, 40 bp, Artificial Sequence
  PCR primer for ORF amplification
caggagctgcacttccgtttaatacggcaactagtttttc

SEQ ID NO: 12595 - DNA, 40 bp, Artificial Sequence
  PCR primer for ORF amplification
caggagctgcacttcctttcggagaaactaggctagtttt

SEQ ID NO: 12596 - DNA, 40 bp, Artificial Sequence
  PCR primer for ORF amplification
caggagctgcacttccactccaaacgctcatgtcagtatt

SEQ ID NO: 12597 - DNA, 40 bp, Artificial Sequence
  PCR primer for ORF amplification
caggagctgcacttcccaagaagtaatcaacatgtctgtt

SEQ ID NO: 12598 - DNA, 40 bp, Artificial Sequence
  PCR primer for ORF amplification
caggagctgcacttccatcttgacctcgttgctgcctggc

SEQ ID NO: 12599 - DNA, 40 bp, Artificial Sequence
  PCR primer for ORF amplification
caggagctgcacttccttccatggtcttcattagttcatc

SEQ ID NO: 12600 - DNA, 40 bp, Artificial Sequence
  PCR primer for ORF amplification
caggagctgcacttcctttcgcgaataaagaaactacatc

SEQ ID NO: 12601 - DNA, 40 bp, Artificial Sequence
  PCR primer for ORF amplification
caggagctgcacttcctttttttatttttttcttgcctct

SEQ ID NO: 12602 - DNA, 40 bp, Artificial Sequence
  PCR primer for ORF amplification
caggagctgcacttcccaattcgtccaaatatggcaagtt

SEQ ID NO: 12603 - DNA, 40 bp, Artificial Sequence
  PCR primer for ORF amplification
caggagctgcacttcctcttcgaagataaggggtattcca

SEQ ID NO: 12604 - DNA, 40 bp, Artificial Sequence
  PCR primer for ORF amplification
caggagctgcacttcctaaaaagtaatctggcgtctttct

SEQ ID NO: 12605 - DNA, 40 bp, Artificial Sequence
  PCR primer for ORF amplification
caggagctgcacttcccctggcgtacatgtccgggaatag

SEQ ID NO: 12606 - DNA, 40 bp, Artificial Sequence
  PCR primer for ORF amplification
caggagctgcacttcctagaaacaaagtgtggccttctag

SEQ ID NO: 12607 - DNA, 40 bp, Artificial Sequence
  PCR primer for ORF amplification
caggagctgcacttccttttccatcttgaattaggcaagg

SEQ ID NO: 12608 - DNA, 40 bp, Artificial Sequence
  PCR primer for ORF amplification
caggagctgcacttccctttttcaagatggtaacaacatc

SEQ ID NO: 12609 - DNA, 40 bp, Artificial Sequence
  PCR primer for ORF amplification
caggagctgcacttcccttctccatcaagtctggagaagg

SEQ ID NO: 12610 - DNA, 40 bp, Artificial Sequence
  PCR primer for ORF amplification
caggagctgcacttcctaatctcttgatgactgcttcagt

SEQ ID NO: 12611 - DNA, 40 bp, Artificial Sequence
  PCR primer for ORF amplification
caggagctgcacttccttccttgttttctgtgttttttgt

SEQ ID NO: 12612 - DNA, 40 bp, Artificial Sequence
  PCR primer for ORF amplification
caggagctgcacttcctaataatgaggtaacatgctgaca

SEQ ID NO: 12613 - DNA, 40 bp, Artificial Sequence
  PCR primer for ORF amplification
caggagctgcacttcccttagacttcggatatagcttttt

SEQ ID NO: 12614 - DNA, 40 bp, Artificial Sequence
  PCR primer for ORF amplification
caggagctgcacttccggcatccaagataggtcctttttc

SEQ ID NO: 12615 - DNA, 40 bp, Artificial Sequence
  PCR primer for ORF amplification
caggagctgcacttcccaacatgaattcaccgataccaaa

SEQ ID NO: 12616 - DNA, 40 bp, Artificial Sequence
  PCR primer for ORF amplification
caggagctgcacttcctttcttgttaacttctcttctttg

SEQ ID NO: 12617 - DNA, 40 bp, Artificial Sequence
  PCR primer for ORF amplification
caggagctgcacttccgattagaggcgtggccaggcggtt

SEQ ID NO: 12618 - DNA, 40 bp, Artificial Sequence
  PCR primer for ORF amplification
caggagctgcacttcctgaagattctctttcaaattcctt

SEQ ID NO: 12619 - DNA, 40 bp, Artificial Sequence
  PCR primer for ORF amplification
caggagctgcacttcctaaaggacgaatatctggcttggg

SEQ ID NO: 12620 - DNA, 40 bp, Artificial Sequence
  PCR primer for ORF amplification
caggagctgcacttccttttttcaaggcctttcttctgtt

SEQ ID NO: 12621 - DNA, 40 bp, Artificial Sequence
  PCR primer for ORF amplification
caggagctgcacttccggagaacatcttcgaaagagactt

SEQ ID NO: 12622 - DNA, 40 bp, Artificial Sequence
  PCR primer for ORF amplification
caggagctgcacttcccaagtcaatgcaaggctggtctgt

SEQ ID NO: 12623 - DNA, 40 bp, Artificial Sequence
  PCR primer for ORF amplification
caggagctgcacttccaagcttgctcaaaaaagcccgcct

SEQ ID NO: 12624 - DNA, 40 bp, Artificial Sequence
  PCR primer for ORF amplification
caggagctgcacttcctaatctcgacaaaacgtcgtcaac

SEQ ID NO: 12625 - DNA, 40 bp, Artificial Sequence
  PCR primer for ORF amplification
caggagctgcacttccccattcaacgttgtctgcattttc

SEQ ID NO: 12626 - DNA, 40 bp, Artificial Sequence
  PCR primer for ORF amplification
caggagctgcacttcctttttcaatttgttcccttattgg

SEQ ID NO: 12627 - DNA, 40 bp, Artificial Sequence
  PCR primer for ORF amplification
caggagctgcacttcctgcttgtaccaaaggctgatcacc

SEQ ID NO: 12628 - DNA, 40 bp, Artificial Sequence
  PCR primer for ORF amplification
caggagctgcacttccaataatttctctcaaaaagctatt

SEQ ID NO: 12629 - DNA, 40 bp, Artificial Sequence
  PCR primer for ORF amplification
caggagctgcacttccatcagaggatgactgtttttgtgg

SEQ ID NO: 12630 - DNA, 40 bp, Artificial Sequence
  PCR primer for ORF amplification
caggagctgcacttcccaagaatccaaacagtctcaagat

SEQ ID NO: 12631 - DNA, 40 bp, Artificial Sequence
  PCR primer for ORF amplification
caggagctgcacttcctttgctatttctctgtagagcttc

SEQ ID NO: 12632 - DNA, 40 bp, Artificial Sequence
  PCR primer for ORF amplification
caggagctgcacttcccccatccacctttcgctccttgaa

SEQ ID NO: 12633 - DNA, 40 bp, Artificial Sequence
  PCR primer for ORF amplification
caggagctgcacttccaattaccatagtgctaatattttc

SEQ ID NO: 12634 - DNA, 40 bp, Artificial Sequence
  PCR primer for ORF amplification
caggagctgcacttccatggacagattgcaattctgattt

SEQ ID NO: 12635 - DNA, 40 bp, Artificial Sequence
  PCR primer for ORF amplification
caggagctgcacttccagtaactaagtcctctagttcttc

SEQ ID NO: 12636 - DNA, 40 bp, Artificial Sequence
  PCR primer for ORF amplification
caggagctgcacttcccaatcttgaagatcttttaacacg

SEQ ID NO: 12637 - DNA, 40 bp, Artificial Sequence
  PCR primer for ORF amplification
caggagctgcacttccgaccaattcataagtatcatagga

SEQ ID NO: 12638 - DNA, 40 bp, Artificial Sequence
  PCR primer for ORF amplification
caggagctgcacttcctgcaaacataaccccgtattgagg

SEQ ID NO: 12639 - DNA, 40 bp, Artificial Sequence
  PCR primer for ORF amplification
caggagctgcacttccaacatcgccgttcagtagtgaatc

SEQ ID NO: 12640 - DNA, 40 bp, Artificial Sequence
  PCR primer for ORF amplification
caggagctgcacttcctgaggtttcttcgtttaatgtcag

SEQ ID NO: 12641 - DNA, 40 bp, Artificial Sequence
  PCR primer for ORF amplification
caggagctgcacttccccaagcggaccatgacccgagttc

SEQ ID NO: 12642 - DNA, 40 bp, Artificial Sequence
  PCR primer for ORF amplification
caggagctgcacttccgtaagcaggatcactatcgtcacc

SEQ ID NO: 12643 - DNA, 40 bp, Artificial Sequence
  PCR primer for ORF amplification
caggagctgcacttcctggtaacggctcatagttacagct

SEQ ID NO: 12644 - DNA, 40 bp, Artificial Sequence
  PCR primer for ORF amplification
caggagctgcacttccatattttgtcttcactgttccctt

SEQ ID NO: 12645 - DNA, 40 bp, Artificial Sequence
  PCR primer for ORF amplification
caggagctgcacttccaccttgagatttatttatcgactc

SEQ ID NO: 12646 - DNA, 40 bp, Artificial Sequence
  PCR primer for ORF amplification
caggagctgcacttccgtcaactctcacgacaacaacagt

SEQ ID NO: 12647 - DNA, 40 bp, Artificial Sequence
  PCR primer for ORF amplification
caggagctgcacttccacaaatcgggttagtcaatcctct

SEQ ID NO: 12648 - DNA, 40 bp, Artificial Sequence
  PCR primer for ORF amplification
caggagctgcacttccacaaatcgggttggtcaatcctct

SEQ ID NO: 12649 - DNA, 40 bp, Artificial Sequence
  PCR primer for ORF amplification
caggagctgcacttcccaatttggaattatcaatcacctc

SEQ ID NO: 12650 - DNA, 40 bp, Artificial Sequence
  PCR primer for ORF amplification
caggagctgcacttccattttctaccgtagggttgggatt

SEQ ID NO: 12651 - DNA, 40 bp, Artificial Sequence
  PCR primer for ORF amplification
caggagctgcacttccagatctgtcgtacttaaatgcctc

SEQ ID NO: 12652 - DNA, 40 bp, Artificial Sequence
  PCR primer for ORF amplification
caggagctgcacttcctttaccaacattcactttacatcc

SEQ ID NO: 12653 - DNA, 40 bp, Artificial Sequence
  PCR primer for ORF amplification
caggagctgcacttccacctaagccgttccatacaaataa

SEQ ID NO: 12654 - DNA, 40 bp, Artificial Sequence
  PCR primer for ORF amplification
caggagctgcacttccatccagagatggcacaatcaagtt

SEQ ID NO: 12655 - DNA, 40 bp, Artificial Sequence
  PCR primer for ORF amplification
caggagctgcacttccttcagcaactttcgtaggtttaat

SEQ ID NO: 12656 - DNA, 40 bp, Artificial Sequence
  PCR primer for ORF amplification
caggagctgcacttcctttactagtatcgacgacgtatct

SEQ ID NO: 12657 - DNA, 40 bp, Artificial Sequence
  PCR primer for ORF amplification
caggagctgcacttcccataatactaagctgaaacaaaaa

SEQ ID NO: 12658 - DNA, 40 bp, Artificial Sequence
  PCR primer for ORF amplification
caggagctgcacttccggttaagtcggtaaattttgcgtg

SEQ ID NO: 12659 - DNA, 40 bp, Artificial Sequence
  PCR primer for ORF amplification
caggagctgcacttccattggtatgttggttttgattatg

SEQ ID NO: 12660 - DNA, 40 bp, Artificial Sequence
  PCR primer for ORF amplification
caggagctgcacttccaacagcgcttgtatgttcattagc

SEQ ID NO: 12661 - DNA, 40 bp, Artificial Sequence
  PCR primer for ORF amplification
caggagctgcacttccgttcaaatcagtaacaacccttga

SEQ ID NO: 12662 - DNA, 40 bp, Artificial Sequence
  PCR primer for ORF amplification
caggagctgcacttccattgtcaaaagctatcctggcaga

SEQ ID NO: 12663 - DNA, 40 bp, Artificial Sequence
  PCR primer for ORF amplification
caggagctgcacttccagcccacttaccgatcaaagccat

SEQ ID NO: 12664 - DNA, 40 bp, Artificial Sequence
  PCR primer for ORF amplification
caggagctgcacttccgtttaatacggcaacgagtttttc

SEQ ID NO: 12665 - DNA, 40 bp, Artificial Sequence
  PCR primer for ORF amplification
caggagctgcacttccacttttagccttcttgacagcttc

SEQ ID NO: 12666 - DNA, 40 bp, Artificial Sequence
  PCR primer for ORF amplification
caggagctgcacttccatgaaccacggatctggagaaatc

SEQ ID NO: 12667 - DNA, 40 bp, Artificial Sequence
  PCR primer for ORF amplification
caggagctgcacttccacggacttgagcattagcaatact

SEQ ID NO: 12668 - DNA, 40 bp, Artificial Sequence
  PCR primer for ORF amplification
caggagctgcacttcctttcaagacggcaaccaacttttc

SEQ ID NO: 12669 - DNA, 40 bp, Artificial Sequence
  PCR primer for ORF amplification
caggagctgcacttcctttcttctgtccataagctctggt

SEQ ID NO: 12670 - DNA, 40 bp, Artificial Sequence
  PCR primer for ORF amplification
caggagctgcacttccatctatttttgcttctttgatgtg

SEQ ID NO: 12671 - DNA, 40 bp, Artificial Sequence
  PCR primer for ORF amplification
caggagctgcacttccggttgttcttttacgttccttaag

SEQ ID NO: 12672 - DNA, 40 bp, Artificial Sequence
  PCR primer for ORF amplification
caggagctgcacttccaaaacagcaccttttactaaaatc

SEQ ID NO: 12673 - DNA, 40 bp, Artificial Sequence
  PCR primer for ORF amplification
caggagctgcacttccataatttcgtggtgataattcgtt

SEQ ID NO: 12674 - DNA, 40 bp, Artificial Sequence
  PCR primer for ORF amplification
caggagctgcacttccgcttctattaatttttttctgtag

SEQ ID NO: 12675 - DNA, 40 bp, Artificial Sequence
  PCR primer for ORF amplification
caggagctgcacttcccaactcatctttgagcatattttg

SEQ ID NO: 12676 - DNA, 40 bp, Artificial Sequence
  PCR primer for ORF amplification
caggagctgcacttcccgatagtagccttataacaatttc

SEQ ID NO: 12677 - DNA, 40 bp, Artificial Sequence
  PCR primer for ORF amplification
caggagctgcacttccagatgatgcagatctcgatgcaac

SEQ ID NO: 12678 - DNA, 40 bp, Artificial Sequence
  PCR primer for ORF amplification
caggagctgcacttcctaagaaataatccggtgtcttcct

SEQ ID NO: 12679 - DNA, 40 bp, Artificial Sequence
  PCR primer for ORF amplification
caggagctgcacttcctcggatagctttatttgtttcaat

SEQ ID NO: 12680 - DNA, 40 bp, Artificial Sequence
  PCR primer for ORF amplification
caggagctgcacttcctggcggattaatgtgagctataga

SEQ ID NO: 12681 - DNA, 40 bp, Artificial Sequence
  PCR primer for ORF amplification
caggagctgcacttccgtctctatttcttccgggaaccca

SEQ ID NO: 12682 - DNA, 40 bp, Artificial Sequence
  PCR primer for ORF amplification
caggagctgcacttccttttttgaataaaggttccatttt

SEQ ID NO: 12683 - DNA, 40 bp, Artificial Sequence
  PCR primer for ORF amplification
caggagctgcacttccatcagcttcgtctggattgaccac

SEQ ID NO: 12684 - DNA, 40 bp, Artificial Sequence
  PCR primer for ORF amplification
caggagctgcacttccttccatatcaacatccactccaaa

SEQ ID NO: 12685 - DNA, 40 bp, Artificial Sequence
  PCR primer for ORF amplification
caggagctgcacttccggctgcatcctgcaattctttcaa

SEQ ID NO: 12686 - DNA, 40 bp, Artificial Sequence
  PCR primer for ORF amplification
caggagctgcacttcccactaagagcacctcactgcggga

SEQ ID NO: 12687 - DNA, 40 bp, Artificial Sequence
  PCR primer for ORF amplification
caggagctgcacttcctttccgtggctcatagatatacgg

SEQ ID NO: 12688 - DNA, 40 bp, Artificial Sequence
  PCR primer for ORF amplification
caggagctgcacttcccgctaaggactcctcactgcagga

SEQ ID NO: 12689 - DNA, 40 bp, Artificial Sequence
  PCR primer for ORF amplification
caggagctgcacttccgtcctttctccagtcaccattgat

SEQ ID NO: 12690 - DNA, 40 bp, Artificial Sequence
  PCR primer for ORF amplification
caggagctgcacttccccgggtcctgtacaatgttatttc

SEQ ID NO: 12691 - DNA, 40 bp, Artificial Sequence
  PCR primer for ORF amplification
caggagctgcacttccgaagcccattattttatgaatgtc

SEQ ID NO: 12692 - DNA, 40 bp, Artificial Sequence
  PCR primer for ORF amplification
caggagctgcacttccaactacacgggagaaatgctcatc

SEQ ID NO: 12693 - DNA, 40 bp, Artificial Sequence
  PCR primer for ORF amplification
caggagctgcacttccggcgccatagttatccgatttatc

SEQ ID NO: 12694 - DNA, 40 bp, Artificial Sequence
  PCR primer for ORF amplification
caggagctgcacttccacgtttttgtttacaccagtcaaa

SEQ ID NO: 12695 - DNA, 40 bp, Artificial Sequence
  PCR primer for ORF amplification
caggagctgcacttccttttttcttgtgtctttctgttgt

SEQ ID NO: 12696 - DNA, 40 bp, Artificial Sequence
  PCR primer for ORF amplification
caggagctgcacttccccattctaaaacaaccattttttt

SEQ ID NO: 12697 - DNA, 40 bp, Artificial Sequence
  PCR primer for ORF amplification
caggagctgcacttccgaaatcttgaaagtattcagcata

SEQ ID NO: 12698 - DNA, 40 bp, Artificial Sequence
  PCR primer for ORF amplification
caggagctgcacttcccacatcattgcaagctgattgtgc

SEQ ID NO: 12699 - DNA, 40 bp, Artificial Sequence
  PCR primer for ORF amplification
caggagctgcacttccggtatcaggctttgggaatgctct

SEQ ID NO: 12700 - DNA, 40 bp, Artificial Sequence
  PCR primer for ORF amplification
caggagctgcacttcccctgctcgtgaccacggtcttttt

SEQ ID NO: 12701 - DNA, 40 bp, Artificial Sequence
  PCR primer for ORF amplification
caggagctgcacttcccaaggagctcacactatctataaa

SEQ ID NO: 12702 - DNA, 40 bp, Artificial Sequence
  PCR primer for ORF amplification
caggagctgcacttcctactggacgtagcgcggctgcgtc

SEQ ID NO: 12703 - DNA, 40 bp, Artificial Sequence; identical to SEQ ID NO: 12688
  PCR primer for ORF amplification

SEQ ID NO: 12704 - DNA, 40 bp, Artificial Sequence; identical to SEQ ID NO: 12688
  PCR primer for ORF amplification

SEQ ID NO: 12705 - DNA, 40 bp, Artificial Sequence
  PCR primer for ORF amplification
caggagctgcacttccctttaggggcttctcattgcgggc

SEQ ID NO: 12706 - DNA, 40 bp, Artificial Sequence
  PCR primer for ORF amplification
caggagctgcacttcccccaccatagacgccagtgaaaac

SEQ ID NO: 12707 - DNA, 40 bp, Artificial Sequence
  PCR primer for ORF amplification
caggagctgcacttcccttatttctagtaaagttggctct

SEQ ID NO: 12708 - DNA, 40 bp, Artificial Sequence
  PCR primer for ORF amplification
caggagctgcacttccgttaccacccctcaacctcaagac

SEQ ID NO: 12709 - DNA, 40 bp, Artificial Sequence
  PCR primer for ORF amplification
caggagctgcacttccccttttaagacgcaataaatctct

SEQ ID NO: 12710 - DNA, 40 bp, Artificial Sequence
  PCR primer for ORF amplification
caggagctgcacttcccataattacacagttttttttcaa

SEQ ID NO: 12711 - DNA, 40 bp, Artificial Sequence
  PCR primer for ORF amplification
caggagctgcacttcccgactgctcctctttgttatcatg

SEQ ID NO: 12712 - DNA, 40 bp, Artificial Sequence
  PCR primer for ORF amplification
caggagctgcacttcccgccttatttttatccaaatgcac

SEQ ID NO: 12713 - DNA, 40 bp, Artificial Sequence
  PCR primer for ORF amplification
caggagctgcacttccatcatccttaccctttggtttacc

SEQ ID NO: 12714 - DNA, 40 bp, Artificial Sequence
  PCR primer for ORF amplification
caggagctgcacttcctacgctattatcagccaaagttgg

SEQ ID NO: 12715 - DNA, 40 bp, Artificial Sequence
  PCR primer for ORF amplification
caggagctgcacttccaccatataaatcttttaagtggtt

SEQ ID NO: 12716 - DNA, 40 bp, Artificial Sequence
  PCR primer for ORF amplification
caggagctgcacttcccgagctgttatttcccagtgagta

SEQ ID NO: 12717 - DNA, 40 bp, Artificial Sequence
  PCR primer for ORF amplification
caggagctgcacttcccttcatttcaccgtgattgttagg

SEQ ID NO: 12718 - DNA, 40 bp, Artificial Sequence
  PCR primer for ORF amplification
caggagctgcacttcctatgaggttcaatggtaagtgtgt

SEQ ID NO: 12719 - DNA, 40 bp, Artificial Sequence
  PCR primer for ORF amplification
caggagctgcacttccaactcttttgggaccgttgaaaac

SEQ ID NO: 12720 - DNA, 40 bp, Artificial Sequence
  PCR primer for ORF amplification
caggagctgcacttcccttcaaagtctctggaatatgaga

SEQ ID NO: 12721 - DNA, 40 bp, Artificial Sequence
  PCR primer for ORF amplification
caggagctgcacttccgaacttcaaagtcttaggcttttc

SEQ ID NO: 12722 - DNA, 40 bp, Artificial Sequence
  PCR primer for ORF amplification
caggagctgcacttcctcttcttccctttgtgactttatt

SEQ ID NO: 12723 - DNA, 40 bp, Artificial Sequence
  PCR primer for ORF amplification
caggagctgcacttccatattcataggctttcttgataat

SEQ ID NO: 12724 - DNA, 40 bp, Artificial Sequence
  PCR primer for ORF amplification
caggagctgcacttcctttcttcattaaagactcttcatt

SEQ ID NO: 12725 - DNA, 40 bp, Artificial Sequence; identical to SEQ ID NO: 12724
  PCR primer for ORF amplification

SEQ ID NO: 12726 - DNA, 40 bp, Artificial Sequence
  PCR primer for ORF amplification
caggagctgcacttccagtttgcaggggctcgagctggtt

SEQ ID NO: 12727 - DNA, 40 bp, Artificial Sequence
  PCR primer for ORF amplification
caggagctgcacttccttgagttgcttcttgggaagtttg

SEQ ID NO: 12728 - DNA, 40 bp, Artificial Sequence
  PCR primer for ORF amplification
caggagctgcacttcctaaactgaaaagaccagttttctt

SEQ ID NO: 12729 - DNA, 40 bp, Artificial Sequence
  PCR primer for ORF amplification
caggagctgcacttcccgtggcactatccgagtgtctccc

SEQ ID NO: 12730 - DNA, 40 bp, Artificial Sequence
  PCR primer for ORF amplification
caggagctgcacttcccctatctaaaatacccttagtttt

SEQ ID NO: 12731 - DNA, 40 bp, Artificial Sequence
  PCR primer for ORF amplification
caggagctgcacttcctatactcgctagaagttttagcaa

SEQ ID NO: 12732 - DNA, 40 bp, Artificial Sequence
  PCR primer for ORF amplification
caggagctgcacttcctagctcatcatgtgagacgatcct

SEQ ID NO: 12733 - DNA, 40 bp, Artificial Sequence
  PCR primer for ORF amplification
caggagctgcacttcctttttccgtggatcgaagaatttc

SEQ ID NO: 12734 - DNA, 40 bp, Artificial Sequence
  PCR primer for ORF amplification
caggagctgcacttcccaggatttttaatagtaaatataa

SEQ ID NO: 12735 - DNA, 40 bp, Artificial Sequence
  PCR primer for ORF amplification
caggagctgcacttcccattaggttcgaataaacacgggt

SEQ ID NO: 12736 - DNA, 40 bp, Artificial Sequence
  PCR primer for ORF amplification
caggagctgcacttcctatatctgtgggaaggggtacaac

SEQ ID NO: 12737 - DNA, 40 bp, Artificial Sequence
  PCR primer for ORF amplification
caggagctgcacttccaattgtataaatgacgatcttacc

SEQ ID NO: 12738 - DNA, 40 bp, Artificial Sequence
  PCR primer for ORF amplification
caggagctgcacttccaaattccaatttctttggtttttc

SEQ ID NO: 12739 - DNA, 40 bp, Artificial Sequence
  PCR primer for ORF amplification
caggagctgcacttcctagatggctcgatgaggtcttacg

SEQ ID NO: 12740 - DNA, 40 bp, Artificial Sequence
  PCR primer for ORF amplification
caggagctgcacttccttcatatttcattttggacaatgg

SEQ ID NO: 12741 - DNA, 40 bp, Artificial Sequence
  PCR primer for ORF amplification
caggagctgcacttccatgccttctaggcttcttcttgac

SEQ ID NO: 12742 - DNA, 40 bp, Artificial Sequence
  PCR primer for ORF amplification
caggagctgcacttccttgtcctgttgaaaaaatattcga

SEQ ID NO: 12743 - DNA, 40 bp, Artificial Sequence
  PCR primer for ORF amplification
caggagctgcacttccctttttcctctgaagagctagttt

SEQ ID NO: 12744 - DNA, 40 bp, Artificial Sequence
  PCR primer for ORF amplification
caggagctgcacttcccacagatcttctttctaaggcttt

SEQ ID NO: 12745 - DNA, 40 bp, Artificial Sequence
  PCR primer for ORF amplification
caggagctgcacttccgtttctaatatacttcgcgatatt

SEQ ID NO: 12746 - DNA, 40 bp, Artificial Sequence
  PCR primer for ORF amplification
caggagctgcacttccttcgtttgttagctcgcttataat

SEQ ID NO: 12747 - DNA, 40 bp, Artificial Sequence
  PCR primer for ORF amplification
caggagctgcacttcctttggatgatttagaagatgaccg

SEQ ID NO: 12748 - DNA, 40 bp, Artificial Sequence
  PCR primer for ORF amplification
caggagctgcacttccttcattggccagcttatataacgt

SEQ ID NO: 12749 - DNA, 40 bp, Artificial Sequence
  PCR primer for ORF amplification
caggagctgcacttccaccacggaaagcgttcggatcaag

SEQ ID NO: 12750 - DNA, 40 bp, Artificial Sequence
  PCR primer for ORF amplification
caggagctgcacttcccgataacggtgaggtgattcgttg

SEQ ID NO: 12751 - DNA, 40 bp, Artificial Sequence
  PCR primer for ORF amplification
caggagctgcacttccgcttctcctcatcgattttagttt

SEQ ID NO: 12752 - DNA, 40 bp, Artificial Sequence
  PCR primer for ORF amplification
caggagctgcacttccctcctcaccatcgtcttcatcaag

SEQ ID NO: 12753 - DNA, 40 bp, Artificial Sequence
  PCR primer for ORF amplification
caggagctgcacttccttcattggatagaataccccagta

SEQ ID NO: 12754 - DNA, 40 bp, Artificial Sequence
  PCR primer for ORF amplification
caggagctgcacttccatcacgccaggctgcgtatacttc

SEQ ID NO: 12755 - DNA, 40 bp, Artificial Sequence
  PCR primer for ORF amplification
caggagctgcacttccgtgtgtacgcgtttcatcatcaac

SEQ ID NO: 12756 - DNA, 40 bp, Artificial Sequence
  PCR primer for ORF amplification
caggagctgcacttccttttatttcatcagacttcaagac

SEQ ID NO: 12757 - DNA, 40 bp, Artificial Sequence
  PCR primer for ORF amplification
caggagctgcacttccgtatttgtaggtttttatttcgcg

SEQ ID NO: 12758 - DNA, 40 bp, Artificial Sequence
  PCR primer for ORF amplification
caggagctgcacttcccttcttggtatcatcacgatgcaa

SEQ ID NO: 12759 - DNA, 40 bp, Artificial Sequence
  PCR primer for ORF amplification
caggagctgcacttcctttaattctctgtcttgggccacc

SEQ ID NO: 12760 - DNA, 40 bp, Artificial Sequence
  PCR primer for ORF amplification
caggagctgcacttccaatgccgaatactctactatatgc

SEQ ID NO: 12761 - DNA, 40 bp, Artificial Sequence
  PCR primer for ORF amplification
caggagctgcacttccgtcagaatattcttcctctatgtc

SEQ ID NO: 12762 - DNA, 40 bp, Artificial Sequence
  PCR primer for ORF amplification
caggagctgcacttcccagtttttgtttagtcgttttaac

SEQ ID NO: 12763 - DNA, 40 bp, Artificial Sequence
  PCR primer for ORF amplification
caggagctgcacttcctacaacctggaagatacaaaactg

SEQ ID NO: 12764 - DNA, 40 bp, Artificial Sequence
  PCR primer for ORF amplification
caggagctgcacttccaactatccatgtttgcaaggaatt

SEQ ID NO: 12765 - DNA, 40 bp, Artificial Sequence
  PCR primer for ORF amplification
caggagctgcacttcctttcaaagattttctccactcctt

SEQ ID NO: 12766 - DNA, 40 bp, Artificial Sequence
  PCR primer for ORF amplification
caggagctgcacttccattcttaacttttttgattggttt

SEQ ID NO: 12767 - DNA, 40 bp, Artificial Sequence
  PCR primer for ORF amplification
caggagctgcacttcccaagtccttcttcaaagtacccat

SEQ ID NO: 12768 - DNA, 40 bp, Artificial Sequence
  PCR primer for ORF amplification
caggagctgcacttcccaattgaggaagagcttgcaatgg

SEQ ID NO: 12769 - DNA, 40 bp, Artificial Sequence; identical to SEQ ID NO: 11980
  PCR primer for ORF amplification

SEQ ID NO: 12770 - DNA, 40 bp, Artificial Sequence
  PCR primer for ORF amplification
caggagctgcacttcctaaagacgaggaggacaaatcggt

SEQ ID NO: 12771 - DNA, 40 bp, Artificial Sequence
  PCR primer for ORF amplification
caggagctgcacttccatctctgatcttggcataaccctt

SEQ ID NO: 12772 - DNA, 40 bp, Artificial Sequence
  PCR primer for ORF amplification
caggagctgcacttccatcacttgatagaataccccagta

SEQ ID NO: 12773 - DNA, 40 bp, Artificial Sequence
  PCR primer for ORF amplification
caggagctgcacttccgtatggtttgaaacgacttttcat

SEQ ID NO: 12774 - DNA, 40 bp, Artificial Sequence
  PCR primer for ORF amplification
caggagctgcacttcccaggtaatgataatctagtgcttt

SEQ ID NO: 12775 - DNA, 40 bp, Artificial Sequence
  PCR primer for ORF amplification
caggagctgcacttcccatatatttccttgaatgcttcag

SEQ ID NO: 12776 - DNA, 40 bp, Artificial Sequence
  PCR primer for ORF amplification
caggagctgcacttccaacaacaacagtgccaggatcaat

SEQ ID NO: 12777 - DNA, 40 bp, Artificial Sequence
  PCR primer for ORF amplification
caggagctgcacttcctatcaatgacgatgccatgaataa

SEQ ID NO: 12778 - DNA, 40 bp, Artificial Sequence
  PCR primer for ORF amplification
caggagctgcacttccagtcaatatgtaatcaacactaag

SEQ ID NO: 12779 - DNA, 40 bp, Artificial Sequence
  PCR primer for ORF amplification
caggagctgcacttcctctggccacagtatgttttttgtg

SEQ ID NO: 12780 - DNA, 40 bp, Artificial Sequence
  PCR primer for ORF amplification
caggagctgcacttcctaaaatttccctcaatgttgtatt

SEQ ID NO: 12781 - DNA, 40 bp, Artificial Sequence
  PCR primer for ORF amplification
caggagctgcacttccatcttcatgtagatctaattcttc

SEQ ID NO: 12782 - DNA, 40 bp, Artificial Sequence
  PCR primer for ORF amplification
caggagctgcacttccattttgtttactggttttcttata

SEQ ID NO: 12783 - DNA, 40 bp, Artificial Sequence
  PCR primer for ORF amplification
caggagctgcacttccttttacttcttcaacagaggaaga

SEQ ID NO: 12784 - DNA, 40 bp, Artificial Sequence
  PCR primer for ORF amplification
caggagctgcacttccgcagacacagcatccaacatgctg

SEQ ID NO: 12785 - DNA, 40 bp, Artificial Sequence
  PCR primer for ORF amplification
caggagctgcacttcctcttcttttataaatacagggctt

SEQ ID NO: 12786 - DNA, 40 bp, Artificial Sequence
  PCR primer for ORF amplification
caggagctgcacttcctaaattgattatatacatcacaaa

SEQ ID NO: 12787 - DNA, 40 bp, Artificial Sequence
  PCR primer for ORF amplification
caggagctgcacttcctttgtttatcagtgtaacaagcat

SEQ ID NO: 12788 - DNA, 40 bp, Artificial Sequence
  PCR primer for ORF amplification
caggagctgcacttcctttcatggagaccaatttaacatc

SEQ ID NO: 12789 - DNA, 40 bp, Artificial Sequence
  PCR primer for ORF amplification
caggagctgcacttcctgcgtgttgcaatttttgctttag

SEQ ID NO: 12790 - DNA, 40 bp, Artificial Sequence
  PCR primer for ORF amplification
caggagctgcacttcctgttttttgctttttctcaacggt

SEQ ID NO: 12791 - DNA, 40 bp, Artificial Sequence
  PCR primer for ORF amplification
caggagctgcacttccctgcagaagttggtctctgtagtg

SEQ ID NO: 12792 - DNA, 40 bp, Artificial Sequence
  PCR primer for ORF amplification
caggagctgcacttccggagaaaaactttgatatattctt

SEQ ID NO: 12793 - DNA, 40 bp, Artificial Sequence
  PCR primer for ORF amplification
caggagctgcacttccagtagattcgtgattgccaaatac

SEQ ID NO: 12794 - DNA, 40 bp, Artificial Sequence
  PCR primer for ORF amplification
caggagctgcacttccacggtatcctcttgaaataagttc

SEQ ID NO: 12795 - DNA, 40 bp, Artificial Sequence
  PCR primer for ORF amplification
caggagctgcacttccaccgatatggttttgccaaccagc

SEQ ID NO: 12796 - DNA, 40 bp, Artificial Sequence
  PCR primer for ORF amplification
caggagctgcacttcctaaaatttctctcaatggaatact

SEQ ID NO: 12797 - DNA, 40 bp, Artificial Sequence
  PCR primer for ORF amplification
caggagctgcacttcccactaggcccctttctctttccaa

SEQ ID NO: 12798 - DNA, 40 bp, Artificial Sequence
  PCR primer for ORF amplification
caggagctgcacttccgttgtttgctgctggcacctccac

SEQ ID NO: 12799 - DNA, 40 bp, Artificial Sequence
  PCR primer for ORF amplification
caggagctgcacttccgtcctttttcgagctccagaattt

SEQ ID NO: 12800 - DNA, 40 bp, Artificial Sequence
  PCR primer for ORF amplification
caggagctgcacttccgatatttattacttcttctaatga

SEQ ID NO: 12801 - DNA, 40 bp, Artificial Sequence
  PCR primer for ORF amplification
caggagctgcacttcctgggaagaaaaatctcgtgtacca

SEQ ID NO: 12802 - DNA, 40 bp, Artificial Sequence
  PCR primer for ORF amplification
caggagctgcacttcctctacgtagtctatctcttgaaaa

SEQ ID NO: 12803 - DNA, 40 bp, Artificial Sequence
  PCR primer for ORF amplification
caggagctgcacttccgttcaagtcggcaacagtttttga

SEQ ID NO: 12804 - DNA, 40 bp, Artificial Sequence
  PCR primer for ORF amplification
caggagctgcacttcctaatcttgcatctttgcctcttgg

SEQ ID NO: 12805 - DNA, 40 bp, Artificial Sequence
  PCR primer for ORF amplification
caggagctgcacttccaacccagatggattggccacgagc

SEQ ID NO: 12806 - DNA, 40 bp, Artificial Sequence
  PCR primer for ORF amplification
caggagctgcacttcctttactgaagtaagaaggagcact

SEQ ID NO: 12807 - DNA, 40 bp, Artificial Sequence
  PCR primer for ORF amplification
caggagctgcacttccgttggtggcttgtttcaaggcttg

SEQ ID NO: 12808 - DNA, 40 bp, Artificial Sequence
  PCR primer for ORF amplification
caggagctgcacttccggccacttcgacaatttcatcttc

SEQ ID NO: 12809 - DNA, 40 bp, Artificial Sequence
  PCR primer for ORF amplification
caggagctgcacttccatcttttgaagagcaaagtgacct

SEQ ID NO: 12810 - DNA, 40 bp, Artificial Sequence
  PCR primer for ORF amplification
caggagctgcacttcctgtgaacttcgaagtactttgaaa

SEQ ID NO: 12811 - DNA, 40 bp, Artificial Sequence
  PCR primer for ORF amplification
caggagctgcacttcctttttcgttatttctggccaagcg

SEQ ID NO: 12812 - DNA, 40 bp, Artificial Sequence
  PCR primer for ORF amplification
caggagctgcacttccattcttaccagcaccagctctgaa

SEQ ID NO: 12813 - DNA, 40 bp, Artificial Sequence
  PCR primer for ORF amplification
caggagctgcacttccaatttgtgttaccttcaatttgaa

SEQ ID NO: 12814 - DNA, 40 bp, Artificial Sequence
  PCR primer for ORF amplification
caggagctgcacttcctatgttaaatcttgttgacaaatc

SEQ ID NO: 12815 - DNA, 40 bp, Artificial Sequence
  PCR primer for ORF amplification
caggagctgcacttcccaatttggtttcctctagtttcgt

SEQ ID NO: 12816 - DNA, 40 bp, Artificial Sequence
  PCR primer for ORF amplification
caggagctgcacttccctttttggagagtagtgcagtctt

SEQ ID NO: 12817 - DNA, 40 bp, Artificial Sequence
  PCR primer for ORF amplification
caggagctgcacttccctttgacaggaacgagactaaaga

SEQ ID NO: 12818 - DNA, 40 bp, Artificial Sequence
  PCR primer for ORF amplification
caggagctgcacttccgttcaacaaggtagcaatgtcgga

SEQ ID NO: 12819 - DNA, 40 bp, Artificial Sequence
  PCR primer for ORF amplification
caggagctgcacttccgttcaacaaagtagcgatgtcgga

SEQ ID NO: 12820 - DNA, 40 bp, Artificial Sequence
  PCR primer for ORF amplification
caggagctgcacttccccaatgtttaggttccatgccttc

SEQ ID NO: 12821 - DNA, 40 bp, Artificial Sequence
  PCR primer for ORF amplification
caggagctgcacttcctctatcatgtacttttcgagttaa

SEQ ID NO: 12822 - DNA, 40 bp, Artificial Sequence
  PCR primer for ORF amplification
caggagctgcacttccctctttgctatccaagacctgctt

SEQ ID NO: 12823 - DNA, 40 bp, Artificial Sequence
  PCR primer for ORF amplification
caggagctgcacttccatggttctcttcctctatgtgata

SEQ ID NO: 12824 - DNA, 40 bp, Artificial Sequence
  PCR primer for ORF amplification
caggagctgcacttcctattttaggttttttggcatctgg

SEQ ID NO: 12825 - DNA, 40 bp, Artificial Sequence
  PCR primer for ORF amplification
caggagctgcacttccagcgtttttctcagcaaattcctt

SEQ ID NO: 12826 - DNA, 40 bp, Artificial Sequence
  PCR primer for ORF amplification
caggagctgcacttcccttgtcgcccgcttcgtttttgta

SEQ ID NO: 12827 - DNA, 40 bp, Artificial Sequence
  PCR primer for ORF amplification
caggagctgcacttccttggttttctggtctcaactttct

SEQ ID NO: 12828 - DNA, 40 bp, Artificial Sequence
  PCR primer for ORF amplification
caggagctgcacttcccttgaatattgtcgcgaaagaatg

SEQ ID NO: 12829 - DNA, 40 bp, Artificial Sequence
  PCR primer for ORF amplification
caggagctgcacttccatgattttttttcatcacaaatac

SEQ ID NO: 12830 - DNA, 40 bp, Artificial Sequence
  PCR primer for ORF amplification
caggagctgcacttccttcctttggtagaccagtctttgc

SEQ ID NO: 12831 - DNA, 40 bp, Artificial Sequence
  PCR primer for ORF amplification
caggagctgcacttcctattttcttctgcaatttcatata

SEQ ID NO: 12832 - DNA, 40 bp, Artificial Sequence
  PCR primer for ORF amplification
caggagctgcacttccttgtgtgtagaaataaccttgtgg

SEQ ID NO: 12833 - DNA, 40 bp, Artificial Sequence
  PCR primer for ORF amplification
caggagctgcacttccagtactatttaaaatcttgcctac

SEQ ID NO: 12834 - DNA, 40 bp, Artificial Sequence
  PCR primer for ORF amplification
caggagctgcacttccgttgagcacatacttaccatcacc

SEQ ID NO: 12835 - DNA, 40 bp, Artificial Sequence
  PCR primer for ORF amplification
caggagctgcacttcctttctgctccacctttggagtatt

SEQ ID NO: 12836 - DNA, 40 bp, Artificial Sequence
  PCR primer for ORF amplification
caggagctgcacttccattgttgccgttattattagagta

SEQ ID NO: 12837 - DNA, 40 bp, Artificial Sequence
  PCR primer for ORF amplification
caggagctgcacttccaatcaaaaccacttgcgtaaaggc

SEQ ID NO: 12838 - DNA, 40 bp, Artificial Sequence
  PCR primer for ORF amplification
caggagctgcacttccaaaaataaaacaataaagtttata

SEQ ID NO: 12839 - DNA, 40 bp, Artificial Sequence
  PCR primer for ORF amplification
caggagctgcacttcccaagaaatccatgttcagaccacc

SEQ ID NO: 12840 - DNA, 40 bp, Artificial Sequence
  PCR primer for ORF amplification
caggagctgcacttcctatcgtcacatccaacacgctccc

SEQ ID NO: 12841 - DNA, 40 bp, Artificial Sequence
  PCR primer for ORF amplification
caggagctgcacttccccatcttttcccgatcactttctc

SEQ ID NO: 12842 - DNA, 40 bp, Artificial Sequence
  PCR primer for ORF amplification
caggagctgcacttccagcaaatccgttgctttcaattag

SEQ ID NO: 12843 - DNA, 40 bp, Artificial Sequence
  PCR primer for ORF amplification
caggagctgcacttcctttaccgccagcttctctaaacca

SEQ ID NO: 12844 - DNA, 40 bp, Artificial Sequence
  PCR primer for ORF amplification
caggagctgcacttccgaagtcccggaaaagatcagcata

SEQ ID NO: 12845 - DNA, 40 bp, Artificial Sequence
  PCR primer for ORF amplification
caggagctgcacttccctcttccaggtttgagtacgcttc

SEQ ID NO: 12846 - DNA, 40 bp, Artificial Sequence
  PCR primer for ORF amplification
caggagctgcacttccaagtaggtcatccaaagcatcatt

SEQ ID NO: 12847 - DNA, 40 bp, Artificial Sequence
  PCR primer for ORF amplification
caggagctgcacttccaataaagtttaatttaactttaat

SEQ ID NO: 12848 - DNA, 40 bp, Artificial Sequence
  PCR primer for ORF amplification
caggagctgcacttcctttgtattcaaaaattctggcatc

SEQ ID NO: 12849 - DNA, 40 bp, Artificial Sequence
  PCR primer for ORF amplification
caggagctgcacttccgtcggcatgatcgctgaatagaat

SEQ ID NO: 12850 - DNA, 40 bp, Artificial Sequence
  PCR primer for ORF amplification
caggagctgcacttccaaattctttcattaaatccatata

SEQ ID NO: 12851 - DNA, 40 bp, Artificial Sequence
  PCR primer for ORF amplification
caggagctgcacttccgtgtttgcacttaaaataattttt

SEQ ID NO: 12852 - DNA, 40 bp, Artificial Sequence
  PCR primer for ORF amplification
caggagctgcacttcctatcttttcaatgacaatagagga

SEQ ID NO: 12853 - DNA, 40 bp, Artificial Sequence
  PCR primer for ORF amplification
caggagctgcacttccaatgtcaatttcttcagtttctag

SEQ ID NO: 12854 - DNA, 40 bp, Artificial Sequence
  PCR primer for ORF amplification
caggagctgcacttccgattagtagcttcctaatacctgt

SEQ ID NO: 12855 - DNA, 40 bp, Artificial Sequence
  PCR primer for ORF amplification
caggagctgcacttccgtcctctactttaacagaaatatc

SEQ ID NO: 12856 - DNA, 40 bp, Artificial Sequence
  PCR primer for ORF amplification
caggagctgcacttccaaagtcttcgttgaaggtgaaagc

SEQ ID NO: 12857 - DNA, 40 bp, Artificial Sequence
  PCR primer for ORF amplification
caggagctgcacttccaacttgcacggttgacatctttgg

SEQ ID NO: 12858 - DNA, 40 bp, Artificial Sequence
  PCR primer for ORF amplification
caggagctgcacttcctgataattctgcaaaatttgctgg

SEQ ID NO: 12859 - DNA, 40 bp, Artificial Sequence
  PCR primer for ORF amplification
caggagctgcacttcctcttgaatcaggtgaagttgaatg

SEQ ID NO: 12860 - DNA, 40 bp, Artificial Sequence
  PCR primer for ORF amplification
caggagctgcacttccaaaccaacagaatttggtattgtt

SEQ ID NO: 12861 - DNA, 40 bp, Artificial Sequence
  PCR primer for ORF amplification
caggagctgcacttccaacgacatcttccatttctatttc

SEQ ID NO: 12862 - DNA, 40 bp, Artificial Sequence
  PCR primer for ORF amplification
caggagctgcacttccgttcttgttccaacctaaatctac

SEQ ID NO: 12863 - DNA, 40 bp, Artificial Sequence
  PCR primer for ORF amplification
caggagctgcacttccatttttgtcccaaccgagttttag

SEQ ID NO: 12864 - DNA, 40 bp, Artificial Sequence
  PCR primer for ORF amplification
caggagctgcacttcctgattcattggtggggttcgactt

SEQ ID NO: 12865 - DNA, 40 bp, Artificial Sequence
  PCR primer for ORF amplification
caggagctgcacttcccttcacatcatccgttctggtggg

SEQ ID NO: 12866 - DNA, 40 bp, Artificial Sequence
  PCR primer for ORF amplification
caggagctgcacttccctgcttgtagtaatgtgtgggcac

SEQ ID NO: 12867 - DNA, 40 bp, Artificial Sequence
  PCR primer for ORF amplification
caggagctgcacttccctcgtcttcttctctggggtcacc

SEQ ID NO: 12868 - DNA, 40 bp, Artificial Sequence
  PCR primer for ORF amplification
caggagctgcacttcctgtattttgcacggttttgtgttg

SEQ ID NO: 12869 - DNA, 40 bp, Artificial Sequence
  PCR primer for ORF amplification
caggagctgcacttccaaaaaatataggaatatcctttgt

SEQ ID NO: 12870 - DNA, 40 bp, Artificial Sequence
  PCR primer for ORF amplification
caggagctgcacttccgcttattatatccttgttcacctt

SEQ ID NO: 12871 - DNA, 40 bp, Artificial Sequence
  PCR primer for ORF amplification
caggagctgcacttccttctttgtttccaagaacttgctt

SEQ ID NO: 12872 - DNA, 40 bp, Artificial Sequence
  PCR primer for ORF amplification
caggagctgcacttccagccctctttacacctagtgacgt

SEQ ID NO: 12873 - DNA, 40 bp, Artificial Sequence
  PCR primer for ORF amplification
caggagctgcacttcccaggaaaactaacttttcactcag

SEQ ID NO: 12874 - DNA, 40 bp, Artificial Sequence
  PCR primer for ORF amplification
caggagctgcacttcccatacctaaagccactccttcgta

SEQ ID NO: 12875 - DNA, 40 bp, Artificial Sequence
  PCR primer for ORF amplification
caggagctgcacttccatcgtgcgtatccagtcgccatct

SEQ ID NO: 12876 - DNA, 40 bp, Artificial Sequence
  PCR primer for ORF amplification
caggagctgcacttcccgtggagtgtagcaccgccaaaga

SEQ ID NO: 12877 - DNA, 40 bp, Artificial Sequence
  PCR primer for ORF amplification
caggagctgcacttccaaaataattaccgcaattgtgggt

SEQ ID NO: 12878 - DNA, 40 bp, Artificial Sequence
  PCR primer for ORF amplification
caggagctgcacttccgtctaagaatggtgaagtgatgtt

SEQ ID NO: 12879 - DNA, 40 bp, Artificial Sequence
  PCR primer for ORF amplification
caggagctgcacttccttttttgttattaatgaagtttga

SEQ ID NO: 12880 - DNA, 40 bp, Artificial Sequence
  PCR primer for ORF amplification
caggagctgcacttccctcaggacgtattttcgcttttat

SEQ ID NO: 12881 - DNA, 40 bp, Artificial Sequence
  PCR primer for ORF amplification
caggagctgcacttcccacctgttcgatttttctttttag

SEQ ID NO: 12882 - DNA, 40 bp, Artificial Sequence
  PCR primer for ORF amplification
caggagctgcacttcccttatttagagaaatagatactga

SEQ ID NO: 12883 - DNA, 40 bp, Artificial Sequence
  PCR primer for ORF amplification
caggagctgcacttccgttgttctttttgttggaaactgt

SEQ ID NO: 12884 - DNA, 40 bp, Artificial Sequence
  PCR primer for ORF amplification
caggagctgcacttccaggtttggattcctcattcaatgg

SEQ ID NO: 12885 - DNA, 40 bp, Artificial Sequence
  PCR primer for ORF amplification
caggagctgcacttccattagattttttcaaatcattctt

SEQ ID NO: 12886 - DNA, 40 bp, Artificial Sequence
  PCR primer for ORF amplification
caggagctgcacttccgtcaaacttcactttcttaccttg

SEQ ID NO: 12887 - DNA, 40 bp, Artificial Sequence
  PCR primer for ORF amplification
caggagctgcacttccccactcgacgttgtcagcattttc

SEQ ID NO: 12888 - DNA, 40 bp, Artificial Sequence
  PCR primer for ORF amplification
caggagctgcacttccccttaagtttgtccaagtgaaaaa

SEQ ID NO: 12889 - DNA, 40 bp, Artificial Sequence
  PCR primer for ORF amplification
caggagctgcacttccaagagagtcggctttaacgtggag

SEQ ID NO: 12890 - DNA, 40 bp, Artificial Sequence
  PCR primer for ORF amplification
caggagctgcacttcctgaatagttagagtaccacagtag

SEQ ID NO: 12891 - DNA, 40 bp, Artificial Sequence
  PCR primer for ORF amplification
caggagctgcacttcctttttcccacttgttttgacttgg

SEQ ID NO: 12892 - DNA, 40 bp, Artificial Sequence
  PCR primer for ORF amplification
caggagctgcacttccttttccgtcaattttcaatcttgc

SEQ ID NO: 12893 - DNA, 40 bp, Artificial Sequence
  PCR primer for ORF amplification
caggagctgcacttccactattgtccaattgtgcccattt

SEQ ID NO: 12894 - DNA, 40 bp, Artificial Sequence
  PCR primer for ORF amplification
caggagctgcacttccatttctattgttccatatataata

SEQ ID NO: 12895 - DNA, 40 bp, Artificial Sequence
  PCR primer for ORF amplification
caggagctgcacttccctgaaatcttgttctttgcttgtt

SEQ ID NO: 12896 - DNA, 40 bp, Artificial Sequence
  PCR primer for ORF amplification
caggagctgcacttccgtccttgctatccacgttgtcctg

SEQ ID NO: 12897 - DNA, 40 bp, Artificial Sequence
  PCR primer for ORF amplification
caggagctgcacttccaattcctggtggaagcttgtaatt

SEQ ID NO: 12898 - DNA, 40 bp, Artificial Sequence
  PCR primer for ORF amplification
caggagctgcacttcctttcttaattttcccaccggcggc

SEQ ID NO: 12899 - DNA, 40 bp, Artificial Sequence
  PCR primer for ORF amplification
caggagctgcacttcccttgaacagcttggcgacagaaat

SEQ ID NO: 12900 - DNA, 40 bp, Artificial Sequence
  PCR primer for ORF amplification
caggagctgcacttccagtcatgaatttagagataaatgc

SEQ ID NO: 12901 - DNA, 40 bp, Artificial Sequence
  PCR primer for ORF amplification
caggagctgcacttccctgggcccactggtggaagtcgtc

SEQ ID NO: 12902 - DNA, 40 bp, Artificial Sequence
  PCR primer for ORF amplification
caggagctgcacttccgtagcggttctggttgccgttatt

SEQ ID NO: 12903 - DNA, 40 bp, Artificial Sequence
  PCR primer for ORF amplification
caggagctgcacttcctagcgttaccgcctgtgcctgaga

SEQ ID NO: 12904 - DNA, 40 bp, Artificial Sequence
  PCR primer for ORF amplification
caggagctgcacttccttcgtcgtcttcttcatcatcgtc

SEQ ID NO: 12905 - DNA, 40 bp, Artificial Sequence
  PCR primer for ORF amplification
caggagctgcacttccaattgctttggccaaaccaaccgc

SEQ ID NO: 12906 - DNA, 40 bp, Artificial Sequence
  PCR primer for ORF amplification
caggagctgcacttccgttatgagtgaatttttcggccgg

SEQ ID NO: 12907 - DNA, 40 bp, Artificial Sequence
  PCR primer for ORF amplification
caggagctgcacttcccatcagtaatcctgccggtccatt

SEQ ID NO: 12908 - DNA, 40 bp, Artificial Sequence
  PCR primer for ORF amplification
caggagctgcacttccgtgtatatcttcttcggtcttatc

SEQ ID NO: 12909 - DNA, 40 bp, Artificial Sequence
  PCR primer for ORF amplification
caggagctgcacttccatcttggaatttgtatgaaccact

SEQ ID NO: 12910 - DNA, 40 bp, Artificial Sequence
  PCR primer for ORF amplification
caggagctgcacttccttcatcgtcactgtctcctagaac

SEQ ID NO: 12911 - DNA, 40 bp, Artificial Sequence
  PCR primer for ORF amplification
caggagctgcacttccaccttcactatcataaattatctc

SEQ ID NO: 12912 - DNA, 40 bp, Artificial Sequence
  PCR primer for ORF amplification
caggagctgcacttccttttaaatgggatttttttacttg

SEQ ID NO: 12913 - DNA, 40 bp, Artificial Sequence
  PCR primer for ORF amplification
caggagctgcacttcctagctggtccgttctccaaccatc

SEQ ID NO: 12914 - DNA, 40 bp, Artificial Sequence
  PCR primer for ORF amplification
caggagctgcacttcccacgggaggcgcctgtttgcgggt

SEQ ID NO: 12915 - DNA, 40 bp, Artificial Sequence
  PCR primer for ORF amplification
caggagctgcacttccatcatcttttctactcttgttctg

SEQ ID NO: 12916 - DNA, 40 bp, Artificial Sequence
  PCR primer for ORF amplification
caggagctgcacttccaaaggggtcgctactaagtatact

SEQ ID NO: 12917 - DNA, 40 bp, Artificial Sequence
  PCR primer for ORF amplification
caggagctgcacttccattgataaatgtactttcaatgat

SEQ ID NO: 12918 - DNA, 40 bp, Artificial Sequence
  PCR primer for ORF amplification
caggagctgcacttcctttgatttcagtttcagctaaacg

SEQ ID NO: 12919 - DNA, 40 bp, Artificial Sequence
  PCR primer for ORF amplification
caggagctgcacttccatgttgttgcataaaattttctga

SEQ ID NO: 12920 - DNA, 40 bp, Artificial Sequence
  PCR primer for ORF amplification
caggagctgcacttccgtgctttttactagttttcaagct

SEQ ID NO: 12921 - DNA, 40 bp, Artificial Sequence
  PCR primer for ORF amplification
caggagctgcacttccttccatcctacaccaaggtctgtc

SEQ ID NO: 12922 - DNA, 40 bp, Artificial Sequence
  PCR primer for ORF amplification
caggagctgcacttccaaaggaaagtaaatcgatttcttt

SEQ ID NO: 12923 - DNA, 40 bp, Artificial Sequence
  PCR primer for ORF amplification
caggagctgcacttcccgttctcgattcccactgaacttt

SEQ ID NO: 12924 - DNA, 40 bp, Artificial Sequence
  PCR primer for ORF amplification
caggagctgcacttccaacttttagagaaccattgtagtc

SEQ ID NO: 12925 - DNA, 40 bp, Artificial Sequence
  PCR primer for ORF amplification
caggagctgcacttccgaaatctaaagaagccggttcatc

SEQ ID NO: 12926 - DNA, 40 bp, Artificial Sequence
  PCR primer for ORF amplification
caggagctgcacttccatttgcaagcttacttaacaagtc

SEQ ID NO: 12927 - DNA, 40 bp, Artificial Sequence
  PCR primer for ORF amplification
caggagctgcacttcccaggagctgtctaaccagagcact

SEQ ID NO: 12928 - DNA, 40 bp, Artificial Sequence
  PCR primer for ORF amplification
caggagctgcacttcctgctatatttaagagggaaaatag

SEQ ID NO: 12929 - DNA, 40 bp, Artificial Sequence
  PCR primer for ORF amplification
caggagctgcacttccttgagatgcacattgaacaccttc

SEQ ID NO: 12930 - DNA, 40 bp, Artificial Sequence
  PCR primer for ORF amplification
caggagctgcacttccgctgagccttggaggtggtctttt

SEQ ID NO: 12931 - DNA, 40 bp, Artificial Sequence
  PCR primer for ORF amplification
caggagctgcacttcctgtgtaactgtcaatattctccaa

SEQ ID NO: 12932 - DNA, 40 bp, Artificial Sequence
  PCR primer for ORF amplification
caggagctgcacttccaggctgcgttctagaagggctagt

SEQ ID NO: 12933 - DNA, 40 bp, Artificial Sequence
  PCR primer for ORF amplification
caggagctgcacttcctttatgcttcttgtttaatcttga

SEQ ID NO: 12934 - DNA, 40 bp, Artificial Sequence
  PCR primer for ORF amplification
caggagctgcacttccaaatgattctaactcccttacgta

SEQ ID NO: 12935 - DNA, 40 bp, Artificial Sequence
  PCR primer for ORF amplification
caggagctgcacttccgttagcagtcataacttgccaaac

SEQ ID NO: 12936 - DNA, 40 bp, Artificial Sequence
  PCR primer for ORF amplification
caggagctgcacttccatggtggtatttaccttccccgag

SEQ ID NO: 12937 - DNA, 40 bp, Artificial Sequence
  PCR primer for ORF amplification
caggagctgcacttcctatctcctcaataatagagtttcc

SEQ ID NO: 12938 - DNA, 40 bp, Artificial Sequence
  PCR primer for ORF amplification
caggagctgcacttccttcacacttttccttagattcttc

SEQ ID NO: 12939 - DNA, 40 bp, Artificial Sequence
  PCR primer for ORF amplification
caggagctgcacttcctgctgatcttggagcgatcttgaa

SEQ ID NO: 12940 - DNA, 40 bp, Artificial Sequence
  PCR primer for ORF amplification
caggagctgcacttccattagtgtacaggtcataggttgc

SEQ ID NO: 12941 - DNA, 40 bp, Artificial Sequence
  PCR primer for ORF amplification
caggagctgcacttcccatctcgtcgtcactattgattaa

SEQ ID NO: 12942 - DNA, 40 bp, Artificial Sequence
  PCR primer for ORF amplification
caggagctgcacttccgaccaacgacttggagtaagagaa

SEQ ID NO: 12943 - DNA, 40 bp, Artificial Sequence
  PCR primer for ORF amplification
caggagctgcacttcctaaactatttccaatagagtcaag

SEQ ID NO: 12944 - DNA, 40 bp, Artificial Sequence
  PCR primer for ORF amplification
caggagctgcacttccgaacaacactctttccttggccaa

SEQ ID NO: 12945 - DNA, 40 bp, Artificial Sequence
  PCR primer for ORF amplification
caggagctgcacttccgaaaaggctttccagttgaaattc

SEQ ID NO: 12946 - DNA, 40 bp, Artificial Sequence
  PCR primer for ORF amplification
caggagctgcacttccgtttttcatagaaaccaatttaac

SEQ ID NO: 12947 - DNA, 40 bp, Artificial Sequence
  PCR primer for ORF amplification
caggagctgcacttccactatctgattgttctttcttatt

SEQ ID NO: 12948 - DNA, 40 bp, Artificial Sequence
  PCR primer for ORF amplification
caggagctgcacttcctatttcttcccaagtaaatggcct

SEQ ID NO: 12949 - DNA, 40 bp, Artificial Sequence
  PCR primer for ORF amplification
caggagctgcacttcccaatgcagctgcctcgaactcttt

SEQ ID NO: 12950 - DNA, 40 bp, Artificial Sequence
  PCR primer for ORF amplification
caggagctgcacttcctttacaagttagaatattatctat

SEQ ID NO: 12951 - DNA, 40 bp, Artificial Sequence
  PCR primer for ORF amplification
caggagctgcacttccgccttgtaagaaattgtccaggac

SEQ ID NO: 12952 - DNA, 40 bp, Artificial Sequence
  PCR primer for ORF amplification
caggagctgcacttccagcaaacgtgatacgtggatggta

SEQ ID NO: 12953 - DNA, 40 bp, Artificial Sequence
  PCR primer for ORF amplification
caggagctgcacttccaatatccaaagttaatgaagaagg

SEQ ID NO: 12954 - DNA, 40 bp, Artificial Sequence
  PCR primer for ORF amplification
caggagctgcacttcctttcttcaacagttcgtgaacgga

SEQ ID NO: 12955 - DNA, 40 bp, Artificial Sequence
  PCR primer for ORF amplification
caggagctgcacttccacagtctatcaaatcgatagcttc

SEQ ID NO: 12956 - DNA, 40 bp, Artificial Sequence
  PCR primer for ORF amplification
caggagctgcacttcccaaatggaagaggcgtcgtttcca

SEQ ID NO: 12957 - DNA, 40 bp, Artificial Sequence
  PCR primer for ORF amplification
caggagctgcacttccattacgtgaccagctatacatttc

SEQ ID NO: 12958 - DNA, 40 bp, Artificial Sequence
  PCR primer for ORF amplification
caggagctgcacttcctaagtacttcgtaaaattcgaatc

SEQ ID NO: 12959 - DNA, 40 bp, Artificial Sequence
  PCR primer for ORF amplification
caggagctgcacttccgaggggcgaccttcttttacgttc

SEQ ID NO: 12960 - DNA, 40 bp, Artificial Sequence
  PCR primer for ORF amplification
caggagctgcacttccgttactctccaataattcttttgc

SEQ ID NO: 12961 - DNA, 40 bp, Artificial Sequence
  PCR primer for ORF amplification
caggagctgcacttcctttagaatcggataggtcaaactc

SEQ ID NO: 12962 - DNA, 40 bp, Artificial Sequence
  PCR primer for ORF amplification
caggagctgcacttcccacaatcatatcaatttgataact

SEQ ID NO: 12963 - DNA, 40 bp, Artificial Sequence
  PCR primer for ORF amplification
caggagctgcacttccctttgtagcatctagatcatcatt

SEQ ID NO: 12964 - DNA, 40 bp, Artificial Sequence
  PCR primer for ORF amplification
caggagctgcacttccatcaaatgttttctttgaaccagc

SEQ ID NO: 12965 - DNA, 40 bp, Artificial Sequence
  PCR primer for ORF amplification
caggagctgcacttcctttcatattccatgacaaacttga

SEQ ID NO: 12966 - DNA, 40 bp, Artificial Sequence
  PCR primer for ORF amplification
caggagctgcacttcctttcatgtttcttttcttcaaaac

SEQ ID NO: 12967 - DNA, 40 bp, Artificial Sequence
  PCR primer for ORF amplification
caggagctgcacttcccctggttggtgatctttcacgtgg

SEQ ID NO: 12968 - DNA, 40 bp, Artificial Sequence
  PCR primer for ORF amplification
caggagctgcacttccatcattatcagtctgtctcttggt

SEQ ID NO: 12969 - DNA, 40 bp, Artificial Sequence
  PCR primer for ORF amplification
caggagctgcacttccctggctcttcttgccccagatcga

SEQ ID NO: 12970 - DNA, 40 bp, Artificial Sequence
  PCR primer for ORF amplification
caggagctgcacttccgagttcttcccaagtcagggcttt

SEQ ID NO: 12971 - DNA, 40 bp, Artificial Sequence
  PCR primer for ORF amplification
caggagctgcacttccactaatgaaggtgctctcaacgat

SEQ ID NO: 12972 - DNA, 40 bp, Artificial Sequence
  PCR primer for ORF amplification
caggagctgcacttcccgaggactctatgggcgtataaag

SEQ ID NO: 12973 - DNA, 40 bp, Artificial Sequence
  PCR primer for ORF amplification
caggagctgcacttccttcttcctgtttgattttcgcctc

SEQ ID NO: 12974 - DNA, 40 bp, Artificial Sequence
  PCR primer for ORF amplification
caggagctgcacttccacgtcttggacctcttcctcttct

SEQ ID NO: 12975 - DNA, 40 bp, Artificial Sequence
  PCR primer for ORF amplification
caggagctgcacttccttttaagaccttaccgtcaacaat

SEQ ID NO: 12976 - DNA, 40 bp, Artificial Sequence
  PCR primer for ORF amplification
caggagctgcacttccatattttgatattaaggctgggtc

SEQ ID NO: 12977 - DNA, 40 bp, Artificial Sequence
  PCR primer for ORF amplification
caggagctgcacttccttttttacttaatttcatccattt

SEQ ID NO: 12978 - DNA, 40 bp, Artificial Sequence
  PCR primer for ORF amplification
caggagctgcacttccatgtcttgtaggatcattgagctt

SEQ ID NO: 12979 - DNA, 40 bp, Artificial Sequence
  PCR primer for ORF amplification
caggagctgcacttccttcccgttttactgatcttttctt

SEQ ID NO: 12980 - DNA, 40 bp, Artificial Sequence
  PCR primer for ORF amplification
caggagctgcacttccatctactaggcgaacacctaaatt

SEQ ID NO: 12981 - DNA, 40 bp, Artificial Sequence
  PCR primer for ORF amplification
caggagctgcacttcctttcttttcggataagaaagcaac

SEQ ID NO: 12982 - DNA, 40 bp, Artificial Sequence
  PCR primer for ORF amplification
caggagctgcacttccaggattcttcacgttgtaatttaa

SEQ ID NO: 12983 - DNA, 40 bp, Artificial Sequence
  PCR primer for ORF amplification
caggagctgcacttccaggattacttaagttatacaaagc

SEQ ID NO: 12984 - DNA, 40 bp, Artificial Sequence
  PCR primer for ORF amplification
caggagctgcacttcctgtgtgacgcagtttagcctcgtt

SEQ ID NO: 12985 - DNA, 40 bp, Artificial Sequence
  PCR primer for ORF amplification
caggagctgcacttcctgaagtggtggcatcgcttagatg

SEQ ID NO: 12986 - DNA, 40 bp, Artificial Sequence
  PCR primer for ORF amplification
caggagctgcacttcctgcatgggtgtcattattattaac

SEQ ID NO: 12987 - DNA, 40 bp, Artificial Sequence
  PCR primer for ORF amplification
caggagctgcacttccctgttgccttaattgagtaatttg

SEQ ID NO: 12988 - DNA, 40 bp, Artificial Sequence
  PCR primer for ORF amplification
caggagctgcacttccttgcaatggtgtatacagtatttg

SEQ ID NO: 12989 - DNA, 40 bp, Artificial Sequence
  PCR primer for ORF amplification
caggagctgcacttccatgtgtcttttcattagtgagagc

SEQ ID NO: 12990 - DNA, 40 bp, Artificial Sequence
  PCR primer for ORF amplification
caggagctgcacttcctgactgcttgcattcaggagcctg

SEQ ID NO: 12991 - DNA, 40 bp, Artificial Sequence
  PCR primer for ORF amplification
caggagctgcacttccaacgcaacaaattgattgattatt

SEQ ID NO: 12992 - DNA, 40 bp, Artificial Sequence
  PCR primer for ORF amplification
caggagctgcacttccttctttaataaagatggcggcggc

SEQ ID NO: 12993 - DNA, 40 bp, Artificial Sequence
  PCR primer for ORF amplification
caggagctgcacttccacaagccattgatgacctactttg

SEQ ID NO: 12994 - DNA, 40 bp, Artificial Sequence
  PCR primer for ORF amplification
caggagctgcacttccgttcctctggaatatatcgctaga

SEQ ID NO: 12995 - DNA, 40 bp, Artificial Sequence
  PCR primer for ORF amplification
caggagctgcacttcccccaactatcttcaattctgcatc

SEQ ID NO: 12996 - DNA, 40 bp, Artificial Sequence
  PCR primer for ORF amplification
caggagctgcacttccaatatcctttttcgttggagtact

SEQ ID NO: 12997 - DNA, 40 bp, Artificial Sequence
  PCR primer for ORF amplification
caggagctgcacttcccaatttagcttcaatagtatagaa

SEQ ID NO: 12998 - DNA, 40 bp, Artificial Sequence
  PCR primer for ORF amplification
caggagctgcacttccctctccaaatatcttacaggtcgt

SEQ ID NO: 12999 - DNA, 40 bp, Artificial Sequence
  PCR primer for ORF amplification
caggagctgcacttccattgcgaacgatttgcctatataa

SEQ ID NO: 13000 - DNA, 40 bp, Artificial Sequence
  PCR primer for ORF amplification
caggagctgcacttccgttgtatagaacaaacttagcttt

SEQ ID NO: 13001 - DNA, 40 bp, Artificial Sequence
  PCR primer for ORF amplification
caggagctgcacttcctagtttgcacatacctttcttgtc

SEQ ID NO: 13002 - DNA, 40 bp, Artificial Sequence
  PCR primer for ORF amplification
caggagctgcacttcctagcatatctggtggatcgtctct

SEQ ID NO: 13003 - DNA, 40 bp, Artificial Sequence
  PCR primer for ORF amplification
caggagctgcacttccatccctagaggcaaaaccttgctt

SEQ ID NO: 13004 - DNA, 40 bp, Artificial Sequence
  PCR primer for ORF amplification
caggagctgcacttccaaggtcgccaagaccagatatgga

SEQ ID NO: 13005 - DNA, 40 bp, Artificial Sequence
  PCR primer for ORF amplification
caggagctgcacttcccaaagtcaactcttcacctttggt

SEQ ID NO: 13006 - DNA, 40 bp, Artificial Sequence
  PCR primer for ORF amplification
caggagctgcacttcccatgcccgtaactagtgcttgcga

SEQ ID NO: 13007 - DNA, 40 bp, Artificial Sequence
  PCR primer for ORF amplification
caggagctgcacttccatcagtgagtttgtcatcaatgga

SEQ ID NO: 13008 - DNA, 40 bp, Artificial Sequence
  PCR primer for ORF amplification
caggagctgcacttccctcttttagggtgtattcagtgtt

SEQ ID NO: 13009 - DNA, 40 bp, Artificial Sequence
  PCR primer for ORF amplification
caggagctgcacttccgtagtcatcacctttcgaaacgac

SEQ ID NO: 13010 - DNA, 40 bp, Artificial Sequence
  PCR primer for ORF amplification
caggagctgcacttcctgagaactcaaaaagtaactgaaa

SEQ ID NO: 13011 - DNA, 40 bp, Artificial Sequence
  PCR primer for ORF amplification
caggagctgcacttccgagttcatctctgaaattttttat

SEQ ID NO: 13012 - DNA, 40 bp, Artificial Sequence
  PCR primer for ORF amplification
caggagctgcacttcctgtttctatatccgtttccgattc

SEQ ID NO: 13013 - DNA, 40 bp, Artificial Sequence
  PCR primer for ORF amplification
caggagctgcacttccaagcataacaaaacgaaccttttt

SEQ ID NO: 13014 - DNA, 40 bp, Artificial Sequence
  PCR primer for ORF amplification
caggagctgcacttcctgtcagcttggagcgcttgatgga

SEQ ID NO: 13015 - DNA, 40 bp, Artificial Sequence
  PCR primer for ORF amplification
caggagctgcacttccctgtagggattcttcttgatctga

SEQ ID NO: 13016 - DNA, 40 bp, Artificial Sequence
  PCR primer for ORF amplification
caggagctgcacttcccgaatgtccaacaaggtttcctgc

SEQ ID NO: 13017 - DNA, 40 bp, Artificial Sequence
  PCR primer for ORF amplification
caggagctgcacttccttttgaccgtttccaagaactcaa

SEQ ID NO: 13018 - DNA, 40 bp, Artificial Sequence
  PCR primer for ORF amplification
caggagctgcacttccgatttgaggtgtgactactatttt

SEQ ID NO: 13019 - DNA, 40 bp, Artificial Sequence
  PCR primer for ORF amplification
caggagctgcacttccagatttcttgattttctggtacat

SEQ ID NO: 13020 - DNA, 40 bp, Artificial Sequence
  PCR primer for ORF amplification
caggagctgcacttcctgcccatttccctagaagagccat

SEQ ID NO: 13021 - DNA, 40 bp, Artificial Sequence
  PCR primer for ORF amplification
caggagctgcacttcctttttttgagttgaatctactcgg

SEQ ID NO: 13022 - DNA, 40 bp, Artificial Sequence
  PCR primer for ORF amplification
caggagctgcacttccaaattgcggagggaaagcgatgtt

SEQ ID NO: 13023 - DNA, 40 bp, Artificial Sequence
  PCR primer for ORF amplification
caggagctgcacttcctagactatcgtctactttttccca

SEQ ID NO: 13024 - DNA, 40 bp, Artificial Sequence
  PCR primer for ORF amplification
caggagctgcacttccagctttcacgtccttctttttatc

SEQ ID NO: 13025 - DNA, 40 bp, Artificial Sequence
  PCR primer for ORF amplification
caggagctgcacttcctatgcgtctatttatgtaggatga

SEQ ID NO: 13026 - DNA, 40 bp, Artificial Sequence
  PCR primer for ORF amplification
caggagctgcacttcctttcctagtgcagaataacttggc

SEQ ID NO: 13027 - DNA, 40 bp, Artificial Sequence
  PCR primer for ORF amplification
caggagctgcacttcctttgctatggggaaagggctcctt

SEQ ID NO: 13028 - DNA, 40 bp, Artificial Sequence
  PCR primer for ORF amplification
caggagctgcacttccttgaatatctttcgtagctaccaa

SEQ ID NO: 13029 - DNA, 40 bp, Artificial Sequence
  PCR primer for ORF amplification
caggagctgcacttccaaacagcagttctgtattcaaagc

SEQ ID NO: 13030 - DNA, 40 bp, Artificial Sequence
  PCR primer for ORF amplification
caggagctgcacttccttgataacctggagaccatatttt

SEQ ID NO: 13031 - DNA, 40 bp, Artificial Sequence
  PCR primer for ORF amplification
caggagctgcacttcctgcccatctttgcacgacaacgga

SEQ ID NO: 13032 - DNA, 40 bp, Artificial Sequence
  PCR primer for ORF amplification
caggagctgcacttccgaccttattttgatggggagctgc

SEQ ID NO: 13033 - DNA, 40 bp, Artificial Sequence
  PCR primer for ORF amplification
caggagctgcacttccagcgtaaaccgcttcaatagcctt

SEQ ID NO: 13034 - DNA, 40 bp, Artificial Sequence
  PCR primer for ORF amplification
caggagctgcacttccaatttcttttggatgtttaattga

SEQ ID NO: 13035 - DNA, 40 bp, Artificial Sequence
  PCR primer for ORF amplification
caggagctgcacttccgttcgctgattgtttcttcttctg

SEQ ID NO: 13036 - DNA, 40 bp, Artificial Sequence
  PCR primer for ORF amplification
caggagctgcacttccggattgcataaactcaagaatgcg

SEQ ID NO: 13037 - DNA, 40 bp, Artificial Sequence
  PCR primer for ORF amplification
caggagctgcacttcctaacagatcgatacacttggcaat

SEQ ID NO: 13038 - DNA, 40 bp, Artificial Sequence
  PCR primer for ORF amplification
caggagctgcacttccctctagtatatagtttcctagttt

SEQ ID NO: 13039 - DNA, 40 bp, Artificial Sequence
  PCR primer for ORF amplification
caggagctgcacttccgattatatattcttttctaaagtt

SEQ ID NO: 13040 - DNA, 40 bp, Artificial Sequence
  PCR primer for ORF amplification
caggagctgcacttccttcaatcgcatgtttcggagtttc

SEQ ID NO: 13041 - DNA, 40 bp, Artificial Sequence
  PCR primer for ORF amplification
caggagctgcacttcctgaatcgtgtttgaggaagtattt

SEQ ID NO: 13042 - DNA, 40 bp, Artificial Sequence
  PCR primer for ORF amplification
caggagctgcacttccttttttatttcgtagcctgctgga

SEQ ID NO: 13043 - DNA, 40 bp, Artificial Sequence
  PCR primer for ORF amplification
caggagctgcacttccggattgggccccgtgaacaaccat

SEQ ID NO: 13044 - DNA, 40 bp, Artificial Sequence
  PCR primer for ORF amplification
caggagctgcacttcctgatgactgcatcttaattatcct

SEQ ID NO: 13045 - DNA, 40 bp, Artificial Sequence
  PCR primer for ORF amplification
caggagctgcacttcccataatcgagcagttcttctgctg

SEQ ID NO: 13046 - DNA, 40 bp, Artificial Sequence
  PCR primer for ORF amplification
caggagctgcacttcctaactctgtaggcttttcttctct

SEQ ID NO: 13047 - DNA, 40 bp, Artificial Sequence
  PCR primer for ORF amplification
caggagctgcacttccaaactgtatacaattatttgcagc

SEQ ID NO: 13048 - DNA, 40 bp, Artificial Sequence
  PCR primer for ORF amplification
caggagctgcacttcccattctcattgtggtttctaagtc

SEQ ID NO: 13049 - DNA, 40 bp, Artificial Sequence
  PCR primer for ORF amplification
caggagctgcacttccatcttctgcacgcgtgttattgct

SEQ ID NO: 13050 - DNA, 40 bp, Artificial Sequence
  PCR primer for ORF amplification
caggagctgcacttccgttagatctttctactctgtgttc

SEQ ID NO: 13051 - DNA, 40 bp, Artificial Sequence
  PCR primer for ORF amplification
caggagctgcacttcccagagctgccaaagagtcaaataa

SEQ ID NO: 13052 - DNA, 40 bp, Artificial Sequence
  PCR primer for ORF amplification
caggagctgcacttccatcacgtctagcataagagatctg

SEQ ID NO: 13053 - DNA, 40 bp, Artificial Sequence
  PCR primer for ORF amplification
caggagctgcacttccgtttctcaagtgactattgtgaat

SEQ ID NO: 13054 - DNA, 40 bp, Artificial Sequence
  PCR primer for ORF amplification
caggagctgcacttccgaatcttctggcacgtctactctt

SEQ ID NO: 13055 - DNA, 40 bp, Artificial Sequence
  PCR primer for ORF amplification
caggagctgcacttcctattgttacatccaaaattttgcc

SEQ ID NO: 13056 - DNA, 40 bp, Artificial Sequence
  PCR primer for ORF amplification
caggagctgcacttccagttgggttagcccactgtaaaac

SEQ ID NO: 13057 - DNA, 40 bp, Artificial Sequence
  PCR primer for ORF amplification
caggagctgcacttccattttgggtcaattcaacgacctt

SEQ ID NO: 13058 - DNA, 40 bp, Artificial Sequence
  PCR primer for ORF amplification
caggagctgcacttccacgaggtgggaatgccaaattttc

SEQ ID NO: 13059 - DNA, 40 bp, Artificial Sequence
  PCR primer for ORF amplification
caggagctgcacttccggcggatggcttagtccgcttggc

SEQ ID NO: 13060 - DNA, 40 bp, Artificial Sequence
  PCR primer for ORF amplification
caggagctgcacttccccatttctgaaaaggtaaccaaac

SEQ ID NO: 13061 - DNA, 40 bp, Artificial Sequence
  PCR primer for ORF amplification
caggagctgcacttccctcgatcgacttgatttctttttg

SEQ ID NO: 13062 - DNA, 40 bp, Artificial Sequence
  PCR primer for ORF amplification
caggagctgcacttccttccacagtctccttcttgtttat

SEQ ID NO: 13063 - DNA, 40 bp, Artificial Sequence
  PCR primer for ORF amplification
caggagctgcacttcctttgtagaagtcgaatttatcgac

SEQ ID NO: 13064 - DNA, 40 bp, Artificial Sequence
  PCR primer for ORF amplification
caggagctgcacttccttggaaaaggagggatgcagcaaa

SEQ ID NO: 13065 - DNA, 40 bp, Artificial Sequence
  PCR primer for ORF amplification
caggagctgcacttccaatctcgtcttgctcttcttttaa

SEQ ID NO: 13066 - DNA, 40 bp, Artificial Sequence
  PCR primer for ORF amplification
caggagctgcacttccatctaaatcaatccgtgaccttaa

SEQ ID NO: 13067 - DNA, 40 bp, Artificial Sequence
  PCR primer for ORF amplification
caggagctgcacttccagaatagtactcctcctctttaaa

SEQ ID NO: 13068 - DNA, 40 bp, Artificial Sequence
  PCR primer for ORF amplification
caggagctgcacttccgaatttttcgacgttcatgattaa

SEQ ID NO: 13069 - DNA, 40 bp, Artificial Sequence
  PCR primer for ORF amplification
caggagctgcacttcctttgtcacccgctgactgcgtttc

SEQ ID NO: 13070 - DNA, 40 bp, Artificial Sequence
  PCR primer for ORF amplification
caggagctgcacttccaacacgatctgaccctgtcaatct

SEQ ID NO: 13071 - DNA, 40 bp, Artificial Sequence
  PCR primer for ORF amplification
caggagctgcacttccggtccatctgtgcgcttcgttatc

SEQ ID NO: 13072 - DNA, 40 bp, Artificial Sequence
  PCR primer for ORF amplification
caggagctgcacttccttccagggttttacgtaacagttc

SEQ ID NO: 13073 - DNA, 40 bp, Artificial Sequence
  PCR primer for ORF amplification
caggagctgcacttcctttctttgattcttgacgttgaga

SEQ ID NO: 13074 - DNA, 40 bp, Artificial Sequence
  PCR primer for ORF amplification
caggagctgcacttccggctctattagcttcttcatcagg

SEQ ID NO: 13075 - DNA, 40 bp, Artificial Sequence
  PCR primer for ORF amplification
caggagctgcacttccttcgctgtaaatgctactgctgca

SEQ ID NO: 13076 - DNA, 40 bp, Artificial Sequence
  PCR primer for ORF amplification
caggagctgcacttccgtttgtttttttgaatgtttcaag

SEQ ID NO: 13077 - DNA, 40 bp, Artificial Sequence
  PCR primer for ORF amplification
caggagctgcacttcctactggcaagtgacagttgtgtaa

SEQ ID NO: 13078 - DNA, 40 bp, Artificial Sequence
  PCR primer for ORF amplification
caggagctgcacttccaaaaccttcaactttcattataag

SEQ ID NO: 13079 - DNA, 40 bp, Artificial Sequence
  PCR primer for ORF amplification
caggagctgcacttccgaaaattgatggtacggtgcctga

SEQ ID NO: 13080 - DNA, 40 bp, Artificial Sequence
  PCR primer for ORF amplification
caggagctgcacttccgtaatcgtcgtcaccaccgtattg

SEQ ID NO: 13081 - DNA, 40 bp, Artificial Sequence
  PCR primer for ORF amplification
caggagctgcacttccatgttgactagccagcatgtcaac

SEQ ID NO: 13082 - DNA, 40 bp, Artificial Sequence
  PCR primer for ORF amplification
caggagctgcacttcctgcaaccaatgcaggtggtggagg

SEQ ID NO: 13083 - DNA, 40 bp, Artificial Sequence
  PCR primer for ORF amplification
caggagctgcacttcctatctctgggtctagtaggaagtc

SEQ ID NO: 13084 - DNA, 40 bp, Artificial Sequence
  PCR primer for ORF amplification
caggagctgcacttccctcacctttgcaactttgttcaat

SEQ ID NO: 13085 - DNA, 40 bp, Artificial Sequence
  PCR primer for ORF amplification
caggagctgcacttccggtgaattgtctagaacccccgcg

SEQ ID NO: 13086 - DNA, 40 bp, Artificial Sequence
  PCR primer for ORF amplification
caggagctgcacttccacttggagaagataaattggattt

SEQ ID NO: 13087 - DNA, 40 bp, Artificial Sequence
  PCR primer for ORF amplification
caggagctgcacttccgtttggtacctcgaacaccagaga

SEQ ID NO: 13088 - DNA, 40 bp, Artificial Sequence
  PCR primer for ORF amplification
caggagctgcacttccagagcgcaaacttttcccgtcatt

SEQ ID NO: 13089 - DNA, 40 bp, Artificial Sequence
  PCR primer for ORF amplification
caggagctgcacttcctatattgaagccgctgaggtctaa

SEQ ID NO: 13090 - DNA, 40 bp, Artificial Sequence
  PCR primer for ORF amplification
caggagctgcacttcctaaattattattatcttcagtcca

SEQ ID NO: 13091 - DNA, 40 bp, Artificial Sequence
  PCR primer for ORF amplification
caggagctgcacttccagtatgtggcgccggaaggaagta

SEQ ID NO: 13092 - DNA, 40 bp, Artificial Sequence
  PCR primer for ORF amplification
caggagctgcacttcccttcttttcttgcttagtttttgg

SEQ ID NO: 13093 - DNA, 40 bp, Artificial Sequence
  PCR primer for ORF amplification
caggagctgcacttccttgcaacaactcatccctgtaatg

SEQ ID NO: 13094 - DNA, 40 bp, Artificial Sequence
  PCR primer for ORF amplification
caggagctgcacttcctatatccggggccgacatcgccga

SEQ ID NO: 13095 - DNA, 40 bp, Artificial Sequence
  PCR primer for ORF amplification
caggagctgcacttcctcttggaccaaatttagtcattgc

SEQ ID NO: 13096 - DNA, 40 bp, Artificial Sequence
  PCR primer for ORF amplification
caggagctgcacttcctgtatgtctcttcttttttgtagc

SEQ ID NO: 13097 - DNA, 40 bp, Artificial Sequence
  PCR primer for ORF amplification
caggagctgcacttccatcactctttgaggatacacttga

SEQ ID NO: 13098 - DNA, 40 bp, Artificial Sequence
  PCR primer for ORF amplification
caggagctgcacttcccataataaattgcagatttacgtc

SEQ ID NO: 13099 - DNA, 40 bp, Artificial Sequence
  PCR primer for ORF amplification
caggagctgcacttccgttaaaattattgaagtaccgctc

SEQ ID NO: 13100 - DNA, 40 bp, Artificial Sequence
  PCR primer for ORF amplification
caggagctgcacttccaaacctataatacacatatatatt

SEQ ID NO: 13101 - DNA, 40 bp, Artificial Sequence
  PCR primer for ORF amplification
caggagctgcacttccttgaacttggttgtctgatttgtt

SEQ ID NO: 13102 - DNA, 40 bp, Artificial Sequence
  PCR primer for ORF amplification
caggagctgcacttccggctggtggtaaaaaagctgcaaa

SEQ ID NO: 13103 - DNA, 40 bp, Artificial Sequence
  PCR primer for ORF amplification
caggagctgcacttccttggtccccatcaataccgtatat

SEQ ID NO: 13104 - DNA, 40 bp, Artificial Sequence
  PCR primer for ORF amplification
caggagctgcacttcctacacagaaggaccgtagttcatt

SEQ ID NO: 13105 - DNA, 40 bp, Artificial Sequence
  PCR primer for ORF amplification
caggagctgcacttccgttaacaccctgaaatgaattaga

SEQ ID NO: 13106 - DNA, 40 bp, Artificial Sequence
  PCR primer for ORF amplification
caggagctgcacttccatagaattcattgtcatgctcaac

SEQ ID NO: 13107 - DNA, 40 bp, Artificial Sequence
  PCR primer for ORF amplification
caggagctgcacttcctttaatttctttatgcaacatgct

SEQ ID NO: 13108 - DNA, 40 bp, Artificial Sequence
  PCR primer for ORF amplification
caggagctgcacttccggatactgaatccggctgccaatc

SEQ ID NO: 13109 - DNA, 40 bp, Artificial Sequence
  PCR primer for ORF amplification
caggagctgcacttcccacgaagtaggacaacaagctgga

SEQ ID NO: 13110 - DNA, 40 bp, Artificial Sequence
  PCR primer for ORF amplification
caggagctgcacttccccttggttgtgtatatgggacgtt

SEQ ID NO: 13111 - DNA, 40 bp, Artificial Sequence
  PCR primer for ORF amplification
caggagctgcacttcctataatttcccattccaatttcag

SEQ ID NO: 13112 - DNA, 40 bp, Artificial Sequence
  PCR primer for ORF amplification
caggagctgcacttcctttaggtcctcccttctttttacc

SEQ ID NO: 13113 - DNA, 40 bp, Artificial Sequence
  PCR primer for ORF amplification
caggagctgcacttccaaagtctcctgcgttgttaaaatc

SEQ ID NO: 13114 - DNA, 40 bp, Artificial Sequence
  PCR primer for ORF amplification
caggagctgcacttcctgcataaaaggataccgatttcga

SEQ ID NO: 13115 - DNA, 40 bp, Artificial Sequence
  PCR primer for ORF amplification
caggagctgcacttcccatccaattctggctctggaaaaa

SEQ ID NO: 13116 - DNA, 40 bp, Artificial Sequence
  PCR primer for ORF amplification
caggagctgcacttcctatagtaatttcgttctccctcat

SEQ ID NO: 13117 - DNA, 40 bp, Artificial Sequence
  PCR primer for ORF amplification
caggagctgcacttcccaaaacaatttccttttcttcgtc

SEQ ID NO: 13118 - DNA, 40 bp, Artificial Sequence
  PCR primer for ORF amplification
caggagctgcacttccatacaagacacttgccttttcaaa

SEQ ID NO: 13119 - DNA, 40 bp, Artificial Sequence
  PCR primer for ORF amplification
caggagctgcacttcctaaggaagactcggattcaccggc

SEQ ID NO: 13120 - DNA, 40 bp, Artificial Sequence
  PCR primer for ORF amplification
caggagctgcacttccatttttgatgaattttaatttaaa

SEQ ID NO: 13121 - DNA, 40 bp, Artificial Sequence
  PCR primer for ORF amplification
caggagctgcacttcctacacgacggccgggaacacagct

SEQ ID NO: 13122 - DNA, 40 bp, Artificial Sequence
  PCR primer for ORF amplification
caggagctgcacttccctgttggaactcattagcgtactg

SEQ ID NO: 13123 - DNA, 40 bp, Artificial Sequence
  PCR primer for ORF amplification
caggagctgcacttcctcgatatcttgtttgccagtggta

SEQ ID NO: 13124 - DNA, 40 bp, Artificial Sequence
  PCR primer for ORF amplification
caggagctgcacttcctaaactataatgcgagatattgct

SEQ ID NO: 13125 - DNA, 40 bp, Artificial Sequence
  PCR primer for ORF amplification
caggagctgcacttcccttaagattaaatagattttgaaa

SEQ ID NO: 13126 - DNA, 40 bp, Artificial Sequence
  PCR primer for ORF amplification
caggagctgcacttcccatagggcggacattgcttagcac

SEQ ID NO: 13127 - DNA, 40 bp, Artificial Sequence
  PCR primer for ORF amplification
caggagctgcacttccaatatattcgttgcatttttcgaa

SEQ ID NO: 13128 - DNA, 40 bp, Artificial Sequence
  PCR primer for ORF amplification
caggagctgcacttcctaaaggttctgttaatgccaaatc

SEQ ID NO: 13129 - DNA, 40 bp, Artificial Sequence
  PCR primer for ORF amplification
caggagctgcacttccaatttccaaaccatttagaacttt

SEQ ID NO: 13130 - DNA, 40 bp, Artificial Sequence
  PCR primer for ORF amplification
caggagctgcacttccttgtctcttgattgtatggtacct

SEQ ID NO: 13131 - DNA, 40 bp, Artificial Sequence
  PCR primer for ORF amplification
caggagctgcacttccgatactataaaaagggttctggag

SEQ ID NO: 13132 - DNA, 40 bp, Artificial Sequence
  PCR primer for ORF amplification
caggagctgcacttcctttggttgtgtctggattcataga

SEQ ID NO: 13133 - DNA, 40 bp, Artificial Sequence
  PCR primer for ORF amplification
caggagctgcacttcctttcaatacagtatatagttgctt

SEQ ID NO: 13134 - DNA, 40 bp, Artificial Sequence
  PCR primer for ORF amplification
caggagctgcacttcctttcttaccaacaacttcccaatt

SEQ ID NO: 13135 - DNA, 40 bp, Artificial Sequence
  PCR primer for ORF amplification
caggagctgcacttccgttgggctttacgctttccggttc

SEQ ID NO: 13136 - DNA, 40 bp, Artificial Sequence
  PCR primer for ORF amplification
caggagctgcacttccagttttaggcaaggctttagcttt

SEQ ID NO: 13137 - DNA, 40 bp, Artificial Sequence
  PCR primer for ORF amplification
caggagctgcacttccttttttatcttcgtcctttttctt

SEQ ID NO: 13138 - DNA, 40 bp, Artificial Sequence
  PCR primer for ORF amplification
caggagctgcacttcctaatttgtcaccgtggtggaagtt

SEQ ID NO: 13139 - DNA, 40 bp, Artificial Sequence
  PCR primer for ORF amplification
caggagctgcacttcccaacttgtcaccgtggtggaagtt

SEQ ID NO: 13140 - DNA, 40 bp, Artificial Sequence
  PCR primer for ORF amplification
caggagctgcacttcctagtttgtttccatcatgaaacct

SEQ ID NO: 13141 - DNA, 40 bp, Artificial Sequence
  PCR primer for ORF amplification
caggagctgcacttccgttaccttcttgaccaaaatctct

SEQ ID NO: 13142 - DNA, 40 bp, Artificial Sequence
  PCR primer for ORF amplification
caggagctgcacttcctaatttttggtattctatagtgcc

SEQ ID NO: 13143 - DNA, 40 bp, Artificial Sequence
  PCR primer for ORF amplification
caggagctgcacttccttcgctttcctcggtatagggctt

SEQ ID NO: 13144 - DNA, 40 bp, Artificial Sequence
  PCR primer for ORF amplification
caggagctgcacttccaatgaaatcatagtcggatccttc

SEQ ID NO: 13145 - DNA, 40 bp, Artificial Sequence
  PCR primer for ORF amplification
caggagctgcacttccattcttttggattccatgcttttt

SEQ ID NO: 13146 - DNA, 40 bp, Artificial Sequence
  PCR primer for ORF amplification
caggagctgcacttcccaagtataaaccttctaaattttc

SEQ ID NO: 13147 - DNA, 40 bp, Artificial Sequence
  PCR primer for ORF amplification
caggagctgcacttccgtttctgttggtaattgaactgac

SEQ ID NO: 13148 - DNA, 40 bp, Artificial Sequence
  PCR primer for ORF amplification
caggagctgcacttccttcaataatacgtgtgattagacc

SEQ ID NO: 13149 - DNA, 40 bp, Artificial Sequence
  PCR primer for ORF amplification
caggagctgcacttccaatgttttctgtctcattgaacca

SEQ ID NO: 13150 - DNA, 40 bp, Artificial Sequence
  PCR primer for ORF amplification
caggagctgcacttcctatccaattctggtaaccaaacct

SEQ ID NO: 13151 - DNA, 40 bp, Artificial Sequence
  PCR primer for ORF amplification
caggagctgcacttccataaacatatggaatgatcttgta

SEQ ID NO: 13152 - DNA, 40 bp, Artificial Sequence
  PCR primer for ORF amplification
caggagctgcacttcctgttggacggtaattctccagaat

SEQ ID NO: 13153 - DNA, 40 bp, Artificial Sequence
  PCR primer for ORF amplification
caggagctgcacttccatgatcctctaagcaatcagctgt

SEQ ID NO: 13154 - DNA, 40 bp, Artificial Sequence
  PCR primer for ORF amplification
caggagctgcacttcctttcttggttcggaagtccccacc

SEQ ID NO: 13155 - DNA, 40 bp, Artificial Sequence
  PCR primer for ORF amplification
caggagctgcacttccatcaataaggtgagaatattcagg

SEQ ID NO: 13156 - DNA, 40 bp, Artificial Sequence
  PCR primer for ORF amplification
caggagctgcacttccatatttaggaatggtttgatcaat

SEQ ID NO: 13157 - DNA, 40 bp, Artificial Sequence
  PCR primer for ORF amplification
caggagctgcacttcccctgtctctagttaaatttttttt

SEQ ID NO: 13158 - DNA, 40 bp, Artificial Sequence
  PCR primer for ORF amplification
caggagctgcacttccttcgtcatcgatgtctagctcttc

SEQ ID NO: 13159 - DNA, 40 bp, Artificial Sequence
  PCR primer for ORF amplification
caggagctgcacttccgaagaactgctggttgtcaggatt

SEQ ID NO: 13160 - DNA, 40 bp, Artificial Sequence
  PCR primer for ORF amplification
caggagctgcacttccaagttttaggttttttaacttttt

SEQ ID NO: 13161 - DNA, 40 bp, Artificial Sequence
  PCR primer for ORF amplification
caggagctgcacttcctaatgtaaaggtgtccttgtaaaa

SEQ ID NO: 13162 - DNA, 40 bp, Artificial Sequence
  PCR primer for ORF amplification
caggagctgcacttccaagtttgctgataattaaatctag

SEQ ID NO: 13163 - DNA, 40 bp, Artificial Sequence
  PCR primer for ORF amplification
caggagctgcacttcctttggtgacctttgcctttttaga

SEQ ID NO: 13164 - DNA, 40 bp, Artificial Sequence
  PCR primer for ORF amplification
caggagctgcacttcctgaacggtaatcaccgttaattgt

SEQ ID NO: 13165 - DNA, 40 bp, Artificial Sequence
  PCR primer for ORF amplification
caggagctgcacttcctctggacttcttgcctaatggact

SEQ ID NO: 13166 - DNA, 40 bp, Artificial Sequence
  PCR primer for ORF amplification
caggagctgcacttcctttcttagggcttgcgtcagcttg

SEQ ID NO: 13167 - DNA, 40 bp, Artificial Sequence
  PCR primer for ORF amplification
caggagctgcacttccaggcttgaaggaaaacgagctgga

SEQ ID NO: 13168 - DNA, 40 bp, Artificial Sequence
  PCR primer for ORF amplification
caggagctgcacttccgacctgctgggatgaacgactaac

SEQ ID NO: 13169 - DNA, 40 bp, Artificial Sequence
  PCR primer for ORF amplification
caggagctgcacttcccttatttttgttgttctttttctt

SEQ ID NO: 13170 - DNA, 40 bp, Artificial Sequence
  PCR primer for ORF amplification
caggagctgcacttcccaggcaattggaagtattgcagtt

SEQ ID NO: 13171 - DNA, 40 bp, Artificial Sequence
  PCR primer for ORF amplification
caggagctgcacttccgtttaattttgtttcgttagattg

SEQ ID NO: 13172 - DNA, 40 bp, Artificial Sequence
  PCR primer for ORF amplification
caggagctgcacttccctcacggaattttttccagttttt

SEQ ID NO: 13173 - DNA, 40 bp, Artificial Sequence
  PCR primer for ORF amplification
caggagctgcacttcccattccaaataattctacgtttct

SEQ ID NO: 13174 - DNA, 40 bp, Artificial Sequence
  PCR primer for ORF amplification
caggagctgcacttccactcccttcccatttcttgaagag

SEQ ID NO: 13175 - DNA, 40 bp, Artificial Sequence
  PCR primer for ORF amplification
caggagctgcacttcccatagttatgttattggtgatcgc

SEQ ID NO: 13176 - DNA, 40 bp, Artificial Sequence
  PCR primer for ORF amplification
caggagctgcacttcctatatagttactatcgagtatagt

SEQ ID NO: 13177 - DNA, 40 bp, Artificial Sequence
  PCR primer for ORF amplification
caggagctgcacttcctattttattgagctttatggtacc

SEQ ID NO: 13178 - DNA, 40 bp, Artificial Sequence
  PCR primer for ORF amplification
caggagctgcacttcctttcttcttcttaccctcaattct

SEQ ID NO: 13179 - DNA, 40 bp, Artificial Sequence
  PCR primer for ORF amplification
caggagctgcacttcccatgggcaatagccccacagaatg

SEQ ID NO: 13180 - DNA, 40 bp, Artificial Sequence
  PCR primer for ORF amplification
caggagctgcacttcctgaagtccatggtaaattcgtgtt

SEQ ID NO: 13181 - DNA, 40 bp, Artificial Sequence
  PCR primer for ORF amplification
caggagctgcacttcctaaggaagcgtgagttttaacgtg

SEQ ID NO: 13182 - DNA, 40 bp, Artificial Sequence
  PCR primer for ORF amplification
caggagctgcacttcctaagtagtccttgagtagttttaa

SEQ ID NO: 13183 - DNA, 40 bp, Artificial Sequence
  PCR primer for ORF amplification
caggagctgcacttccgtttttaaggccaatttgattcag

SEQ ID NO: 13184 - DNA, 40 bp, Artificial Sequence
  PCR primer for ORF amplification
caggagctgcacttcccagaagtttgaccttcttgatgtc

SEQ ID NO: 13185 - DNA, 40 bp, Artificial Sequence
  PCR primer for ORF amplification
caggagctgcacttcccgagtaatgttctccatgttttct

SEQ ID NO: 13186 - DNA, 40 bp, Artificial Sequence
  PCR primer for ORF amplification
caggagctgcacttcccattatagacatgatgattgccgt

SEQ ID NO: 13187 - DNA, 40 bp, Artificial Sequence
  PCR primer for ORF amplification
caggagctgcacttcctggtttttggccagcgaaaacagt

SEQ ID NO: 13188 - DNA, 40 bp, Artificial Sequence
  PCR primer for ORF amplification
caggagctgcacttccctcacctagaaacatcttgcgaaa

SEQ ID NO: 13189 - DNA, 40 bp, Artificial Sequence
  PCR primer for ORF amplification
caggagctgcacttcccgctctgtgtaaagtgtatatata

SEQ ID NO: 13190 - DNA, 40 bp, Artificial Sequence
  PCR primer for ORF amplification
caggagctgcacttccgcattcaaacaaacctccctctga

SEQ ID NO: 13191 - DNA, 40 bp, Artificial Sequence
  PCR primer for ORF amplification
caggagctgcacttccggacattccatcaggcttccaatc

SEQ ID NO: 13192 - DNA, 40 bp, Artificial Sequence
  PCR primer for ORF amplification
caggagctgcacttcctagcagtttggtctttatgatctc

SEQ ID NO: 13193 - DNA, 40 bp, Artificial Sequence
  PCR primer for ORF amplification
caggagctgcacttccctctaaatatctatatgaagttag

SEQ ID NO: 13194 - DNA, 40 bp, Artificial Sequence
  PCR primer for ORF amplification
caggagctgcacttccatgacattggttaggatatttcct

SEQ ID NO: 13195 - DNA, 40 bp, Artificial Sequence
  PCR primer for ORF amplification
caggagctgcacttcctttagcttgcaaaccgtgcatgat

SEQ ID NO: 13196 - DNA, 40 bp, Artificial Sequence
  PCR primer for ORF amplification
caggagctgcacttccttcttcttgtaaagtttccttttc

SEQ ID NO: 13197 - DNA, 40 bp, Artificial Sequence
  PCR primer for ORF amplification
caggagctgcacttccccaggcaaagcgtaactgagaggc

SEQ ID NO: 13198 - DNA, 40 bp, Artificial Sequence
  PCR primer for ORF amplification
caggagctgcacttcctattttttgcatttctttcgtaag

SEQ ID NO: 13199 - DNA, 40 bp, Artificial Sequence
  PCR primer for ORF amplification
caggagctgcacttccgtttatgttgaatgccttctctcc

SEQ ID NO: 13200 - DNA, 40 bp, Artificial Sequence
  PCR primer for ORF amplification
caggagctgcacttccaatgtatcgttggccattcataaa

SEQ ID NO: 13201 - DNA, 40 bp, Artificial Sequence
  PCR primer for ORF amplification
caggagctgcacttcctggtaacctatcccaaccttctgg

SEQ ID NO: 13202 - DNA, 40 bp, Artificial Sequence
  PCR primer for ORF amplification
caggagctgcacttccttcttctgttttggtatccttccc

SEQ ID NO: 13203 - DNA, 40 bp, Artificial Sequence
  PCR primer for ORF amplification
caggagctgcacttccagccactgtcttttcctttagata

SEQ ID NO: 13204 - DNA, 40 bp, Artificial Sequence
  PCR primer for ORF amplification
caggagctgcacttccattattcaaataagtggacggatc

SEQ ID NO: 13205 - DNA, 40 bp, Artificial Sequence
  PCR primer for ORF amplification
caggagctgcacttcctgacaaagggatgaaattcccgac

SEQ ID NO: 13206 - DNA, 40 bp, Artificial Sequence
  PCR primer for ORF amplification
caggagctgcacttcctgaggcttggttgtcaccgaaagt

SEQ ID NO: 13207 - DNA, 40 bp, Artificial Sequence
  PCR primer for ORF amplification
caggagctgcacttccgtcttctgacttcgactcccgatc

SEQ ID NO: 13208 - DNA, 40 bp, Artificial Sequence
  PCR primer for ORF amplification
caggagctgcacttcctctgaattgagagtaataagcttc

SEQ ID NO: 13209 - DNA, 40 bp, Artificial Sequence
  PCR primer for ORF amplification
caggagctgcacttccatcatttatttgtaagttttgttc

SEQ ID NO: 13210 - DNA, 40 bp, Artificial Sequence
  PCR primer for ORF amplification
caggagctgcacttccgttagaaattgtgccacattggtt

SEQ ID NO: 13211 - DNA, 40 bp, Artificial Sequence
  PCR primer for ORF amplification
caggagctgcacttccctcttgcttttcccatacttgtat

SEQ ID NO: 13212 - DNA, 40 bp, Artificial Sequence
  PCR primer for ORF amplification
caggagctgcacttccaagctctctccatgattctctcac

SEQ ID NO: 13213 - DNA, 40 bp, Artificial Sequence
  PCR primer for ORF amplification
caggagctgcacttccatggcggttcatttgctttttaat

SEQ ID NO: 13214 - DNA, 40 bp, Artificial Sequence
  PCR primer for ORF amplification
caggagctgcacttccttgttttgctgggttctgcttttc

SEQ ID NO: 13215 - DNA, 40 bp, Artificial Sequence
  PCR primer for ORF amplification
caggagctgcacttcctttagttccaatccaaaattggcc

SEQ ID NO: 13216 - DNA, 40 bp, Artificial Sequence
  PCR primer for ORF amplification
caggagctgcacttccgtttagcttcaaagctgcggtcag

SEQ ID NO: 13217 - DNA, 40 bp, Artificial Sequence
  PCR primer for ORF amplification
caggagctgcacttccaaactgtaatgctgacgaaggctt

SEQ ID NO: 13218 - DNA, 40 bp, Artificial Sequence
  PCR primer for ORF amplification
caggagctgcacttccacgtactgtccataggttgtcgtg

SEQ ID NO: 13219 - DNA, 40 bp, Artificial Sequence
  PCR primer for ORF amplification
caggagctgcacttccattcgcgcgaaaggttgtggctat

SEQ ID NO: 13220 - DNA, 40 bp, Artificial Sequence
  PCR primer for ORF amplification
caggagctgcacttccaaagactaaccacagagcacatgc

SEQ ID NO: 13221 - DNA, 40 bp, Artificial Sequence
  PCR primer for ORF amplification
caggagctgcacttccttgtaacactccagagtctttcaa

SEQ ID NO: 13222 - DNA, 40 bp, Artificial Sequence
  PCR primer for ORF amplification
caggagctgcacttccaaccatgttgaaaaggctgaaatt

SEQ ID NO: 13223 - DNA, 40 bp, Artificial Sequence
  PCR primer for ORF amplification
caggagctgcacttccatatctgtagtggtcggccttgaa

SEQ ID NO: 13224 - DNA, 40 bp, Artificial Sequence
  PCR primer for ORF amplification
caggagctgcacttccatgaattagcttcaaatctctcat

SEQ ID NO: 13225 - DNA, 40 bp, Artificial Sequence
  PCR primer for ORF amplification
caggagctgcacttccacgtggttgttcttccatcatgat

SEQ ID NO: 13226 - DNA, 40 bp, Artificial Sequence
  PCR primer for ORF amplification
caggagctgcacttccattactcttgtgcatcaagtatgc

SEQ ID NO: 13227 - DNA, 40 bp, Artificial Sequence
  PCR primer for ORF amplification
caggagctgcacttcccctatgggaaaggactaaactttt

SEQ ID NO: 13228 - DNA, 40 bp, Artificial Sequence
  PCR primer for ORF amplification
caggagctgcacttcctatccatttctgtcttgcagcaac

SEQ ID NO: 13229 - DNA, 40 bp, Artificial Sequence
  PCR primer for ORF amplification
caggagctgcacttccgtcctgcatggcatatacatcctt

SEQ ID NO: 13230 - DNA, 40 bp, Artificial Sequence
  PCR primer for ORF amplification
caggagctgcacttccatcagtttctaataatctatgaag

SEQ ID NO: 13231 - DNA, 40 bp, Artificial Sequence
  PCR primer for ORF amplification
caggagctgcacttccttctgacagagaaagtagagcatc

SEQ ID NO: 13232 - DNA, 40 bp, Artificial Sequence
  PCR primer for ORF amplification
caggagctgcacttccttgcatatattcgagcatttcatt

SEQ ID NO: 13233 - DNA, 40 bp, Artificial Sequence
  PCR primer for ORF amplification
caggagctgcacttccaaatcttttggcgcttaagttggg

SEQ ID NO: 13234 - DNA, 40 bp, Artificial Sequence
  PCR primer for ORF amplification
caggagctgcacttccctgcttttcttgttcttgtctttg

SEQ ID NO: 13235 - DNA, 40 bp, Artificial Sequence
  PCR primer for ORF amplification
caggagctgcacttcctacgactaattcatcaaacttagt

SEQ ID NO: 13236 - DNA, 40 bp, Artificial Sequence
  PCR primer for ORF amplification
caggagctgcacttcctttatcaagataagtttccggatc

SEQ ID NO: 13237 - DNA, 40 bp, Artificial Sequence
  PCR primer for ORF amplification
caggagctgcacttcctgcgagtttgtccattttcgagac

SEQ ID NO: 13238 - DNA, 40 bp, Artificial Sequence
  PCR primer for ORF amplification
caggagctgcacttccttttccggttctgtgatgtgatga

SEQ ID NO: 13239 - DNA, 40 bp, Artificial Sequence
  PCR primer for ORF amplification
caggagctgcacttccatacactgccgaatacggaaagta

SEQ ID NO: 13240 - DNA, 40 bp, Artificial Sequence
  PCR primer for ORF amplification
caggagctgcacttccaaatttgtcttccaaaggagagtc

SEQ ID NO: 13241 - DNA, 40 bp, Artificial Sequence
  PCR primer for ORF amplification
caggagctgcacttccatctggagagtttgtcgaactcgt

SEQ ID NO: 13242 - DNA, 40 bp, Artificial Sequence
  PCR primer for ORF amplification
caggagctgcacttcctgtatttcttttttcagcggccga

SEQ ID NO: 13243 - DNA, 40 bp, Artificial Sequence
  PCR primer for ORF amplification
caggagctgcacttccttgttcataaccaggtggtggttg

SEQ ID NO: 13244 - DNA, 40 bp, Artificial Sequence
  PCR primer for ORF amplification
caggagctgcacttcctgaaaaggcaatcaatccactgtt

SEQ ID NO: 13245 - DNA, 40 bp, Artificial Sequence
  PCR primer for ORF amplification
caggagctgcacttcctgtatcacaactattaaattcagt

SEQ ID NO: 13246 - DNA, 40 bp, Artificial Sequence
  PCR primer for ORF amplification
caggagctgcacttccatttttatcttcatttttaatgtc

SEQ ID NO: 13247 - DNA, 40 bp, Artificial Sequence
  PCR primer for ORF amplification
caggagctgcacttccctttgagtattggtgggatttagg

SEQ ID NO: 13248 - DNA, 40 bp, Artificial Sequence
  PCR primer for ORF amplification
caggagctgcacttcctgcctgacgtccatcttttttgga

SEQ ID NO: 13249 - DNA, 40 bp, Artificial Sequence
  PCR primer for ORF amplification
caggagctgcacttcctatattacttgactggtcttgcat

SEQ ID NO: 13250 - DNA, 40 bp, Artificial Sequence
  PCR primer for ORF amplification
caggagctgcacttccaggcgatttagtttcgtctgataa

SEQ ID NO: 13251 - DNA, 40 bp, Artificial Sequence
  PCR primer for ORF amplification
caggagctgcacttccttcaactttttttgatatggcatc

SEQ ID NO: 13252 - DNA, 40 bp, Artificial Sequence
  PCR primer for ORF amplification
caggagctgcacttcccaacttatccatcgcctcatttag

SEQ ID NO: 13253 - DNA, 40 bp, Artificial Sequence
  PCR primer for ORF amplification
caggagctgcacttccttcgacctcactaaataagtcact

SEQ ID NO: 13254 - DNA, 40 bp, Artificial Sequence
  PCR primer for ORF amplification
caggagctgcacttccttctacttcactgaataagtcact

SEQ ID NO: 13255 - DNA, 40 bp, Artificial Sequence
  PCR primer for ORF amplification
caggagctgcacttccccttcttccccatcgtccattaga

SEQ ID NO: 13256 - DNA, 40 bp, Artificial Sequence
  PCR primer for ORF amplification
caggagctgcacttccttgttgttgctgctgttgctgctg

SEQ ID NO: 13257 - DNA, 40 bp, Artificial Sequence
  PCR primer for ORF amplification
caggagctgcacttccgtttttcttcttttcactaacata

SEQ ID NO: 13258 - DNA, 40 bp, Artificial Sequence
  PCR primer for ORF amplification
caggagctgcacttcctttttttgatggacgaagcagtct

SEQ ID NO: 13259 - DNA, 40 bp, Artificial Sequence
  PCR primer for ORF amplification
caggagctgcacttcccttctctttgatggcagcggcttc

SEQ ID NO: 13260 - DNA, 40 bp, Artificial Sequence
  PCR primer for ORF amplification
caggagctgcacttccaaatacatcaccttggtcaaacat

SEQ ID NO: 13261 - DNA, 40 bp, Artificial Sequence
  PCR primer for ORF amplification
caggagctgcacttcctttggccaaagcacccattgggtc

SEQ ID NO: 13262 - DNA, 40 bp, Artificial Sequence
  PCR primer for ORF amplification
caggagctgcacttcctaaatcaattagagtatatccccg

SEQ ID NO: 13263 - DNA, 40 bp, Artificial Sequence
  PCR primer for ORF amplification
caggagctgcacttccgttttcgaccctaggaacccctat

SEQ ID NO: 13264 - DNA, 40 bp, Artificial Sequence
  PCR primer for ORF amplification
caggagctgcacttccccaaagaacgtgagaatgggcagg

SEQ ID NO: 13265 - DNA, 40 bp, Artificial Sequence
  PCR primer for ORF amplification
caggagctgcacttccttcgtccaggcgttccattacaat

SEQ ID NO: 13266 - DNA, 40 bp, Artificial Sequence
  PCR primer for ORF amplification
caggagctgcacttcctttgaagtccttatgtgtccactt

SEQ ID NO: 13267 - DNA, 40 bp, Artificial Sequence
  PCR primer for ORF amplification
caggagctgcacttccgtcacatacatatatcttacctgc

SEQ ID NO: 13268 - DNA, 40 bp, Artificial Sequence
  PCR primer for ORF amplification
caggagctgcacttccatcgtattctactccggatccatc

SEQ ID NO: 13269 - DNA, 40 bp, Artificial Sequence
  PCR primer for ORF amplification
caggagctgcacttcccaacataacaacaccgacattgct

SEQ ID NO: 13270 - DNA, 40 bp, Artificial Sequence
  PCR primer for ORF amplification
caggagctgcacttcctggcaaggccgcagaagaaccgga

SEQ ID NO: 13271 - DNA, 40 bp, Artificial Sequence
  PCR primer for ORF amplification
caggagctgcacttccatcaataatgacatcaaccatgtc

SEQ ID NO: 13272 - DNA, 40 bp, Artificial Sequence
  PCR primer for ORF amplification
caggagctgcacttccgtaagatgctggtttagtggcgac

SEQ ID NO: 13273 - DNA, 40 bp, Artificial Sequence
  PCR primer for ORF amplification
caggagctgcacttccacatgatgcgaaatcatggcttaa

SEQ ID NO: 13274 - DNA, 40 bp, Artificial Sequence
  PCR primer for ORF amplification
caggagctgcacttccttttataattttcttcaacatatt

SEQ ID NO: 13275 - DNA, 40 bp, Artificial Sequence
  PCR primer for ORF amplification
caggagctgcacttccatagtctaaagatatcttggtctt

SEQ ID NO: 13276 - DNA, 40 bp, Artificial Sequence
  PCR primer for ORF amplification
caggagctgcacttcctaatgtcacagtctttatatctaa

SEQ ID NO: 13277 - DNA, 40 bp, Artificial Sequence
  PCR primer for ORF amplification
caggagctgcacttccgaaaatatgattagcgttccgtaa

SEQ ID NO: 13278 - DNA, 40 bp, Artificial Sequence
  PCR primer for ORF amplification
caggagctgcacttcctatcagcccggataccaagattgt

SEQ ID NO: 13279 - DNA, 40 bp, Artificial Sequence
  PCR primer for ORF amplification
caggagctgcacttcctaaaactaactcatcaaagctgcc

SEQ ID NO: 13280 - DNA, 40 bp, Artificial Sequence
  PCR primer for ORF amplification
caggagctgcacttccaaaaacgtctccctggtcaagcat

SEQ ID NO: 13281 - DNA, 40 bp, Artificial Sequence
  PCR primer for ORF amplification
caggagctgcacttccaatgtttaatttatcaaatttcat

SEQ ID NO: 13282 - DNA, 40 bp, Artificial Sequence
  PCR primer for ORF amplification
caggagctgcacttccttcaaaattctcagtgattggttc

SEQ ID NO: 13283 - DNA, 40 bp, Artificial Sequence
  PCR primer for ORF amplification
caggagctgcacttccccatctcatcatggacatgtcact

SEQ ID NO: 13284 - DNA, 40 bp, Artificial Sequence
  PCR primer for ORF amplification
caggagctgcacttcccctaaacacttcaaattggacctc

SEQ ID NO: 13285 - DNA, 40 bp, Artificial Sequence
  PCR primer for ORF amplification
caggagctgcacttccgctttcgaagacagaatgaaattt

SEQ ID NO: 13286 - DNA, 40 bp, Artificial Sequence
  PCR primer for ORF amplification
caggagctgcacttccagagtgattggtcaatgatttctt

SEQ ID NO: 13287 - DNA, 40 bp, Artificial Sequence
  PCR primer for ORF amplification
caggagctgcacttcctttcttagcagccttttgagcagc

SEQ ID NO: 13288 - DNA, 40 bp, Artificial Sequence
  PCR primer for ORF amplification
caggagctgcacttccttggcttattttctttttgttctt

SEQ ID NO: 13289 - DNA, 40 bp, Artificial Sequence
  PCR primer for ORF amplification
caggagctgcacttcccttgtcttctaaattatcttctgg

SEQ ID NO: 13290 - DNA, 40 bp, Artificial Sequence
  PCR primer for ORF amplification
caggagctgcacttccggttgatatagcattgatagatgt

SEQ ID NO: 13291 - DNA, 40 bp, Artificial Sequence
  PCR primer for ORF amplification
caggagctgcacttccaaacagcatccacacagccccacc

SEQ ID NO: 13292 - DNA, 40 bp, Artificial Sequence
  PCR primer for ORF amplification
caggagctgcacttccgttgagctttttttccatagagct

SEQ ID NO: 13293 - DNA, 40 bp, Artificial Sequence
  PCR primer for ORF amplification
caggagctgcacttcctgctaaacgcgtaaaatctagagc

SEQ ID NO: 13294 - DNA, 40 bp, Artificial Sequence
  PCR primer for ORF amplification
caggagctgcacttccaaacttcatcttcttttttgtcat

SEQ ID NO: 13295 - DNA, 40 bp, Artificial Sequence
  PCR primer for ORF amplification
caggagctgcacttcccagtaaaccacctttagcaacctg

SEQ ID NO: 13296 - DNA, 40 bp, Artificial Sequence
  PCR primer for ORF amplification
caggagctgcacttccaacgttaaagggagtggtatcttc

SEQ ID NO: 13297 - DNA, 40 bp, Artificial Sequence
  PCR primer for ORF amplification
caggagctgcacttccacttctccttttggaactgttgac

SEQ ID NO: 13298 - DNA, 40 bp, Artificial Sequence
  PCR primer for ORF amplification
caggagctgcacttccttggatacagcagtacgaacttct

SEQ ID NO: 13299 - DNA, 40 bp, Artificial Sequence
  PCR primer for ORF amplification
caggagctgcacttccatgtgatgatgtgcccaaaaatac

SEQ ID NO: 13300 - DNA, 40 bp, Artificial Sequence
  PCR primer for ORF amplification
caggagctgcacttccatccgaccaatcatcctcgtctac

SEQ ID NO: 13301 - DNA, 40 bp, Artificial Sequence
  PCR primer for ORF amplification
caggagctgcacttccatgatatggtggggggctatcctc

SEQ ID NO: 13302 - DNA, 40 bp, Artificial Sequence
  PCR primer for ORF amplification
caggagctgcacttcctttcttgctcttttcagcttgagc

SEQ ID NO: 13303 - DNA, 40 bp, Artificial Sequence
  PCR primer for ORF amplification
caggagctgcacttccgtttttgaaaatgttgtctccttt

SEQ ID NO: 13304 - DNA, 40 bp, Artificial Sequence
  PCR primer for ORF amplification
caggagctgcacttcctagtttgctttcaatgtttttgac

SEQ ID NO: 13305 - DNA, 40 bp, Artificial Sequence
  PCR primer for ORF amplification
caggagctgcacttccacttttggcagctccaacctctct

SEQ ID NO: 13306 - DNA, 40 bp, Artificial Sequence
  PCR primer for ORF amplification
caggagctgcacttccggcttctgtcgaaacaatccattc

SEQ ID NO: 13307 - DNA, 40 bp, Artificial Sequence
  PCR primer for ORF amplification
caggagctgcacttccggctgtttctattcctcgcttagt

SEQ ID NO: 13308 - DNA, 40 bp, Artificial Sequence
  PCR primer for ORF amplification
caggagctgcacttccacgtctagaatcaagcaaagtttg

SEQ ID NO: 13309 - DNA, 40 bp, Artificial Sequence
  PCR primer for ORF amplification
caggagctgcacttccatttggttccacaaaggctctata

SEQ ID NO: 13310 - DNA, 40 bp, Artificial Sequence
  PCR primer for ORF amplification
caggagctgcacttccggaacgttctcttgtcaaaaattt

SEQ ID NO: 13311 - DNA, 40 bp, Artificial Sequence
  PCR primer for ORF amplification
caggagctgcacttccgttagttaaagaagaggaactcat

SEQ ID NO: 13312 - DNA, 40 bp, Artificial Sequence
  PCR primer for ORF amplification
caggagctgcacttccagcattggaacacggtattgctgc

SEQ ID NO: 13313 - DNA, 40 bp, Artificial Sequence
  PCR primer for ORF amplification
caggagctgcacttccagttattacgggcttggattcaca

SEQ ID NO: 13314 - DNA, 40 bp, Artificial Sequence
  PCR primer for ORF amplification
caggagctgcacttcctttaagaagaattgtttgaatgtt

SEQ ID NO: 13315 - DNA, 40 bp, Artificial Sequence
  PCR primer for ORF amplification
caggagctgcacttcccttgtagtttttttccagctcaat

SEQ ID NO: 13316 - DNA, 40 bp, Artificial Sequence
  PCR primer for ORF amplification
caggagctgcacttcctagagaaggagacattgaaacatc

SEQ ID NO: 13317 - DNA, 40 bp, Artificial Sequence
  PCR primer for ORF amplification
caggagctgcacttccagtacttactataacgtcgacatc

SEQ ID NO: 13318 - DNA, 40 bp, Artificial Sequence
  PCR primer for ORF amplification
caggagctgcacttccaaatcgttcctgtggtcgctttgc

SEQ ID NO: 13319 - DNA, 40 bp, Artificial Sequence
  PCR primer for ORF amplification
caggagctgcacttcctcttctcagagcccattctggata

SEQ ID NO: 13320 - DNA, 40 bp, Artificial Sequence
  PCR primer for ORF amplification
caggagctgcacttccagtgtcttgatcatgttctggtgt

SEQ ID NO: 13321 - DNA, 40 bp, Artificial Sequence
  PCR primer for ORF amplification
caggagctgcacttcctattttatatgttgcggatgaatt

SEQ ID NO: 13322 - DNA, 40 bp, Artificial Sequence
  PCR primer for ORF amplification
caggagctgcacttccattcttctttttcttgtctttact

SEQ ID NO: 13323 - DNA, 40 bp, Artificial Sequence
  PCR primer for ORF amplification
caggagctgcacttccttggttcagtttttcttcgatata

SEQ ID NO: 13324 - DNA, 40 bp, Artificial Sequence
  PCR primer for ORF amplification
caggagctgcacttccaaacaataacatagcaacaaggca

SEQ ID NO: 13325 - DNA, 40 bp, Artificial Sequence
  PCR primer for ORF amplification
caggagctgcacttccaattttgcttttcttactggcttt

SEQ ID NO: 13326 - DNA, 40 bp, Artificial Sequence
  PCR primer for ORF amplification
caggagctgcacttcccggcaactgcgcaataacacagtc

SEQ ID NO: 13327 - DNA, 40 bp, Artificial Sequence
  PCR primer for ORF amplification
caggagctgcacttccccataacaacatttttctagggtc

SEQ ID NO: 13328 - DNA, 40 bp, Artificial Sequence
  PCR primer for ORF amplification
caggagctgcacttcccaaataatttgcggaagtttctaa

SEQ ID NO: 13329 - DNA, 40 bp, Artificial Sequence
  PCR primer for ORF amplification
caggagctgcacttccatttaattgggatttcaaattatc

SEQ ID NO: 13330 - DNA, 40 bp, Artificial Sequence
  PCR primer for ORF amplification
caggagctgcacttccaaattttaagctgcttagtgtatt

SEQ ID NO: 13331 - DNA, 40 bp, Artificial Sequence
  PCR primer for ORF amplification
caggagctgcacttcctataggcgtaccatcaaccttttt

SEQ ID NO: 13332 - DNA, 40 bp, Artificial Sequence
  PCR primer for ORF amplification
caggagctgcacttccatacatttctaactcttcctcaga

SEQ ID NO: 13333 - DNA, 40 bp, Artificial Sequence
  PCR primer for ORF amplification
caggagctgcacttcctgatattgactcgacaaaatctaa

SEQ ID NO: 13334 - DNA, 40 bp, Artificial Sequence
  PCR primer for ORF amplification
caggagctgcacttccatttgtaacgtgttcattttcttt

SEQ ID NO: 13335 - DNA, 40 bp, Artificial Sequence
  PCR primer for ORF amplification
caggagctgcacttccagtttctgtgccaggcataccttc

SEQ ID NO: 13336 - DNA, 40 bp, Artificial Sequence
  PCR primer for ORF amplification
caggagctgcacttcccctgattttagaaaacaaatttaa

SEQ ID NO: 13337 - DNA, 40 bp, Artificial Sequence
  PCR primer for ORF amplification
caggagctgcacttccttgcaagtgggaacggccggcctt

SEQ ID NO: 13338 - DNA, 40 bp, Artificial Sequence
  PCR primer for ORF amplification
caggagctgcacttccatcctcgtcttcgtcgtcctcgat

SEQ ID NO: 13339 - DNA, 40 bp, Artificial Sequence
  PCR primer for ORF amplification
caggagctgcacttcctatattaaaatcggtattagcgtc

SEQ ID NO: 13340 - DNA, 40 bp, Artificial Sequence
  PCR primer for ORF amplification
caggagctgcacttccattccagagcttgatagacctatc

SEQ ID NO: 13341 - DNA, 40 bp, Artificial Sequence
  PCR primer for ORF amplification
caggagctgcacttcccttaaatagcttcttcaatttgcc

SEQ ID NO: 13342 - DNA, 40 bp, Artificial Sequence
  PCR primer for ORF amplification
caggagctgcacttcccaatttcgaactcttaatattcaa

SEQ ID NO: 13343 - DNA, 40 bp, Artificial Sequence
  PCR primer for ORF amplification
caggagctgcacttccttccggatttatcggctcgttccc

SEQ ID NO: 13344 - DNA, 40 bp, Artificial Sequence
  PCR primer for ORF amplification
caggagctgcacttcctttgtcatgaggaaacttctcttc

SEQ ID NO: 13345 - DNA, 40 bp, Artificial Sequence
  PCR primer for ORF amplification
caggagctgcacttcctatgcttaaacctggcaatgtgga

SEQ ID NO: 13346 - DNA, 40 bp, Artificial Sequence
  PCR primer for ORF amplification
caggagctgcacttccaggaagcgcatctacatcttcttt

SEQ ID NO: 13347 - DNA, 40 bp, Artificial Sequence
  PCR primer for ORF amplification
caggagctgcacttccatttgctgaaccactgctatcaat

SEQ ID NO: 13348 - DNA, 40 bp, Artificial Sequence
  PCR primer for ORF amplification
caggagctgcacttccgcccgatggggttattatagacca

SEQ ID NO: 13349 - DNA, 40 bp, Artificial Sequence
  PCR primer for ORF amplification
caggagctgcacttccatcgagttcagagtctatgtatac

SEQ ID NO: 13350 - DNA, 40 bp, Artificial Sequence
  PCR primer for ORF amplification
caggagctgcacttcccttttcgaacattttattgagaac

SEQ ID NO: 13351 - DNA, 40 bp, Artificial Sequence
  PCR primer for ORF amplification
caggagctgcacttccctgttttaataaagtgtcgttgta

SEQ ID NO: 13352 - DNA, 40 bp, Artificial Sequence
  PCR primer for ORF amplification
caggagctgcacttccatgcttcttccatctttgatctac

SEQ ID NO: 13353 - DNA, 40 bp, Artificial Sequence
  PCR primer for ORF amplification
caggagctgcacttccattggtgaaaaattccataagaga

SEQ ID NO: 13354 - DNA, 40 bp, Artificial Sequence
  PCR primer for ORF amplification
caggagctgcacttccattatattgcatataacgcgatgt

SEQ ID NO: 13355 - DNA, 40 bp, Artificial Sequence
  PCR primer for ORF amplification
caggagctgcacttccccctgtaaagtagtccataatgaa

SEQ ID NO: 13356 - DNA, 40 bp, Artificial Sequence
  PCR primer for ORF amplification
caggagctgcacttcctaagacataacctaggatgacaca

SEQ ID NO: 13357 - DNA, 40 bp, Artificial Sequence
  PCR primer for ORF amplification
caggagctgcacttccatcgtcgtaacctctgccaatgaa

SEQ ID NO: 13358 - DNA, 40 bp, Artificial Sequence
  PCR primer for ORF amplification
caggagctgcacttccctcgcctatgagctcaatatggcc

SEQ ID NO: 13359 - DNA, 40 bp, Artificial Sequence
  PCR primer for ORF amplification
caggagctgcacttccttgtctcaatagactggcgttgta

SEQ ID NO: 13360 - DNA, 40 bp, Artificial Sequence
  PCR primer for ORF amplification
caggagctgcacttccttgttttaatagggtatcgttgta

SEQ ID NO: 13361 - DNA, 40 bp, Artificial Sequence
  PCR primer for ORF amplification
caggagctgcacttccgtataaatttaagtaatctttcat

SEQ ID NO: 13362 - DNA, 40 bp, Artificial Sequence
  PCR primer for ORF amplification
caggagctgcacttccgtcgaagcattctgtcttgcccaa

SEQ ID NO: 13363 - DNA, 40 bp, Artificial Sequence
  PCR primer for ORF amplification
caggagctgcacttccaggaattatgtcgtcttcatcttt

SEQ ID NO: 13364 - DNA, 40 bp, Artificial Sequence
  PCR primer for ORF amplification
caggagctgcacttcccaaatcgactggcgtaggatgtat

SEQ ID NO: 13365 - DNA, 40 bp, Artificial Sequence
  PCR primer for ORF amplification
caggagctgcacttccttcaatttcttcaatcttggaacc

SEQ ID NO: 13366 - DNA, 40 bp, Artificial Sequence
  PCR primer for ORF amplification
caggagctgcacttccttgattcactaaggatgcgttata

SEQ ID NO: 13367 - DNA, 40 bp, Artificial Sequence
  PCR primer for ORF amplification
caggagctgcacttccttcaagttctactgatactttact

SEQ ID NO: 13368 - DNA, 40 bp, Artificial Sequence
  PCR primer for ORF amplification
caggagctgcacttccatatagcaatctaattgagatctt

SEQ ID NO: 13369 - DNA, 40 bp, Artificial Sequence
  PCR primer for ORF amplification
caggagctgcacttcccgtttgaacaggtgaataaaaatg

SEQ ID NO: 13370 - DNA, 40 bp, Artificial Sequence
  PCR primer for ORF amplification
caggagctgcacttcccacagccaatgggtattcgccagc

SEQ ID NO: 13371 - DNA, 40 bp, Artificial Sequence
  PCR primer for ORF amplification
caggagctgcacttccgtttgcttggttcaaaaagtctcg

SEQ ID NO: 13372 - DNA, 40 bp, Artificial Sequence
  PCR primer for ORF amplification
caggagctgcacttccgtataataacctgatggaaacttt

SEQ ID NO: 13373 - DNA, 40 bp, Artificial Sequence
  PCR primer for ORF amplification
caggagctgcacttcctctgagttctacgctgtattcttt

SEQ ID NO: 13374 - DNA, 40 bp, Artificial Sequence
  PCR primer for ORF amplification
caggagctgcacttccatttttcttgtcttctatcaacca

SEQ ID NO: 13375 - DNA, 40 bp, Artificial Sequence
  PCR primer for ORF amplification
caggagctgcacttcctttatgtataccagagcagaaaca

SEQ ID NO: 13376 - DNA, 40 bp, Artificial Sequence
  PCR primer for ORF amplification
caggagctgcacttccgggaataatgtcgacttcatcctt

SEQ ID NO: 13377 - DNA, 40 bp, Artificial Sequence
  PCR primer for ORF amplification
caggagctgcacttcctttttgtccctttatatcaatttt

SEQ ID NO: 13378 - DNA, 40 bp, Artificial Sequence
  PCR primer for ORF amplification
caggagctgcacttccagggcctgcagtattttctgaact

SEQ ID NO: 13379 - DNA, 40 bp, Artificial Sequence
  PCR primer for ORF amplification
caggagctgcacttccattttctttatctttttcagactc

SEQ ID NO: 13380 - DNA, 40 bp, Artificial Sequence
  PCR primer for ORF amplification
caggagctgcacttcccagttcgtaaaacttcataagttc

SEQ ID NO: 13381 - DNA, 40 bp, Artificial Sequence
  PCR primer for ORF amplification
caggagctgcacttcccttgcggtcattggcaatagattc

SEQ ID NO: 13382 - DNA, 40 bp, Artificial Sequence
  PCR primer for ORF amplification
caggagctgcacttccagcatcatctatttctcgaaaagt

SEQ ID NO: 13383 - DNA, 40 bp, Artificial Sequence
  PCR primer for ORF amplification
caggagctgcacttccagtaggcttgcgtgcatgcagggg

SEQ ID NO: 13384 - DNA, 40 bp, Artificial Sequence
  PCR primer for ORF amplification
caggagctgcacttccatttacttgacgaatggtgtagaa

SEQ ID NO: 13385 - DNA, 40 bp, Artificial Sequence
  PCR primer for ORF amplification
caggagctgcacttccacttttacttacaggaggtactgg

SEQ ID NO: 13386 - DNA, 40 bp, Artificial Sequence
  PCR primer for ORF amplification
caggagctgcacttccaaaaaataaactaaaagtaaaaaa

SEQ ID NO: 13387 - DNA, 40 bp, Artificial Sequence
  PCR primer for ORF amplification
caggagctgcacttccttgcttaagtaggtgtgagtcctc

SEQ ID NO: 13388 - DNA, 40 bp, Artificial Sequence
  PCR primer for ORF amplification
caggagctgcacttccgcttgtatctgagaattttctttt

SEQ ID NO: 13389 - DNA, 40 bp, Artificial Sequence
  PCR primer for ORF amplification
caggagctgcacttccctcatgcaatgtcataatatcata

SEQ ID NO: 13390 - DNA, 40 bp, Artificial Sequence
  PCR primer for ORF amplification
caggagctgcacttccttccgtagtatccatggcatcagg

SEQ ID NO: 13391 - DNA, 40 bp, Artificial Sequence
  PCR primer for ORF amplification
caggagctgcacttcctaattcattaactgatttggctaa

SEQ ID NO: 13392 - DNA, 40 bp, Artificial Sequence
  PCR primer for ORF amplification
caggagctgcacttcctataataccaatttttttaaggtt

SEQ ID NO: 13393 - DNA, 40 bp, Artificial Sequence
  PCR primer for ORF amplification
caggagctgcacttcctatgctcaatgatgccagtgtttt

SEQ ID NO: 13394 - DNA, 40 bp, Artificial Sequence
  PCR primer for ORF amplification
caggagctgcacttccagggtctatgtcttcattatcctt

SEQ ID NO: 13395 - DNA, 40 bp, Artificial Sequence
  PCR primer for ORF amplification
caggagctgcacttccaaaatggatgtcggcacctaagag

SEQ ID NO: 13396 - DNA, 40 bp, Artificial Sequence
  PCR primer for ORF amplification
caggagctgcacttccgacaaatagtagcgaggaccaagt

SEQ ID NO: 13397 - DNA, 40 bp, Artificial Sequence
  PCR primer for ORF amplification
caggagctgcacttccgaaaacataaggaataaagacgta

SEQ ID NO: 13398 - DNA, 40 bp, Artificial Sequence
  PCR primer for ORF amplification
caggagctgcacttccatagtaattctcgtaatcaaatct

SEQ ID NO: 13399 - DNA, 40 bp, Artificial Sequence
  PCR primer for ORF amplification
caggagctgcacttcctactaatttatgatcaccgtcggc

SEQ ID NO: 13400 - DNA, 40 bp, Artificial Sequence
  PCR primer for ORF amplification
caggagctgcacttccgactctcctaggtaattgtttata

SEQ ID NO: 13401 - DNA, 40 bp, Artificial Sequence
  PCR primer for ORF amplification
caggagctgcacttccctttcttcttgttagtatactatt

SEQ ID NO: 13402 - DNA, 40 bp, Artificial Sequence
  PCR primer for ORF amplification
caggagctgcacttcccaagcccttcgatcttgctatata

SEQ ID NO: 13403 - DNA, 40 bp, Artificial Sequence
  PCR primer for ORF amplification
caggagctgcacttcctcttcttgttttaggtttcgccag

SEQ ID NO: 13404 - DNA, 40 bp, Artificial Sequence
  PCR primer for ORF amplification
caggagctgcacttcctcctatatgtgtagcataatttgt

SEQ ID NO: 13405 - DNA, 40 bp, Artificial Sequence
  PCR primer for ORF amplification
caggagctgcacttcccatatcgtcatcaccagaatcttc

SEQ ID NO: 13406 - DNA, 40 bp, Artificial Sequence
  PCR primer for ORF amplification
caggagctgcacttcccaaatcattccatccaaataacca

SEQ ID NO: 13407 - DNA, 40 bp, Artificial Sequence
  PCR primer for ORF amplification
caggagctgcacttcccgtcagccttattgtataatcatc

SEQ ID NO: 13408 - DNA, 40 bp, Artificial Sequence
  PCR primer for ORF amplification
caggagctgcacttcctgctcctactttgctttcttcttc

SEQ ID NO: 13409 - DNA, 40 bp, Artificial Sequence
  PCR primer for ORF amplification
caggagctgcacttccattgtataagacgaaatgagcttt

SEQ ID NO: 13410 - DNA, 40 bp, Artificial Sequence
  PCR primer for ORF amplification
caggagctgcacttccgttagttacgttcatgttcaaagt

SEQ ID NO: 13411 - DNA, 40 bp, Artificial Sequence
  PCR primer for ORF amplification
caggagctgcacttcctaatccgggaggcccttgcagtcc

SEQ ID NO: 13412 - DNA, 40 bp, Artificial Sequence
  PCR primer for ORF amplification
caggagctgcacttcctaggcctactctttttggaatcga

SEQ ID NO: 13413 - DNA, 40 bp, Artificial Sequence
  PCR primer for ORF amplification
caggagctgcacttcctttggattcagcaatcttcttctt

SEQ ID NO: 13414 - DNA, 40 bp, Artificial Sequence
  PCR primer for ORF amplification
caggagctgcacttccctgtgcatttctgattacatttag

SEQ ID NO: 13415 - DNA, 40 bp, Artificial Sequence
  PCR primer for ORF amplification
caggagctgcacttcccttggtgattgacataccagcttc

SEQ ID NO: 13416 - DNA, 40 bp, Artificial Sequence
  PCR primer for ORF amplification
caggagctgcacttcctttcttataaactaacatagcaac

SEQ ID NO: 13417 - DNA, 40 bp, Artificial Sequence
  PCR primer for ORF amplification
caggagctgcacttccgtttgttgcgttcgtagcctgcga

SEQ ID NO: 13418 - DNA, 40 bp, Artificial Sequence
  PCR primer for ORF amplification
caggagctgcacttcctttttctaatactataccacttct

SEQ ID NO: 13419 - DNA, 40 bp, Artificial Sequence
  PCR primer for ORF amplification
caggagctgcacttcctttctcgctcaagaaagtttgcag

SEQ ID NO: 13420 - DNA, 40 bp, Artificial Sequence
  PCR primer for ORF amplification
caggagctgcacttcccatatgggattttgattgattcaa

SEQ ID NO: 13421 - DNA, 40 bp, Artificial Sequence
  PCR primer for ORF amplification
caggagctgcacttccccaaaaaccatccaatttcttacc

SEQ ID NO: 13422 - DNA, 40 bp, Artificial Sequence
  PCR primer for ORF amplification
caggagctgcacttcctattttttgtttcttagctccatg

SEQ ID NO: 13423 - DNA, 40 bp, Artificial Sequence
  PCR primer for ORF amplification
caggagctgcacttccgttgggggaaaggatcttgaagac

SEQ ID NO: 13424 - DNA, 40 bp, Artificial Sequence
  PCR primer for ORF amplification
caggagctgcacttcctattaccaaaacctgagagatttt

SEQ ID NO: 13425 - DNA, 40 bp, Artificial Sequence
  PCR primer for ORF amplification
caggagctgcacttccgaaacacttgtggtgaacgataga

SEQ ID NO: 13426 - DNA, 40 bp, Artificial Sequence
  PCR primer for ORF amplification
caggagctgcacttccataattaagatataaactgccatc

SEQ ID NO: 13427 - DNA, 40 bp, Artificial Sequence
  PCR primer for ORF amplification
caggagctgcacttcctttgaaggtatatccaatgattgc

SEQ ID NO: 13428 - DNA, 40 bp, Artificial Sequence
  PCR primer for ORF amplification
caggagctgcacttccaagacccatacggtcaatgacata

SEQ ID NO: 13429 - DNA, 40 bp, Artificial Sequence
  PCR primer for ORF amplification
caggagctgcacttccaatatctgattctggctcttcctt

SEQ ID NO: 13430 - DNA, 40 bp, Artificial Sequence
  PCR primer for ORF amplification
caggagctgcacttccttcgtgaatatcgctgaagtaatc

SEQ ID NO: 13431 - DNA, 40 bp, Artificial Sequence
  PCR primer for ORF amplification
caggagctgcacttccttgtatgacaggtactcttctcaa

SEQ ID NO: 13432 - DNA, 40 bp, Artificial Sequence
  PCR primer for ORF amplification
caggagctgcacttcctgattgcaggtcttgtaagtgttg

SEQ ID NO: 13433 - DNA, 40 bp, Artificial Sequence
  PCR primer for ORF amplification
caggagctgcacttcctttggtctcaattttaatattttt

SEQ ID NO: 13434 - DNA, 40 bp, Artificial Sequence
  PCR primer for ORF amplification
caggagctgcacttccgttcttactttcgattttctttac

SEQ ID NO: 13435 - DNA, 40 bp, Artificial Sequence
  PCR primer for ORF amplification
caggagctgcacttcctttctcatttcctcctaatgtgtc

SEQ ID NO: 13436 - DNA, 40 bp, Artificial Sequence
  PCR primer for ORF amplification
caggagctgcacttcctctgcaatctgcaatcttagtttc

SEQ ID NO: 13437 - DNA, 40 bp, Artificial Sequence
  PCR primer for ORF amplification
caggagctgcacttccttggtttatgtgggatttccactc

SEQ ID NO: 13438 - DNA, 40 bp, Artificial Sequence
  PCR primer for ORF amplification
caggagctgcacttcccatcaaatcagaaaatcctggaac

SEQ ID NO: 13439 - DNA, 40 bp, Artificial Sequence
  PCR primer for ORF amplification
caggagctgcacttcctttatgacctgcatttttatcagc

SEQ ID NO: 13440 - DNA, 40 bp, Artificial Sequence
  PCR primer for ORF amplification
caggagctgcacttcctatttggcagtgctgtccatcaga

SEQ ID NO: 13441 - DNA, 40 bp, Artificial Sequence
  PCR primer for ORF amplification
caggagctgcacttccaaccttttttttcttgcggacagg

SEQ ID NO: 13442 - DNA, 40 bp, Artificial Sequence
  PCR primer for ORF amplification
caggagctgcacttccgttttctggcgattcagagtaata

SEQ ID NO: 13443 - DNA, 40 bp, Artificial Sequence
  PCR primer for ORF amplification
caggagctgcacttcctgcttcattgtaagactcctcact

SEQ ID NO: 13444 - DNA, 40 bp, Artificial Sequence
  PCR primer for ORF amplification
caggagctgcacttcctttcttttcgaaatagtccgccat

SEQ ID NO: 13445 - DNA, 40 bp, Artificial Sequence
  PCR primer for ORF amplification
caggagctgcacttccatcctttaacactttcttaactat

SEQ ID NO: 13446 - DNA, 40 bp, Artificial Sequence
  PCR primer for ORF amplification
caggagctgcacttccgttcttgttgagttgcacgtagtt

SEQ ID NO: 13447 - DNA, 40 bp, Artificial Sequence
  PCR primer for ORF amplification
caggagctgcacttccaacatttaacttgacttgttcatc

SEQ ID NO: 13448 - DNA, 40 bp, Artificial Sequence
  PCR primer for ORF amplification
caggagctgcacttccaaaccaacccttcttcttgggact

SEQ ID NO: 13449 - DNA, 40 bp, Artificial Sequence
  PCR primer for ORF amplification
caggagctgcacttccaacgtcctcaaactcaatgtccat

SEQ ID NO: 13450 - DNA, 40 bp, Artificial Sequence
  PCR primer for ORF amplification
caggagctgcacttccttttttgtcctttttggccaattt

SEQ ID NO: 13451 - DNA, 40 bp, Artificial Sequence
  PCR primer for ORF amplification
caggagctgcacttcccctaatccttctaaacttattgtt

SEQ ID NO: 13452 - DNA, 40 bp, Artificial Sequence
  PCR primer for ORF amplification
caggagctgcacttccatcatccatttcatccgctctctt

SEQ ID NO: 13453 - DNA, 40 bp, Artificial Sequence
  PCR primer for ORF amplification
caggagctgcacttcccaatagcatttccaaaggattttc

SEQ ID NO: 13454 - DNA, 40 bp, Artificial Sequence
  PCR primer for ORF amplification
caggagctgcacttcccacaagagtacttttgaaggctgc

SEQ ID NO: 13455 - DNA, 40 bp, Artificial Sequence
  PCR primer for ORF amplification
caggagctgcacttcctctcatagtaaccaattcttctgc

SEQ ID NO: 13456 - DNA, 40 bp, Artificial Sequence
  PCR primer for ORF amplification
caggagctgcacttccattgacatcaatcattaaatcatc

SEQ ID NO: 13457 - DNA, 40 bp, Artificial Sequence
  PCR primer for ORF amplification
caggagctgcacttcctagtcttccttgggagtacagtag

SEQ ID NO: 13458 - DNA, 40 bp, Artificial Sequence
  PCR primer for ORF amplification
caggagctgcacttcccagccttacttgaaaattgcctgt

SEQ ID NO: 13459 - DNA, 40 bp, Artificial Sequence
  PCR primer for ORF amplification
caggagctgcacttcctttcttagatttcttagatttctt

SEQ ID NO: 13460 - DNA, 40 bp, Artificial Sequence
  PCR primer for ORF amplification
caggagctgcacttcctaaaaatgccagaccaagaccaaa

SEQ ID NO: 13461 - DNA, 40 bp, Artificial Sequence
  PCR primer for ORF amplification
caggagctgcacttccatgtttatgggtgtgagtatcggc

SEQ ID NO: 13462 - DNA, 40 bp, Artificial Sequence
  PCR primer for ORF amplification
caggagctgcacttcctagaagaagcccgctctttgattg

SEQ ID NO: 13463 - DNA, 40 bp, Artificial Sequence
  PCR primer for ORF amplification
caggagctgcacttccaaaatattttctatctaatccaaa

SEQ ID NO: 13464 - DNA, 40 bp, Artificial Sequence
  PCR primer for ORF amplification
caggagctgcacttccgtctttctcactctctttctcgag

SEQ ID NO: 13465 - DNA, 40 bp, Artificial Sequence
  PCR primer for ORF amplification
caggagctgcacttcctcttttgtgatagttcttcttttt

SEQ ID NO: 13466 - DNA, 40 bp, Artificial Sequence
  PCR primer for ORF amplification
caggagctgcacttcctttctttgatttcgtttttttcac

SEQ ID NO: 13467 - DNA, 40 bp, Artificial Sequence
  PCR primer for ORF amplification
caggagctgcacttccttcgcataattcatgaatgaactt

SEQ ID NO: 13468 - DNA, 40 bp, Artificial Sequence
  PCR primer for ORF amplification
caggagctgcacttccactcagagaggaattgttcacgtt

SEQ ID NO: 13469 - DNA, 40 bp, Artificial Sequence
  PCR primer for ORF amplification
caggagctgcacttcctaaaaccaagttataaagttctgc

SEQ ID NO: 13470 - DNA, 40 bp, Artificial Sequence
  PCR primer for ORF amplification
caggagctgcacttccagcgccaatgataccaagagactt

SEQ ID NO: 13471 - DNA, 40 bp, Artificial Sequence
  PCR primer for ORF amplification
caggagctgcacttcccagaaaatcaatcattttgcaata

SEQ ID NO: 13472 - DNA, 40 bp, Artificial Sequence
  PCR primer for ORF amplification
caggagctgcacttccagtttctcttgcttccttcgtctc

SEQ ID NO: 13473 - DNA, 40 bp, Artificial Sequence
  PCR primer for ORF amplification
caggagctgcacttccaaattcctcttcctcagcgtatga

SEQ ID NO: 13474 - DNA, 40 bp, Artificial Sequence
  PCR primer for ORF amplification
caggagctgcacttccagcaccgatgataccaacggactt

SEQ ID NO: 13475 - DNA, 40 bp, Artificial Sequence
  PCR primer for ORF amplification
caggagctgcacttccgccgctcctcttggtctccggaac

SEQ ID NO: 13476 - DNA, 40 bp, Artificial Sequence
  PCR primer for ORF amplification
caggagctgcacttccctcaaccttgatatcggacaatcc

SEQ ID NO: 13477 - DNA, 40 bp, Artificial Sequence
  PCR primer for ORF amplification
caggagctgcacttccataaaagttcccatgcgattggtt

SEQ ID NO: 13478 - DNA, 40 bp, Artificial Sequence
  PCR primer for ORF amplification
caggagctgcacttccccccgaaccaaattctaaaagata

SEQ ID NO: 13479 - DNA, 40 bp, Artificial Sequence
  PCR primer for ORF amplification
caggagctgcacttcctttaccatttctcaagtaatacat

SEQ ID NO: 13480 - DNA, 40 bp, Artificial Sequence
  PCR primer for ORF amplification
caggagctgcacttccaattctgagttttctactttttaa

SEQ ID NO: 13481 - DNA, 40 bp, Artificial Sequence
  PCR primer for ORF amplification
caggagctgcacttcctaatggtttcgaggctaacttcga

SEQ ID NO: 13482 - DNA, 40 bp, Artificial Sequence
  PCR primer for ORF amplification
caggagctgcacttccctgcaccccaataacgctcaactc

SEQ ID NO: 13483 - DNA, 40 bp, Artificial Sequence
  PCR primer for ORF amplification
caggagctgcacttcccaacttgttaacattgcttgcttt

SEQ ID NO: 13484 - DNA, 40 bp, Artificial Sequence
  PCR primer for ORF amplification
caggagctgcacttccccagttggtaacttcttcggcctc

SEQ ID NO: 13485 - DNA, 40 bp, Artificial Sequence
  PCR primer for ORF amplification
caggagctgcacttccacaatttctccgacaacgctgaca

SEQ ID NO: 13486 - DNA, 40 bp, Artificial Sequence
  PCR primer for ORF amplification
caggagctgcacttccattgttaccgggtgggtctttact

SEQ ID NO: 13487 - DNA, 40 bp, Artificial Sequence
  PCR primer for ORF amplification
caggagctgcacttccaatgtcaatcttgaccgtctctgc

SEQ ID NO: 13488 - DNA, 40 bp, Artificial Sequence
  PCR primer for ORF amplification
caggagctgcacttccttttttctttctacccccagcttg

SEQ ID NO: 13489 - DNA, 40 bp, Artificial Sequence
  PCR primer for ORF amplification
caggagctgcacttcctagtagcatggcggcaacagcagc

SEQ ID NO: 13490 - DNA, 40 bp, Artificial Sequence
  PCR primer for ORF amplification
caggagctgcacttccgtagccagcccaaacctcgctgta

SEQ ID NO: 13491 - DNA, 40 bp, Artificial Sequence
  PCR primer for ORF amplification
caggagctgcacttccatcttccgttaagattcctttaat

SEQ ID NO: 13492 - DNA, 40 bp, Artificial Sequence
  PCR primer for ORF amplification
caggagctgcacttcctttaggacctagcatgtgttcagg

SEQ ID NO: 13493 - DNA, 40 bp, Artificial Sequence
  PCR primer for ORF amplification
caggagctgcacttcccttttcttgagtatcacgtttgtc

SEQ ID NO: 13494 - DNA, 40 bp, Artificial Sequence
  PCR primer for ORF amplification
caggagctgcacttccaatctggtagacttgctggccggc

SEQ ID NO: 13495 - DNA, 40 bp, Artificial Sequence
  PCR primer for ORF amplification
caggagctgcacttccttttgctggctttttccaaaaata

SEQ ID NO: 13496 - DNA, 40 bp, Artificial Sequence
  PCR primer for ORF amplification
caggagctgcacttccgtgtttctttttaagtgttccgtt

SEQ ID NO: 13497 - DNA, 40 bp, Artificial Sequence
  PCR primer for ORF amplification
caggagctgcacttccaggaagaaacatcatctgttccgg

SEQ ID NO: 13498 - DNA, 40 bp, Artificial Sequence
  PCR primer for ORF amplification
caggagctgcacttccagaagagtccgcctggatatcaga

SEQ ID NO: 13499 - DNA, 40 bp, Artificial Sequence
  PCR primer for ORF amplification
caggagctgcacttccttcatcatatagactggagctgcg

SEQ ID NO: 13500 - DNA, 40 bp, Artificial Sequence
  PCR primer for ORF amplification
caggagctgcacttccttccattatattctcgttaaattt

SEQ ID NO: 13501 - DNA, 40 bp, Artificial Sequence
  PCR primer for ORF amplification
caggagctgcacttcctgcttcttttgcgtgatgcaattt

SEQ ID NO: 13502 - DNA, 40 bp, Artificial Sequence
  PCR primer for ORF amplification
caggagctgcacttcctggtctcaaagaggtgtttctatt

SEQ ID NO: 13503 - DNA, 40 bp, Artificial Sequence
  PCR primer for ORF amplification
caggagctgcacttcctctaaacctatcgttaagcaatct

SEQ ID NO: 13504 - DNA, 40 bp, Artificial Sequence
  PCR primer for ORF amplification
caggagctgcacttccagcttggtatgtagaggaagaaac

SEQ ID NO: 13505 - DNA, 40 bp, Artificial Sequence
  PCR primer for ORF amplification
caggagctgcacttcctttgttgtgactaacaataaggtt

SEQ ID NO: 13506 - DNA, 40 bp, Artificial Sequence
  PCR primer for ORF amplification
caggagctgcacttccatctctttcaaaacagacagcaaa

SEQ ID NO: 13507 - DNA, 40 bp, Artificial Sequence
  PCR primer for ORF amplification
caggagctgcacttccgtgatatgagtagccacatccttt

SEQ ID NO: 13508 - DNA, 40 bp, Artificial Sequence
  PCR primer for ORF amplification
caggagctgcacttccaacgaatcctttctttattgcttc

SEQ ID NO: 13509 - DNA, 40 bp, Artificial Sequence
  PCR primer for ORF amplification
caggagctgcacttccggcttcatctgaacggttgaatac

SEQ ID NO: 13510 - DNA, 40 bp, Artificial Sequence
  PCR primer for ORF amplification
caggagctgcacttcctagcttaatgaatattctttttct

SEQ ID NO: 13511 - DNA, 40 bp, Artificial Sequence
  PCR primer for ORF amplification
caggagctgcacttcccatagcacctggaacacccaagac

SEQ ID NO: 13512 - DNA, 40 bp, Artificial Sequence
  PCR primer for ORF amplification
caggagctgcacttccgacaacaatttcagattctatgga

SEQ ID NO: 13513 - DNA, 40 bp, Artificial Sequence
  PCR primer for ORF amplification
caggagctgcacttccgatatcacctgggacagggtattg

SEQ ID NO: 13514 - DNA, 40 bp, Artificial Sequence
  PCR primer for ORF amplification
caggagctgcacttccaactagttcaacgtaatttgctgg

SEQ ID NO: 13515 - DNA, 40 bp, Artificial Sequence
  PCR primer for ORF amplification
caggagctgcacttccttttttaacatcgtaagatcttct

SEQ ID NO: 13516 - DNA, 40 bp, Artificial Sequence
  PCR primer for ORF amplification
caggagctgcacttcccaaatttttcataaaatcacgcct

SEQ ID NO: 13517 - DNA, 40 bp, Artificial Sequence
  PCR primer for ORF amplification
caggagctgcacttcctttttccttcttctccacttggac

SEQ ID NO: 13518 - DNA, 40 bp, Artificial Sequence
  PCR primer for ORF amplification
caggagctgcacttccactaccagaacctattaattctgt

SEQ ID NO: 13519 - DNA, 40 bp, Artificial Sequence
  PCR primer for ORF amplification
caggagctgcacttccaacgaggcagatttccctggactg

SEQ ID NO: 13520 - DNA, 40 bp, Artificial Sequence
  PCR primer for ORF amplification
caggagctgcacttccccaggtgctcccaacagagacgag

SEQ ID NO: 13521 - DNA, 40 bp, Artificial Sequence
  PCR primer for ORF amplification
caggagctgcacttccttttggagttccacattttcttga

SEQ ID NO: 13522 - DNA, 40 bp, Artificial Sequence
  PCR primer for ORF amplification
caggagctgcacttccgtacctcacctcgtaagaaccggc

SEQ ID NO: 13523 - DNA, 40 bp, Artificial Sequence
  PCR primer for ORF amplification
caggagctgcacttccgtaaagaataatactgtccaaaca

SEQ ID NO: 13524 - DNA, 40 bp, Artificial Sequence
  PCR primer for ORF amplification
caggagctgcacttccgactacagtataaaaataaataaa

SEQ ID NO: 13525 - DNA, 40 bp, Artificial Sequence
  PCR primer for ORF amplification
caggagctgcacttccttcatgcaaggtcattatatcata

SEQ ID NO: 13526 - DNA, 40 bp, Artificial Sequence
  PCR primer for ORF amplification
caggagctgcacttcccactttatctaattgtagtttctt

SEQ ID NO: 13527 - DNA, 40 bp, Artificial Sequence
  PCR primer for ORF amplification
caggagctgcacttccggttcttggatcttgctgatgctg

SEQ ID NO: 13528 - DNA, 40 bp, Artificial Sequence
  PCR primer for ORF amplification
caggagctgcacttccttttcttctttcctttgggcggct

SEQ ID NO: 13529 - DNA, 40 bp, Artificial Sequence
  PCR primer for ORF amplification
caggagctgcacttcccgaaataagatcggctaaagcttt

SEQ ID NO: 13530 - DNA, 40 bp, Artificial Sequence
  PCR primer for ORF amplification
caggagctgcacttccatgttctaatatattcaatatcag

SEQ ID NO: 13531 - DNA, 40 bp, Artificial Sequence
  PCR primer for ORF amplification
caggagctgcacttccacgcatttctattataaaacactt

SEQ ID NO: 13532 - DNA, 40 bp, Artificial Sequence
  PCR primer for ORF amplification
caggagctgcacttcccctattggcaggatcttcttgatg

SEQ ID NO: 13533 - DNA, 40 bp, Artificial Sequence
  PCR primer for ORF amplification
caggagctgcacttcctaaatcatcaaacttcttgatccc

SEQ ID NO: 13534 - DNA, 40 bp, Artificial Sequence
  PCR primer for ORF amplification
caggagctgcacttcctgtgtttcctaatgcctgtcttgt

SEQ ID NO: 13535 - DNA, 40 bp, Artificial Sequence
  PCR primer for ORF amplification
caggagctgcacttccagcttggtaggttgaggaagatat

SEQ ID NO: 13536 - DNA, 40 bp, Artificial Sequence
  PCR primer for ORF amplification
caggagctgcacttccaaaatcgatggattctgcagatgt

SEQ ID NO: 13537 - DNA, 40 bp, Artificial Sequence
  PCR primer for ORF amplification
caggagctgcacttccattggagggatcagtaaaggtttg

SEQ ID NO: 13538 - DNA, 40 bp, Artificial Sequence
  PCR primer for ORF amplification
caggagctgcacttccatatccattcatatcctccagctg

SEQ ID NO: 13539 - DNA, 40 bp, Artificial Sequence
  PCR primer for ORF amplification
caggagctgcacttcctatgccttctacaccgttccacaa

SEQ ID NO: 13540 - DNA, 40 bp, Artificial Sequence
  PCR primer for ORF amplification
caggagctgcacttccttttcttaagtagtcccttaaata

SEQ ID NO: 13541 - DNA, 40 bp, Artificial Sequence
  PCR primer for ORF amplification
caggagctgcacttcctgtggagtactggaattgtatgcc

SEQ ID NO: 13542 - DNA, 40 bp, Artificial Sequence
  PCR primer for ORF amplification
caggagctgcacttccttgtaataaactcttctccttctt

SEQ ID NO: 13543 - DNA, 40 bp, Artificial Sequence
  PCR primer for ORF amplification
caggagctgcacttccttcctccccatcggaattaatctc

SEQ ID NO: 13544 - DNA, 40 bp, Artificial Sequence
  PCR primer for ORF amplification
caggagctgcacttcctctcatgaaaacgttagacttgca

SEQ ID NO: 13545 - DNA, 40 bp, Artificial Sequence
  PCR primer for ORF amplification
caggagctgcacttccaccatgaccggaaaaccaattggt

SEQ ID NO: 13546 - DNA, 40 bp, Artificial Sequence
  PCR primer for ORF amplification
caggagctgcacttccgcatttttcatcaataggactgtg

SEQ ID NO: 13547 - DNA, 40 bp, Artificial Sequence
  PCR primer for ORF amplification
caggagctgcacttcctacacataaggatgtgcatatgtt

SEQ ID NO: 13548 - DNA, 40 bp, Artificial Sequence
  PCR primer for ORF amplification
caggagctgcacttcccaaccaaattgactggccagctgg

SEQ ID NO: 13549 - DNA, 40 bp, Artificial Sequence
  PCR primer for ORF amplification
caggagctgcacttcctgaatatgctgctgcgtattccaa

SEQ ID NO: 13550 - DNA, 40 bp, Artificial Sequence
  PCR primer for ORF amplification
caggagctgcacttcccttcttcacgcaaggacgtttgac

SEQ ID NO: 13551 - DNA, 40 bp, Artificial Sequence
  PCR primer for ORF amplification
caggagctgcacttccgattgcaaaatgagcctgacgagt

SEQ ID NO: 13552 - DNA, 40 bp, Artificial Sequence
  PCR primer for ORF amplification
caggagctgcacttccgtttttggtggcagaggagcttgt

SEQ ID NO: 13553 - DNA, 40 bp, Artificial Sequence
  PCR primer for ORF amplification
caggagctgcacttcccagatattcatatcccttgtagta

SEQ ID NO: 13554 - DNA, 40 bp, Artificial Sequence
  PCR primer for ORF amplification
caggagctgcacttccatctaataaaatattttttaaaat

SEQ ID NO: 13555 - DNA, 40 bp, Artificial Sequence
  PCR primer for ORF amplification
caggagctgcacttccaaattgcacgtcccaaagagcagc

SEQ ID NO: 13556 - DNA, 40 bp, Artificial Sequence
  PCR primer for ORF amplification
caggagctgcacttcctgtaaatttattatttttagtcag

SEQ ID NO: 13557 - DNA, 40 bp, Artificial Sequence
  PCR primer for ORF amplification
caggagctgcacttccaatgtacttgtatgggtttaagat

SEQ ID NO: 13558 - DNA, 40 bp, Artificial Sequence
  PCR primer for ORF amplification
caggagctgcacttccccatccatgctcgaacaacataga

SEQ ID NO: 13559 - DNA, 40 bp, Artificial Sequence
  PCR primer for ORF amplification
caggagctgcacttccaccaatcaactcaccaaacaaaaa

SEQ ID NO: 13560 - DNA, 40 bp, Artificial Sequence
  PCR primer for ORF amplification
caggagctgcacttccaatgctgtttggcaaattcccaat

SEQ ID NO: 13561 - DNA, 40 bp, Artificial Sequence
  PCR primer for ORF amplification
caggagctgcacttccctccaaaaccttcttctttttcgg

SEQ ID NO: 13562 - DNA, 40 bp, Artificial Sequence
  PCR primer for ORF amplification
caggagctgcacttcctctagttggatgccccagtttcaa

SEQ ID NO: 13563 - DNA, 40 bp, Artificial Sequence
  PCR primer for ORF amplification
caggagctgcacttccaaaatattcttcatgcccttttat

SEQ ID NO: 13564 - DNA, 40 bp, Artificial Sequence
  PCR primer for ORF amplification
caggagctgcacttcctttatgaggcccgttattgttttt

SEQ ID NO: 13565 - DNA, 40 bp, Artificial Sequence
  PCR primer for ORF amplification
caggagctgcacttccatgacctgaccatttgatggagtt

SEQ ID NO: 13566 - DNA, 40 bp, Artificial Sequence
  PCR primer for ORF amplification
caggagctgcacttccagtataattatatgtacgatcttc

SEQ ID NO: 13567 - DNA, 40 bp, Artificial Sequence
  PCR primer for ORF amplification
caggagctgcacttcctacgttagctggaagttggaaact

SEQ ID NO: 13568 - DNA, 40 bp, Artificial Sequence
  PCR primer for ORF amplification
caggagctgcacttcccagaccaaatcctttatacattaa

SEQ ID NO: 13569 - DNA, 40 bp, Artificial Sequence
  PCR primer for ORF amplification
caggagctgcacttccctgacttttcctgccgacctttag

SEQ ID NO: 13570 - DNA, 40 bp, Artificial Sequence
  PCR primer for ORF amplification
caggagctgcacttccttcccggacatgtacgccaggtga

SEQ ID NO: 13571 - DNA, 40 bp, Artificial Sequence
  PCR primer for ORF amplification
caggagctgcacttccatgttccaagatttgcaaattacc

SEQ ID NO: 13572 - DNA, 40 bp, Artificial Sequence
  PCR primer for ORF amplification
caggagctgcacttcctactatatggtcagtgttcttagt

SEQ ID NO: 13573 - DNA, 40 bp, Artificial Sequence
  PCR primer for ORF amplification
caggagctgcacttcctttatttacacgttcgtagtatag

SEQ ID NO: 13574 - DNA, 40 bp, Artificial Sequence
  PCR primer for ORF amplification
caggagctgcacttccacaatgaatagctttatcataggc

SEQ ID NO: 13575 - DNA, 40 bp, Artificial Sequence
  PCR primer for ORF amplification
caggagctgcacttccgtttctatcagggtcgaagtctaa

SEQ ID NO: 13576 - DNA, 40 bp, Artificial Sequence
  PCR primer for ORF amplification
caggagctgcacttcccaacttaattctgacagcttttac

SEQ ID NO: 13577 - DNA, 40 bp, Artificial Sequence
  PCR primer for ORF amplification
caggagctgcacttcctttggaaataccaaattcttcgta

SEQ ID NO: 13578 - DNA, 40 bp, Artificial Sequence
  PCR primer for ORF amplification
caggagctgcacttcctttccatcttaagccatcgttaac

SEQ ID NO: 13579 - DNA, 40 bp, Artificial Sequence
  PCR primer for ORF amplification
caggagctgcacttccttttaaatcattctttccaattat

SEQ ID NO: 13580 - DNA, 40 bp, Artificial Sequence
  PCR primer for ORF amplification
caggagctgcacttccttctatttcagggtcaagcttctc

SEQ ID NO: 13581 - DNA, 40 bp, Artificial Sequence
  PCR primer for ORF amplification
caggagctgcacttcctgctacaagcgcacacaaggcggc

SEQ ID NO: 13582 - DNA, 40 bp, Artificial Sequence
  PCR primer for ORF amplification
caggagctgcacttcctgccaccagagcacacaaagctgc

SEQ ID NO: 13583 - DNA, 40 bp, Artificial Sequence
  PCR primer for ORF amplification
caggagctgcacttccaacggtagagacttgcaaagtgtt

SEQ ID NO: 13584 - DNA, 40 bp, Artificial Sequence
  PCR primer for ORF amplification
caggagctgcacttccatccatcaagatggaatactgtga

SEQ ID NO: 13585 - DNA, 40 bp, Artificial Sequence
  PCR primer for ORF amplification
caggagctgcacttccgtacaattttgctatgttatccgc

SEQ ID NO: 13586 - DNA, 40 bp, Artificial Sequence
  PCR primer for ORF amplification
caggagctgcacttccatacttattaaactcatctaaccc

SEQ ID NO: 13587 - DNA, 40 bp, Artificial Sequence
  PCR primer for ORF amplification
caggagctgcacttccgtttaaaccctcttttttggccgc

SEQ ID NO: 13588 - DNA, 40 bp, Artificial Sequence
  PCR primer for ORF amplification
caggagctgcacttccaactttataggcaaaaatctcttt

SEQ ID NO: 13589 - DNA, 40 bp, Artificial Sequence
  PCR primer for ORF amplification
caggagctgcacttccaaacccttcaagagcctttgtagc

SEQ ID NO: 13590 - DNA, 40 bp, Artificial Sequence
  PCR primer for ORF amplification
caggagctgcacttcccctttctcccatgtccatattctc

SEQ ID NO: 13591 - DNA, 40 bp, Artificial Sequence
  PCR primer for ORF amplification
caggagctgcacttccatcacaaccaaaatactttgaatc

SEQ ID NO: 13592 - DNA, 40 bp, Artificial Sequence
  PCR primer for ORF amplification
caggagctgcacttccaaacttacaaagcttcgcaccaac

SEQ ID NO: 13593 - DNA, 40 bp, Artificial Sequence
  PCR primer for ORF amplification
caggagctgcacttcccacttggtctaaaatttccttaat

SEQ ID NO: 13594 - DNA, 40 bp, Artificial Sequence
  PCR primer for ORF amplification
caggagctgcacttcctgtaaatactacacaacaaagaac

SEQ ID NO: 13595 - DNA, 40 bp, Artificial Sequence
  PCR primer for ORF amplification
caggagctgcacttccgaacttctcttgttccatgttgat

SEQ ID NO: 13596 - DNA, 40 bp, Artificial Sequence
  PCR primer for ORF amplification
caggagctgcacttcctttcttgtgtttccgtttacgacc

SEQ ID NO: 13597 - DNA, 40 bp, Artificial Sequence
  PCR primer for ORF amplification
caggagctgcacttcccaggacaccaaagggtttgggttt

SEQ ID NO: 13598 - DNA, 40 bp, Artificial Sequence
  PCR primer for ORF amplification
caggagctgcacttccaaaaattatcgagaacaataccgt

SEQ ID NO: 13599 - DNA, 40 bp, Artificial Sequence
  PCR primer for ORF amplification
caggagctgcacttccgagaaacctgctgtcacaccagcc

SEQ ID NO: 13600 - DNA, 40 bp, Artificial Sequence
  PCR primer for ORF amplification
caggagctgcacttccataatctggtaaccatttctcgtt

SEQ ID NO: 13601 - DNA, 40 bp, Artificial Sequence
  PCR primer for ORF amplification
caggagctgcacttccctgttgtttctttcgtggctgttt

SEQ ID NO: 13602 - DNA, 40 bp, Artificial Sequence
  PCR primer for ORF amplification
caggagctgcacttcctttatatccgtaccttttccaatt

SEQ ID NO: 13603 - DNA, 40 bp, Artificial Sequence
  PCR primer for ORF amplification
caggagctgcacttcctatttcttcataagggtaggagag

SEQ ID NO: 13604 - DNA, 40 bp, Artificial Sequence
  PCR primer for ORF amplification
caggagctgcacttccgcgcaaagaactattattggaatc

SEQ ID NO: 13605 - DNA, 40 bp, Artificial Sequence
  PCR primer for ORF amplification
caggagctgcacttccgggtgtcaatgcaacaatattgaa

SEQ ID NO: 13606 - DNA, 40 bp, Artificial Sequence
  PCR primer for ORF amplification
caggagctgcacttccagtgaaaagggcactcgctagaat

SEQ ID NO: 13607 - DNA, 40 bp, Artificial Sequence
  PCR primer for ORF amplification
caggagctgcacttcccatttgctcactatataaaatgac

SEQ ID NO: 13608 - DNA, 40 bp, Artificial Sequence
  PCR primer for ORF amplification
caggagctgcacttccttcgtacaagtcttcgtccaatct

SEQ ID NO: 13609 - DNA, 40 bp, Artificial Sequence
  PCR primer for ORF amplification
caggagctgcacttccgaagtctgtcatttcaactgagtt

SEQ ID NO: 13610 - DNA, 40 bp, Artificial Sequence
  PCR primer for ORF amplification
caggagctgcacttccgatagtttggtagttggaggacaa

SEQ ID NO: 13611 - DNA, 40 bp, Artificial Sequence
  PCR primer for ORF amplification
caggagctgcacttccgtccatgtgtgggaagggcaacgg

SEQ ID NO: 13612 - DNA, 40 bp, Artificial Sequence
  PCR primer for ORF amplification
caggagctgcacttccatccttacttttcttctttttatc

SEQ ID NO: 13613 - DNA, 40 bp, Artificial Sequence
  PCR primer for ORF amplification
caggagctgcacttccaaaatcaatcaatgagccagtctt

SEQ ID NO: 13614 - DNA, 40 bp, Artificial Sequence
  PCR primer for ORF amplification
caggagctgcacttccttgctgtagggcaatttgctccaa

SEQ ID NO: 13615 - DNA, 40 bp, Artificial Sequence
  PCR primer for ORF amplification
caggagctgcacttccattatccttcgtatcttctggctt

SEQ ID NO: 13616 - DNA, 40 bp, Artificial Sequence
  PCR primer for ORF amplification
caggagctgcacttccttttgaaatagtactgaatggttt

SEQ ID NO: 13617 - DNA, 40 bp, Artificial Sequence
  PCR primer for ORF amplification
caggagctgcacttccttttaagctatgcactttctcccc

SEQ ID NO: 13618 - DNA, 40 bp, Artificial Sequence
  PCR primer for ORF amplification
caggagctgcacttcctaaagctatattttcaaattcttc

SEQ ID NO: 13619 - DNA, 40 bp, Artificial Sequence
  PCR primer for ORF amplification
caggagctgcacttcccttatgagttttacgtcttttggt

SEQ ID NO: 13620 - DNA, 40 bp, Artificial Sequence
  PCR primer for ORF amplification
caggagctgcacttccgttgtccaaagagagatttatgtg

SEQ ID NO: 13621 - DNA, 40 bp, Artificial Sequence
  PCR primer for ORF amplification
caggagctgcacttcctttatccaatgaaagatccacatg

SEQ ID NO: 13622 - DNA, 40 bp, Artificial Sequence
  PCR primer for ORF amplification
caggagctgcacttccgaattcttgaccaacagtagaaat

SEQ ID NO: 13623 - DNA, 40 bp, Artificial Sequence
  PCR primer for ORF amplification
caggagctgcacttccttgaatggcattagtgttatttga

SEQ ID NO: 13624 - DNA, 40 bp, Artificial Sequence
  PCR primer for ORF amplification
caggagctgcacttcctgaacattcaaagatggatccgcc

SEQ ID NO: 13625 - DNA, 40 bp, Artificial Sequence
  PCR primer for ORF amplification
caggagctgcacttccgtcaacagtgtcggcagtatgttt

SEQ ID NO: 13626 - DNA, 40 bp, Artificial Sequence
  PCR primer for ORF amplification
caggagctgcacttcctatcccatccttttccttttccca

SEQ ID NO: 13627 - DNA, 40 bp, Artificial Sequence
  PCR primer for ORF amplification
caggagctgcacttccatactggggttgtgactgaccagg

SEQ ID NO: 13628 - DNA, 40 bp, Artificial Sequence
  PCR primer for ORF amplification
caggagctgcacttcctagcaaggctagtaaagctacgag

SEQ ID NO: 13629 - DNA, 40 bp, Artificial Sequence
  PCR primer for ORF amplification
caggagctgcacttccgttttctgtgagagaaatgtcata

SEQ ID NO: 13630 - DNA, 40 bp, Artificial Sequence
  PCR primer for ORF amplification
caggagctgcacttccttcagatattaggagaacatcctt

SEQ ID NO: 13631 - DNA, 40 bp, Artificial Sequence
  PCR primer for ORF amplification
caggagctgcacttccattacgatacttgctgaagaaatc

SEQ ID NO: 13632 - DNA, 40 bp, Artificial Sequence
  PCR primer for ORF amplification
caggagctgcacttccagctgatcctacgatatcggccca

SEQ ID NO: 13633 - DNA, 40 bp, Artificial Sequence
  PCR primer for ORF amplification
caggagctgcacttcctgctaagtagctcagtaaatccat

SEQ ID NO: 13634 - DNA, 40 bp, Artificial Sequence
  PCR primer for ORF amplification
caggagctgcacttccttgtgggttctgctgctgctctcg

SEQ ID NO: 13635 - DNA, 40 bp, Artificial Sequence
  PCR primer for ORF amplification
caggagctgcacttccctcacttgagtcttcatcactgta

SEQ ID NO: 13636 - DNA, 40 bp, Artificial Sequence
  PCR primer for ORF amplification
caggagctgcacttcccgaaaagaaaacggaaaggatgag

SEQ ID NO: 13637 - DNA, 40 bp, Artificial Sequence
  PCR primer for ORF amplification
caggagctgcacttccactagcattttccaaggtggaaag

SEQ ID NO: 13638 - DNA, 40 bp, Artificial Sequence
  PCR primer for ORF amplification
caggagctgcacttcctttcagtaagtcagagattcgagt

SEQ ID NO: 13639 - DNA, 40 bp, Artificial Sequence
  PCR primer for ORF amplification
caggagctgcacttccatctttccagcacttcctcacgaa

SEQ ID NO: 13640 - DNA, 40 bp, Artificial Sequence
  PCR primer for ORF amplification
caggagctgcacttccgtatgtaggcttagtaacccaatc

SEQ ID NO: 13641 - DNA, 40 bp, Artificial Sequence
  PCR primer for ORF amplification
caggagctgcacttccgctagttaaaggaatgttcagtaa

SEQ ID NO: 13642 - DNA, 40 bp, Artificial Sequence
  PCR primer for ORF amplification
caggagctgcacttccatgttcttgccgtacaaattcttc

SEQ ID NO: 13643 - DNA, 40 bp, Artificial Sequence
  PCR primer for ORF amplification
caggagctgcacttccactctgctttgctgccactaaagc

SEQ ID NO: 13644 - DNA, 40 bp, Artificial Sequence
  PCR primer for ORF amplification
caggagctgcacttcccatagttatatcgtgatctgtggc

SEQ ID NO: 13645 - DNA, 40 bp, Artificial Sequence
  PCR primer for ORF amplification
caggagctgcacttcctaaattcagattcaaccaatccag

SEQ ID NO: 13646 - DNA, 40 bp, Artificial Sequence
  PCR primer for ORF amplification
caggagctgcacttccaaagaacttaccagtttcgtagat

SEQ ID NO: 13647 - DNA, 40 bp, Artificial Sequence
  PCR primer for ORF amplification
caggagctgcacttccataatctgcacaattatataatcc

SEQ ID NO: 13648 - DNA, 40 bp, Artificial Sequence
  PCR primer for ORF amplification
caggagctgcacttccaatatgagtattcgtatggtcgtg

SEQ ID NO: 13649 - DNA, 40 bp, Artificial Sequence
  PCR primer for ORF amplification
caggagctgcacttccaaatacaaaaaagccattgtcttc

SEQ ID NO: 13650 - DNA, 40 bp, Artificial Sequence
  PCR primer for ORF amplification
caggagctgcacttccttcacgagaaatcggcatatccat

SEQ ID NO: 13651 - DNA, 40 bp, Artificial Sequence
  PCR primer for ORF amplification
caggagctgcacttcctttcttctctttcttctctttctt

SEQ ID NO: 13652 - DNA, 40 bp, Artificial Sequence
  PCR primer for ORF amplification
caggagctgcacttccattttttttgtcacctttgatctt

SEQ ID NO: 13653 - DNA, 40 bp, Artificial Sequence
  PCR primer for ORF amplification
caggagctgcacttccttgctttcttgaatccaaatgctt

SEQ ID NO: 13654 - DNA, 40 bp, Artificial Sequence
  PCR primer for ORF amplification
caggagctgcacttccgttggcttcagcggctaacttttc

SEQ ID NO: 13655 - DNA, 40 bp, Artificial Sequence
  PCR primer for ORF amplification
caggagctgcacttccgacactgattgttttccagacgtt

SEQ ID NO: 13656 - DNA, 40 bp, Artificial Sequence
  PCR primer for ORF amplification
caggagctgcacttcccagtggtgccacttggtcctcctc

SEQ ID NO: 13657 - DNA, 40 bp, Artificial Sequence
  PCR primer for ORF amplification
caggagctgcacttccccttttgatgtgaacgtttactaa

SEQ ID NO: 13658 - DNA, 40 bp, Artificial Sequence
  PCR primer for ORF amplification
caggagctgcacttcctcggaaaggatttgaaatttcggc

SEQ ID NO: 13659 - DNA, 40 bp, Artificial Sequence
  PCR primer for ORF amplification
caggagctgcacttccgtcgtattcttggagacagtcacc

SEQ ID NO: 13660 - DNA, 40 bp, Artificial Sequence
  PCR primer for ORF amplification
caggagctgcacttccccagaagaatatcttgttcttcct

SEQ ID NO: 13661 - DNA, 40 bp, Artificial Sequence
  PCR primer for ORF amplification
caggagctgcacttccaatcaactttttggctgccacagc

SEQ ID NO: 13662 - DNA, 40 bp, Artificial Sequence
  PCR primer for ORF amplification
caggagctgcacttccgttgaaccctaatatgcttttcga

SEQ ID NO: 13663 - DNA, 40 bp, Artificial Sequence
  PCR primer for ORF amplification
caggagctgcacttccacttttatagttgtcaaaaaattc

SEQ ID NO: 13664 - DNA, 40 bp, Artificial Sequence
  PCR primer for ORF amplification
caggagctgcacttccttgtttctttttcaactttctttt

SEQ ID NO: 13665 - DNA, 40 bp, Artificial Sequence
  PCR primer for ORF amplification
caggagctgcacttccgaggcaagataattctgagtatgt

SEQ ID NO: 13666 - DNA, 40 bp, Artificial Sequence
  PCR primer for ORF amplification
caggagctgcacttcctaatcctttaaaaaagtctctttt

SEQ ID NO: 13667 - DNA, 40 bp, Artificial Sequence
  PCR primer for ORF amplification
caggagctgcacttcctacatcaagttccagatcagctag

SEQ ID NO: 13668 - DNA, 40 bp, Artificial Sequence
  PCR primer for ORF amplification
caggagctgcacttcccattaaaaagctattgacgctgtt

SEQ ID NO: 13669 - DNA, 40 bp, Artificial Sequence
  PCR primer for ORF amplification
caggagctgcacttcctaaaccaaaaccaccattagaata

SEQ ID NO: 13670 - DNA, 40 bp, Artificial Sequence
  PCR primer for ORF amplification
caggagctgcacttccagattttaagctcattaataaaaa

SEQ ID NO: 13671 - DNA, 40 bp, Artificial Sequence
  PCR primer for ORF amplification
caggagctgcacttccgtgaaggaaaggtttcaaaattga

SEQ ID NO: 13672 - DNA, 40 bp, Artificial Sequence
  PCR primer for ORF amplification
caggagctgcacttccactcgttaaaagttgaagcatacc

SEQ ID NO: 13673 - DNA, 40 bp, Artificial Sequence
  PCR primer for ORF amplification
caggagctgcacttccatccattttgttataaatagcttt

SEQ ID NO: 13674 - DNA, 40 bp, Artificial Sequence
  PCR primer for ORF amplification
caggagctgcacttcctaatttcattttagcaagttcttc

SEQ ID NO: 13675 - DNA, 40 bp, Artificial Sequence
  PCR primer for ORF amplification
caggagctgcacttcccaactcgccgaattcatcgtagac

SEQ ID NO: 13676 - DNA, 40 bp, Artificial Sequence
  PCR primer for ORF amplification
caggagctgcacttccatcatcccatgcatacggcgactt

SEQ ID NO: 13677 - DNA, 40 bp, Artificial Sequence
  PCR primer for ORF amplification
caggagctgcacttccattcatcctatgcagacaggcatt

SEQ ID NO: 13678 - DNA, 40 bp, Artificial Sequence
  PCR primer for ORF amplification
caggagctgcacttccacgctgtggtgggtacgatatgaa

SEQ ID NO: 13679 - DNA, 40 bp, Artificial Sequence
  PCR primer for ORF amplification
caggagctgcacttcctagttgtaactctaaatcacacac

SEQ ID NO: 13680 - DNA, 40 bp, Artificial Sequence
  PCR primer for ORF amplification
caggagctgcacttccattaaacccatggtcacccagctt

SEQ ID NO: 13681 - DNA, 40 bp, Artificial Sequence
  PCR primer for ORF amplification
caggagctgcacttccgtcctttctttttaggggttgctt

SEQ ID NO: 13682 - DNA, 40 bp, Artificial Sequence
  PCR primer for ORF amplification
caggagctgcacttccttctataaaatgctgcttttcgga

SEQ ID NO: 13683 - DNA, 40 bp, Artificial Sequence
  PCR primer for ORF amplification
caggagctgcacttccatgcgtccacaatcttaccatctt

SEQ ID NO: 13684 - DNA, 40 bp, Artificial Sequence
  PCR primer for ORF amplification
caggagctgcacttccaaatttggagttactcgaaagctc

SEQ ID NO: 13685 - DNA, 40 bp, Artificial Sequence
  PCR primer for ORF amplification
caggagctgcacttccatgggttgatctttccgattgttt

SEQ ID NO: 13686 - DNA, 40 bp, Artificial Sequence
  PCR primer for ORF amplification
caggagctgcacttccacagagatttcccaaacattctgg

SEQ ID NO: 13687 - DNA, 40 bp, Artificial Sequence
  PCR primer for ORF amplification
caggagctgcacttcctagtagttcgatggagtacactgt

SEQ ID NO: 13688 - DNA, 40 bp, Artificial Sequence
  PCR primer for ORF amplification
caggagctgcacttccggttgggtacattttgatagaatc

SEQ ID NO: 13689 - DNA, 40 bp, Artificial Sequence
  PCR primer for ORF amplification
caggagctgcacttccgttcatagccttaaccaatttatt

SEQ ID NO: 13690 - DNA, 40 bp, Artificial Sequence
  PCR primer for ORF amplification
caggagctgcacttccttcgccaaaaaatatcgcactaat

SEQ ID NO: 13691 - DNA, 40 bp, Artificial Sequence
  PCR primer for ORF amplification
caggagctgcacttcctccctcagtaaacaaatccatgta

SEQ ID NO: 13692 - DNA, 40 bp, Artificial Sequence
  PCR primer for ORF amplification
caggagctgcacttccttcaataaaggattcgaagcattc

SEQ ID NO: 13693 - DNA, 40 bp, Artificial Sequence
  PCR primer for ORF amplification
caggagctgcacttcccctgataataaagtcaattatgaa

SEQ ID NO: 13694 - DNA, 40 bp, Artificial Sequence
  PCR primer for ORF amplification
caggagctgcacttcctaattcatcatgtacggtatcttc

SEQ ID NO: 13695 - DNA, 40 bp, Artificial Sequence
  PCR primer for ORF amplification
caggagctgcacttccttcaattactctaaaattttctct

SEQ ID NO: 13696 - DNA, 40 bp, Artificial Sequence
  PCR primer for ORF amplification
caggagctgcacttccgattagagattcttcttggctggc

SEQ ID NO: 13697 - DNA, 40 bp, Artificial Sequence
  PCR primer for ORF amplification
caggagctgcacttcccgatgggctgttaaccttctgaat

SEQ ID NO: 13698 - DNA, 40 bp, Artificial Sequence
  PCR primer for ORF amplification
caggagctgcacttcctgggcgtaaagcttctcgttcagt

SEQ ID NO: 13699 - DNA, 40 bp, Artificial Sequence
  PCR primer for ORF amplification
caggagctgcacttccactttgatcgacctgtctgactga

SEQ ID NO: 13700 - DNA, 40 bp, Artificial Sequence
  PCR primer for ORF amplification
caggagctgcacttccctgctgagattcaacgggtgtgtt

SEQ ID NO: 13701 - DNA, 40 bp, Artificial Sequence
  PCR primer for ORF amplification
caggagctgcacttccagaaaaacttagagtatcagcgat

SEQ ID NO: 13702 - DNA, 40 bp, Artificial Sequence
  PCR primer for ORF amplification
caggagctgcacttccagctgattgaattttacatttcca

SEQ ID NO: 13703 - DNA, 40 bp, Artificial Sequence
  PCR primer for ORF amplification
caggagctgcacttccactcgccatttcagtatatgtcgg

SEQ ID NO: 13704 - DNA, 40 bp, Artificial Sequence
  PCR primer for ORF amplification
caggagctgcacttcccttgtcaaattcagactgacgagc

SEQ ID NO: 13705 - DNA, 40 bp, Artificial Sequence
  PCR primer for ORF amplification
caggagctgcacttccaaattgtgacccaaagttgtcatt

SEQ ID NO: 13706 - DNA, 40 bp, Artificial Sequence
  PCR primer for ORF amplification
caggagctgcacttccatcaaatttgatcttcttaccttc

SEQ ID NO: 13707 - DNA, 40 bp, Artificial Sequence
  PCR primer for ORF amplification
caggagctgcacttccaagagtaattaatttttcacaaat

SEQ ID NO: 13708 - DNA, 40 bp, Artificial Sequence
  PCR primer for ORF amplification
caggagctgcacttcctatgctttccatataatgttctat

SEQ ID NO: 13709 - DNA, 40 bp, Artificial Sequence
  PCR primer for ORF amplification
caggagctgcacttccctcgtccaatttggcacggaccgc

SEQ ID NO: 13710 - DNA, 40 bp, Artificial Sequence
  PCR primer for ORF amplification
caggagctgcacttccttgttcgtacaaacaagtacccaa

SEQ ID NO: 13711 - DNA, 40 bp, Artificial Sequence
  PCR primer for ORF amplification
caggagctgcacttccttccatcattgtatcttgatcttt

SEQ ID NO: 13712 - DNA, 40 bp, Artificial Sequence
  PCR primer for ORF amplification
caggagctgcacttccacgtaaaaatcccttcttctttgt

SEQ ID NO: 13713 - DNA, 40 bp, Artificial Sequence
  PCR primer for ORF amplification
caggagctgcacttccacgaattggcttgtcaatggcaat

SEQ ID NO: 13714 - DNA, 40 bp, Artificial Sequence
  PCR primer for ORF amplification
caggagctgcacttccaacccactgaaaaaacccacaaga

SEQ ID NO: 13715 - DNA, 40 bp, Artificial Sequence
  PCR primer for ORF amplification
caggagctgcacttcctgttaagcttctcttgggaattgt

SEQ ID NO: 13716 - DNA, 40 bp, Artificial Sequence
  PCR primer for ORF amplification
caggagctgcacttcccaactcgtatttggtgcagaagcc

SEQ ID NO: 13717 - DNA, 40 bp, Artificial Sequence
  PCR primer for ORF amplification
caggagctgcacttcctttcaaaaccttaccgtcaacaat

SEQ ID NO: 13718 - DNA, 40 bp, Artificial Sequence
  PCR primer for ORF amplification
caggagctgcacttccaagttttttacccaaaatggaggt

SEQ ID NO: 13719 - DNA, 40 bp, Artificial Sequence
  PCR primer for ORF amplification
caggagctgcacttccaaatctgacccacttgaagccaac

SEQ ID NO: 13720 - DNA, 40 bp, Artificial Sequence
  PCR primer for ORF amplification
caggagctgcacttcctttggtcggcctcttccagaaata

SEQ ID NO: 13721 - DNA, 40 bp, Artificial Sequence
  PCR primer for ORF amplification
caggagctgcacttcccaattcatcgtgaatggcatcttc

SEQ ID NO: 13722 - DNA, 40 bp, Artificial Sequence
  PCR primer for ORF amplification
caggagctgcacttccttcttcctgctttatggttccgga

SEQ ID NO: 13723 - DNA, 40 bp, Artificial Sequence
  PCR primer for ORF amplification
caggagctgcacttccattgaatatattttctaggtcatc

SEQ ID NO: 13724 - DNA, 40 bp, Artificial Sequence
  PCR primer for ORF amplification
caggagctgcacttccaggatggctatcaacatcctttga

SEQ ID NO: 13725 - DNA, 40 bp, Artificial Sequence
  PCR primer for ORF amplification
caggagctgcacttccgtttccgaactgtcttagatagtc

SEQ ID NO: 13726 - DNA, 40 bp, Artificial Sequence
  PCR primer for ORF amplification
caggagctgcacttccgtaaatgtacctgaaatttctgtt

SEQ ID NO: 13727 - DNA, 40 bp, Artificial Sequence
  PCR primer for ORF amplification
caggagctgcacttccataagcagatctatcaattaaatc

SEQ ID NO: 13728 - DNA, 40 bp, Artificial Sequence
  PCR primer for ORF amplification
caggagctgcacttccatcgaaagtaattttttttggttt

SEQ ID NO: 13729 - DNA, 40 bp, Artificial Sequence
  PCR primer for ORF amplification
caggagctgcacttccttttgttggagagggagacactgg

SEQ ID NO: 13730 - DNA, 40 bp, Artificial Sequence
  PCR primer for ORF amplification
caggagctgcacttcctacggccttcttgctatcgcgacc

SEQ ID NO: 13731 - DNA, 40 bp, Artificial Sequence
  PCR primer for ORF amplification
caggagctgcacttccaaggacgcggacgttttgaaactt

SEQ ID NO: 13732 - DNA, 40 bp, Artificial Sequence
  PCR primer for ORF amplification
caggagctgcacttccgttatgtaaacgcttttcgtaaga

SEQ ID NO: 13733 - DNA, 40 bp, Artificial Sequence; identical to SEQ ID NO: 13732
  PCR primer for ORF amplification

SEQ ID NO: 13734 - DNA, 40 bp, Artificial Sequence
  PCR primer for ORF amplification
caggagctgcacttcctaagaatcccaaatcgtcgagatc

SEQ ID NO: 13735 - DNA, 40 bp, Artificial Sequence
  PCR primer for ORF amplification
caggagctgcacttcctattttaatcttgtgcaaaaggac

SEQ ID NO: 13736 - DNA, 40 bp, Artificial Sequence
  PCR primer for ORF amplification
caggagctgcacttccagaaaggatggtggcgtcgaaata

SEQ ID NO: 13737 - DNA, 40 bp, Artificial Sequence
  PCR primer for ORF amplification
caggagctgcacttccatagtgcattaactctcccattct

SEQ ID NO: 13738 - DNA, 40 bp, Artificial Sequence
  PCR primer for ORF amplification
caggagctgcacttccagcaaacataaaaccattactgcc

SEQ ID NO: 13739 - DNA, 40 bp, Artificial Sequence
  PCR primer for ORF amplification
caggagctgcacttcctaagctattctcacctgctaccat

SEQ ID NO: 13740 - DNA, 40 bp, Artificial Sequence
  PCR primer for ORF amplification
caggagctgcacttccgagtagagcagaaatcagacctgc

SEQ ID NO: 13741 - DNA, 40 bp, Artificial Sequence
  PCR primer for ORF amplification
caggagctgcacttccctcatagtagtcccattcttcaaa

SEQ ID NO: 13742 - DNA, 40 bp, Artificial Sequence
  PCR primer for ORF amplification
caggagctgcacttccaggttgaaaatttaaacgatcact

SEQ ID NO: 13743 - DNA, 40 bp, Artificial Sequence
  PCR primer for ORF amplification
caggagctgcacttccagaaactctaacgtagtttgcagg

SEQ ID NO: 13744 - DNA, 40 bp, Artificial Sequence
  PCR primer for ORF amplification
caggagctgcacttccacagcaacaaaaacagcaacaaca

SEQ ID NO: 13745 - DNA, 40 bp, Artificial Sequence
  PCR primer for ORF amplification
caggagctgcacttccagggcctaaaaggagagctttgta

SEQ ID NO: 13746 - DNA, 40 bp, Artificial Sequence
  PCR primer for ORF amplification
caggagctgcacttccaaatatatttttaaagatagaatt

SEQ ID NO: 13747 - DNA, 40 bp, Artificial Sequence
  PCR primer for ORF amplification
caggagctgcacttccaaagtacttctccaaatagctacc

SEQ ID NO: 13748 - DNA, 40 bp, Artificial Sequence
  PCR primer for ORF amplification
caggagctgcacttcctttatgtagtcctgaacaatgctt

SEQ ID NO: 13749 - DNA, 40 bp, Artificial Sequence
  PCR primer for ORF amplification
caggagctgcacttccccatattattctttgcaaataggg

SEQ ID NO: 13750 - DNA, 40 bp, Artificial Sequence
  PCR primer for ORF amplification
caggagctgcacttccttcccattcaacagttgcaggagg

SEQ ID NO: 13751 - DNA, 40 bp, Artificial Sequence
  PCR primer for ORF amplification
caggagctgcacttccgttcatttccgtatcttgttcttg

SEQ ID NO: 13752 - DNA, 40 bp, Artificial Sequence
  PCR primer for ORF amplification
caggagctgcacttcctgaacaattcctattttcttttaa

SEQ ID NO: 13753 - DNA, 40 bp, Artificial Sequence
  PCR primer for ORF amplification
caggagctgcacttccttttcctatacaaaatttgctgaa

SEQ ID NO: 13754 - DNA, 40 bp, Artificial Sequence
  PCR primer for ORF amplification
caggagctgcacttccgtcaactggttcccagctgtcgac

SEQ ID NO: 13755 - DNA, 40 bp, Artificial Sequence
  PCR primer for ORF amplification
caggagctgcacttcctctttcatccactgcgaccgaaac

SEQ ID NO: 13756 - DNA, 40 bp, Artificial Sequence
  PCR primer for ORF amplification
caggagctgcacttccaccagcatgttcgaaaacagcaga

SEQ ID NO: 13757 - DNA, 40 bp, Artificial Sequence
  PCR primer for ORF amplification
caggagctgcacttcctaatgcggaaaaaatgaataaatt

SEQ ID NO: 13758 - DNA, 40 bp, Artificial Sequence
  PCR primer for ORF amplification
caggagctgcacttccttgtggtttcttgtgtttcatcca

SEQ ID NO: 13759 - DNA, 40 bp, Artificial Sequence
  PCR primer for ORF amplification
caggagctgcacttccgtcggacaactcactaggatctat

SEQ ID NO: 13760 - DNA, 40 bp, Artificial Sequence
  PCR primer for ORF amplification
caggagctgcacttccagaagggacaccttctagctcgga

SEQ ID NO: 13761 - DNA, 40 bp, Artificial Sequence
  PCR primer for ORF amplification
caggagctgcacttcctgcaagcggatcaaaaaaccattc

SEQ ID NO: 13762 - DNA, 40 bp, Artificial Sequence
  PCR primer for ORF amplification
caggagctgcacttccgttgggaattaggataatatccct

SEQ ID NO: 13763 - DNA, 40 bp, Artificial Sequence
  PCR primer for ORF amplification
caggagctgcacttccagcgatgggttccaatgtagtacc

SEQ ID NO: 13764 - DNA, 40 bp, Artificial Sequence
  PCR primer for ORF amplification
caggagctgcacttcccatatgttgtctattggcggttct

SEQ ID NO: 13765 - DNA, 40 bp, Artificial Sequence
  PCR primer for ORF amplification
caggagctgcacttccaattccaagtcttttcaattgttc

SEQ ID NO: 13766 - DNA, 40 bp, Artificial Sequence
  PCR primer for ORF amplification
caggagctgcacttccgcctatatgccctctttgctttct

SEQ ID NO: 13767 - DNA, 40 bp, Artificial Sequence
  PCR primer for ORF amplification
caggagctgcacttccggaaagttgggttgcttccatcat

SEQ ID NO: 13768 - DNA, 40 bp, Artificial Sequence
  PCR primer for ORF amplification
caggagctgcacttcccatggcgatactgcctctctgtct

SEQ ID NO: 13769 - DNA, 40 bp, Artificial Sequence
  PCR primer for ORF amplification
caggagctgcacttcccaaaaagataacggcagcgagcgc

SEQ ID NO: 13770 - DNA, 40 bp, Artificial Sequence
  PCR primer for ORF amplification
caggagctgcacttccggcaaaattaatattgtaatctaa

SEQ ID NO: 13771 - DNA, 40 bp, Artificial Sequence
  PCR primer for ORF amplification
caggagctgcacttcctaattcatatagacagctgcccaa

SEQ ID NO: 13772 - DNA, 40 bp, Artificial Sequence
  PCR primer for ORF amplification
caggagctgcacttccatccaaccttctttcactttcagg

SEQ ID NO: 13773 - DNA, 40 bp, Artificial Sequence
  PCR primer for ORF amplification
caggagctgcacttcctttatgcgatactagatgcttgaa

SEQ ID NO: 13774 - DNA, 40 bp, Artificial Sequence
  PCR primer for ORF amplification
caggagctgcacttccatatccattaatatcatggtcata

SEQ ID NO: 13775 - DNA, 40 bp, Artificial Sequence
  PCR primer for ORF amplification
caggagctgcacttccacgaccaaagtacttgagctcaaa

SEQ ID NO: 13776 - DNA, 40 bp, Artificial Sequence
  PCR primer for ORF amplification
caggagctgcacttcctttatcatcatcgtcattattatt

SEQ ID NO: 13777 - DNA, 40 bp, Artificial Sequence
  PCR primer for ORF amplification
caggagctgcacttccacggctgaatgcaatatcatcaat

SEQ ID NO: 13778 - DNA, 40 bp, Artificial Sequence
  PCR primer for ORF amplification
caggagctgcacttccatgattaccattattgaatagttt

SEQ ID NO: 13779 - DNA, 40 bp, Artificial Sequence
  PCR primer for ORF amplification
caggagctgcacttcctaggtcattccaaccaaataacca

SEQ ID NO: 13780 - DNA, 40 bp, Artificial Sequence
  PCR primer for ORF amplification
caggagctgcacttcccagttgtgtccaggagtagtacat

SEQ ID NO: 13781 - DNA, 40 bp, Artificial Sequence
  PCR primer for ORF amplification
caggagctgcacttcccaatagaatataacccagtgccaa

SEQ ID NO: 13782 - DNA, 40 bp, Artificial Sequence
  PCR primer for ORF amplification
caggagctgcacttccattgagtatgggcatgaagttacc

SEQ ID NO: 13783 - DNA, 40 bp, Artificial Sequence
  PCR primer for ORF amplification
caggagctgcacttcctactgaaaaccttgcttgagaagg

SEQ ID NO: 13784 - DNA, 40 bp, Artificial Sequence
  PCR primer for ORF amplification
caggagctgcacttcccaccaaaccttgcttcttaagttc

SEQ ID NO: 13785 - DNA, 40 bp, Artificial Sequence
  PCR primer for ORF amplification
caggagctgcacttccaagtacagcaagaatattctgttc

SEQ ID NO: 13786 - DNA, 40 bp, Artificial Sequence
  PCR primer for ORF amplification
caggagctgcacttccaaatgccctgcctgccataggaag

SEQ ID NO: 13787 - DNA, 40 bp, Artificial Sequence
  PCR primer for ORF amplification
caggagctgcacttcctcgaccgaaatatttgagttctaa

SEQ ID NO: 13788 - DNA, 40 bp, Artificial Sequence
  PCR primer for ORF amplification
caggagctgcacttccaatgtatttgtaagggtttaaaat

SEQ ID NO: 13789 - DNA, 40 bp, Artificial Sequence
  PCR primer for ORF amplification
caggagctgcacttccgatcttttgttctggatttctctt

SEQ ID NO: 13790 - DNA, 40 bp, Artificial Sequence
  PCR primer for ORF amplification
caggagctgcacttccacccatgacataaccaatattagc

SEQ ID NO: 13791 - DNA, 40 bp, Artificial Sequence
  PCR primer for ORF amplification
caggagctgcacttcccaaaggatatataaaagtttcgtt

SEQ ID NO: 13792 - DNA, 40 bp, Artificial Sequence
  PCR primer for ORF amplification
caggagctgcacttcctaaggagaaaccaccgtggatcca

SEQ ID NO: 13793 - DNA, 40 bp, Artificial Sequence
  PCR primer for ORF amplification
caggagctgcacttccttttacttcccttacttggaactt

SEQ ID NO: 13794 - DNA, 40 bp, Artificial Sequence
  PCR primer for ORF amplification
caggagctgcacttcctgtagtacttctatcattttttgc

SEQ ID NO: 13795 - DNA, 40 bp, Artificial Sequence
  PCR primer for ORF amplification
caggagctgcacttccggaagaacaatgagcgtaaatggt

SEQ ID NO: 13796 - DNA, 40 bp, Artificial Sequence
  PCR primer for ORF amplification
caggagctgcacttccaatatggcctatatggtcgctggt

SEQ ID NO: 13797 - DNA, 40 bp, Artificial Sequence
  PCR primer for ORF amplification
caggagctgcacttcccaacaatctctcttcgaatcttag

SEQ ID NO: 13798 - DNA, 40 bp, Artificial Sequence
  PCR primer for ORF amplification
caggagctgcacttccggagataacagtggccgtgtagag

SEQ ID NO: 13799 - DNA, 40 bp, Artificial Sequence
  PCR primer for ORF amplification
caggagctgcacttccgtgtactggtcttggaggatattt

SEQ ID NO: 13800 - DNA, 40 bp, Artificial Sequence
  PCR primer for ORF amplification
caggagctgcacttccacgaccgaagtattttaattctaa

SEQ ID NO: 13801 - DNA, 40 bp, Artificial Sequence
  PCR primer for ORF amplification
caggagctgcacttccatacatgtacttaaactcagggtt

SEQ ID NO: 13802 - DNA, 40 bp, Artificial Sequence
  PCR primer for ORF amplification
caggagctgcacttcccctattatatggatggtagccatt

SEQ ID NO: 13803 - DNA, 40 bp, Artificial Sequence
  PCR primer for ORF amplification
caggagctgcacttccttcttgttttcttacaccactaac

SEQ ID NO: 13804 - DNA, 40 bp, Artificial Sequence
  PCR primer for ORF amplification
caggagctgcacttcctctttgtaaatcccttaacatact

SEQ ID NO: 13805 - DNA, 40 bp, Artificial Sequence
  PCR primer for ORF amplification
caggagctgcacttccaccaaagatttggatatcatcgtt

SEQ ID NO: 13806 - DNA, 40 bp, Artificial Sequence
  PCR primer for ORF amplification
caggagctgcacttcctttgttttcctttttcatagcgtc

SEQ ID NO: 13807 - DNA, 40 bp, Artificial Sequence
  PCR primer for ORF amplification
caggagctgcacttccaaaaataagtttagtgtctaagta

SEQ ID NO: 13808 - DNA, 40 bp, Artificial Sequence
  PCR primer for ORF amplification
caggagctgcacttcctaattcatcttcaccatcaatagc

SEQ ID NO: 13809 - DNA, 40 bp, Artificial Sequence
  PCR primer for ORF amplification
caggagctgcacttcctatggctacaactgaaccttcttg

SEQ ID NO: 13810 - DNA, 40 bp, Artificial Sequence
  PCR primer for ORF amplification
caggagctgcacttccaagcgacgcaaattcgccgatggt

SEQ ID NO: 13811 - DNA, 40 bp, Artificial Sequence
  PCR primer for ORF amplification
caggagctgcacttccctctgattgtcttctcttctctct

SEQ ID NO: 13812 - DNA, 40 bp, Artificial Sequence
  PCR primer for ORF amplification
caggagctgcacttccaacgattacgtggaaacctgaacg

SEQ ID NO: 13813 - DNA, 40 bp, Artificial Sequence
  PCR primer for ORF amplification
caggagctgcacttccagagattttcttgataacgaaatg

SEQ ID NO: 13814 - DNA, 40 bp, Artificial Sequence
  PCR primer for ORF amplification
caggagctgcacttccctttttctctctttgcaagaactg

SEQ ID NO: 13815 - DNA, 40 bp, Artificial Sequence
  PCR primer for ORF amplification
caggagctgcacttcctaaaagaaaataagatatgaagga

SEQ ID NO: 13816 - DNA, 40 bp, Artificial Sequence
  PCR primer for ORF amplification
caggagctgcacttccaataatcaagaagtcggccctgta

SEQ ID NO: 13817 - DNA, 40 bp, Artificial Sequence
  PCR primer for ORF amplification
caggagctgcacttccaggagacatttccggaaaggactc

SEQ ID NO: 13818 - DNA, 40 bp, Artificial Sequence
  PCR primer for ORF amplification
caggagctgcacttccttcgaagacttctccagtaattgg

SEQ ID NO: 13819 - DNA, 40 bp, Artificial Sequence
  PCR primer for ORF amplification
caggagctgcacttccatggaatgggtttctgaaaagact

SEQ ID NO: 13820 - DNA, 40 bp, Artificial Sequence
  PCR primer for ORF amplification
caggagctgcacttccccttgcattaggaaacctcaaatt

SEQ ID NO: 13821 - DNA, 40 bp, Artificial Sequence
  PCR primer for ORF amplification
caggagctgcacttccgcaacaacctaatttttggaaaaa

SEQ ID NO: 13822 - DNA, 40 bp, Artificial Sequence
  PCR primer for ORF amplification
caggagctgcacttcctaattcaccctttacagcattacc

SEQ ID NO: 13823 - DNA, 40 bp, Artificial Sequence
  PCR primer for ORF amplification
caggagctgcacttccattttccatatcgcctatttcata

SEQ ID NO: 13824 - DNA, 40 bp, Artificial Sequence
  PCR primer for ORF amplification
caggagctgcacttcctagtaaggcaacgccaacagcagc

SEQ ID NO: 13825 - DNA, 40 bp, Artificial Sequence
  PCR primer for ORF amplification
caggagctgcacttccaaaggtatatagggacttgaaagc

SEQ ID NO: 13826 - DNA, 40 bp, Artificial Sequence
  PCR primer for ORF amplification
caggagctgcacttcccacattctggtgactcaattttct

SEQ ID NO: 13827 - DNA, 40 bp, Artificial Sequence
  PCR primer for ORF amplification
caggagctgcacttcctttttttgtattcaagcttgcaac

SEQ ID NO: 13828 - DNA, 40 bp, Artificial Sequence
  PCR primer for ORF amplification
caggagctgcacttcctttgcttagctgtaaggcgtcgtt

SEQ ID NO: 13829 - DNA, 40 bp, Artificial Sequence
  PCR primer for ORF amplification
caggagctgcacttcctatgatcatctcttcatcgctttt

SEQ ID NO: 13830 - DNA, 40 bp, Artificial Sequence
  PCR primer for ORF amplification
caggagctgcacttccctccggttcaaatattttattgat

SEQ ID NO: 13831 - DNA, 40 bp, Artificial Sequence
  PCR primer for ORF amplification
caggagctgcacttcccaacgtccttatttcacagtcaag

SEQ ID NO: 13832 - DNA, 40 bp, Artificial Sequence
  PCR primer for ORF amplification
caggagctgcacttcctttgaatttcttcaaagaagcgga

SEQ ID NO: 13833 - DNA, 40 bp, Artificial Sequence
  PCR primer for ORF amplification
caggagctgcacttcctgcctccaaacttctatcttcaga

SEQ ID NO: 13834 - DNA, 40 bp, Artificial Sequence
  PCR primer for ORF amplification
caggagctgcacttccaaattctatcccataagctttttt

SEQ ID NO: 13835 - DNA, 40 bp, Artificial Sequence
  PCR primer for ORF amplification
caggagctgcacttccgcccataccgaattgttttgccat

SEQ ID NO: 13836 - DNA, 40 bp, Artificial Sequence
  PCR primer for ORF amplification
caggagctgcacttccttcctcggaaactcttttttcttt

SEQ ID NO: 13837 - DNA, 40 bp, Artificial Sequence
  PCR primer for ORF amplification
caggagctgcacttccccattgaatatttaagatctcttt

SEQ ID NO: 13838 - DNA, 40 bp, Artificial Sequence
  PCR primer for ORF amplification
caggagctgcacttcccgttttatttttatatttttttac

SEQ ID NO: 13839 - DNA, 40 bp, Artificial Sequence
  PCR primer for ORF amplification
caggagctgcacttccgaggtgctgaaatacttcgtcgac

SEQ ID NO: 13840 - DNA, 40 bp, Artificial Sequence
  PCR primer for ORF amplification
caggagctgcacttcctggaaaatattcaatcacaccgaa

SEQ ID NO: 13841 - DNA, 40 bp, Artificial Sequence
  PCR primer for ORF amplification
caggagctgcacttccaagctcatcatgttcgatgaaaac

SEQ ID NO: 13842 - DNA, 40 bp, Artificial Sequence
  PCR primer for ORF amplification
caggagctgcacttccgttaaaattgaattgttggttgac

SEQ ID NO: 13843 - DNA, 40 bp, Artificial Sequence
  PCR primer for ORF amplification
caggagctgcacttccatttactcccagttcttgcttttt

SEQ ID NO: 13844 - DNA, 40 bp, Artificial Sequence
  PCR primer for ORF amplification
caggagctgcacttccagccacagtgcaatcgtattctgc

SEQ ID NO: 13845 - DNA, 40 bp, Artificial Sequence
  PCR primer for ORF amplification
caggagctgcacttccgtgaataaacctataatcaagacg

SEQ ID NO: 13846 - DNA, 40 bp, Artificial Sequence
  PCR primer for ORF amplification
caggagctgcacttccatagtcatcacaagggggaggatc

SEQ ID NO: 13847 - DNA, 40 bp, Artificial Sequence
  PCR primer for ORF amplification
caggagctgcacttccttgttgctttttggctgatattgt

SEQ ID NO: 13848 - DNA, 40 bp, Artificial Sequence
  PCR primer for ORF amplification
caggagctgcacttcccaacttactcttatttctgctgct

SEQ ID NO: 13849 - DNA, 40 bp, Artificial Sequence
  PCR primer for ORF amplification
caggagctgcacttcctatactcattctaatgcctgctaa

SEQ ID NO: 13850 - DNA, 40 bp, Artificial Sequence
  PCR primer for ORF amplification
caggagctgcacttcctgacaaaatccacctcttggcaaa

SEQ ID NO: 13851 - DNA, 40 bp, Artificial Sequence
  PCR primer for ORF amplification
caggagctgcacttcctaaagtgtatctgaaatttggatt

SEQ ID NO: 13852 - DNA, 40 bp, Artificial Sequence
  PCR primer for ORF amplification
caggagctgcacttccaggttcttcagtaaacatttcctc

SEQ ID NO: 13853 - DNA, 40 bp, Artificial Sequence
  PCR primer for ORF amplification
caggagctgcacttcccaagtccttcatggatttgctacc

SEQ ID NO: 13854 - DNA, 40 bp, Artificial Sequence
  PCR primer for ORF amplification
caggagctgcacttccgtcgttctcatgacgagcaaggca

SEQ ID NO: 13855 - DNA, 40 bp, Artificial Sequence
  PCR primer for ORF amplification
caggagctgcacttccattagctgccgcttccggttgtac

SEQ ID NO: 13856 - DNA, 40 bp, Artificial Sequence
  PCR primer for ORF amplification
caggagctgcacttccgaactcctcagcgtaagaatcggc

SEQ ID NO: 13857 - DNA, 40 bp, Artificial Sequence
  PCR primer for ORF amplification
caggagctgcacttcccacggaggaatcccttccaagaaa

SEQ ID NO: 13858 - DNA, 40 bp, Artificial Sequence
  PCR primer for ORF amplification
caggagctgcacttcctatactcatgcgtatgccctcaag

SEQ ID NO: 13859 - DNA, 40 bp, Artificial Sequence
  PCR primer for ORF amplification
caggagctgcacttcctattacttgggtattgcccatacc

SEQ ID NO: 13860 - DNA, 40 bp, Artificial Sequence
  PCR primer for ORF amplification
caggagctgcacttccaaaagtggcaacaaatgattcagt

SEQ ID NO: 13861 - DNA, 40 bp, Artificial Sequence
  PCR primer for ORF amplification
caggagctgcacttcccagttgagagctattgtggttcct

SEQ ID NO: 13862 - DNA, 40 bp, Artificial Sequence
  PCR primer for ORF amplification
caggagctgcacttcccaggtattttggtagtatggcttt

SEQ ID NO: 13863 - DNA, 40 bp, Artificial Sequence
  PCR primer for ORF amplification
caggagctgcacttcctaatcctttaattaaacgagtgac

SEQ ID NO: 13864 - DNA, 40 bp, Artificial Sequence
  PCR primer for ORF amplification
caggagctgcacttccacacagacatggctttttcaccca

SEQ ID NO: 13865 - DNA, 40 bp, Artificial Sequence
  PCR primer for ORF amplification
caggagctgcacttcccataaagtttaacgtgtctgatgg

SEQ ID NO: 13866 - DNA, 40 bp, Artificial Sequence
  PCR primer for ORF amplification
caggagctgcacttccttggacaagatattcatctgattt

SEQ ID NO: 13867 - DNA, 40 bp, Artificial Sequence
  PCR primer for ORF amplification
caggagctgcacttcctttactatcaacaataactaatgg

SEQ ID NO: 13868 - DNA, 40 bp, Artificial Sequence
  PCR primer for ORF amplification
caggagctgcacttccctgtggtgtttctttcaaagtgga

SEQ ID NO: 13869 - DNA, 40 bp, Artificial Sequence
  PCR primer for ORF amplification
caggagctgcacttccacagcatcctagcttactgaaaaa

SEQ ID NO: 13870 - DNA, 40 bp, Artificial Sequence
  PCR primer for ORF amplification
caggagctgcacttccctctcttattattcccacaccaaa

SEQ ID NO: 13871 - DNA, 40 bp, Artificial Sequence
  PCR primer for ORF amplification
caggagctgcacttccatttccgggcgggttgttattttt

SEQ ID NO: 13872 - DNA, 40 bp, Artificial Sequence
  PCR primer for ORF amplification
caggagctgcacttcccagggaatttgcagttgctcttct

SEQ ID NO: 13873 - DNA, 40 bp, Artificial Sequence
  PCR primer for ORF amplification
caggagctgcacttcctatataaactgttgaaagtattcc

SEQ ID NO: 13874 - DNA, 40 bp, Artificial Sequence
  PCR primer for ORF amplification
caggagctgcacttcccgtatcgtccaatggatgaattac

SEQ ID NO: 13875 - DNA, 40 bp, Artificial Sequence
  PCR primer for ORF amplification
caggagctgcacttccctgcttgataccactagaaacctc

SEQ ID NO: 13876 - DNA, 40 bp, Artificial Sequence
  PCR primer for ORF amplification
caggagctgcacttccctttacatctattctatcaaaaac

SEQ ID NO: 13877 - DNA, 40 bp, Artificial Sequence
  PCR primer for ORF amplification
caggagctgcacttccgcccctttcctcctcttctaataa

SEQ ID NO: 13878 - DNA, 40 bp, Artificial Sequence
  PCR primer for ORF amplification
caggagctgcacttccctcctctgtgtacgaagatcttgt

SEQ ID NO: 13879 - DNA, 40 bp, Artificial Sequence
  PCR primer for ORF amplification
caggagctgcacttccttctttatttagagcatccagcgc

SEQ ID NO: 13880 - DNA, 40 bp, Artificial Sequence
  PCR primer for ORF amplification
caggagctgcacttcctgctgccgccgcgaagggatcgtt

SEQ ID NO: 13881 - DNA, 40 bp, Artificial Sequence
  PCR primer for ORF amplification
caggagctgcacttccttctacaccaagttgttgcgccat

SEQ ID NO: 13882 - DNA, 40 bp, Artificial Sequence
  PCR primer for ORF amplification
caggagctgcacttccgtccacattattctctatttcgtc

SEQ ID NO: 13883 - DNA, 40 bp, Artificial Sequence
  PCR primer for ORF amplification
caggagctgcacttcccaacgaccaacctgtggtcagaga

SEQ ID NO: 13884 - DNA, 40 bp, Artificial Sequence
  PCR primer for ORF amplification
caggagctgcacttccgaggtgtacttctttgcccgtagt

SEQ ID NO: 13885 - DNA, 40 bp, Artificial Sequence
  PCR primer for ORF amplification
caggagctgcacttcctattttgctaaaaagccaagacgc

SEQ ID NO: 13886 - DNA, 40 bp, Artificial Sequence
  PCR primer for ORF amplification
caggagctgcacttcccactttggttttgtataacttctt

SEQ ID NO: 13887 - DNA, 40 bp, Artificial Sequence
  PCR primer for ORF amplification
caggagctgcacttcccatgactttctttgaaccttcaaa

SEQ ID NO: 13888 - DNA, 40 bp, Artificial Sequence
  PCR primer for ORF amplification
caggagctgcacttcccccaaaagtgtcaaacgtactgtc

SEQ ID NO: 13889 - DNA, 40 bp, Artificial Sequence
  PCR primer for ORF amplification
caggagctgcacttcccaaactctgtaaaacttcttgtct

SEQ ID NO: 13890 - DNA, 40 bp, Artificial Sequence
  PCR primer for ORF amplification
caggagctgcacttccctcgaattgaggaccagcggctaa

SEQ ID NO: 13891 - DNA, 40 bp, Artificial Sequence
  PCR primer for ORF amplification
caggagctgcacttcccattggcatacctctccctcttcc

SEQ ID NO: 13892 - DNA, 40 bp, Artificial Sequence
  PCR primer for ORF amplification
caggagctgcacttcctatgccatgcatcctgctttcgta

SEQ ID NO: 13893 - DNA, 40 bp, Artificial Sequence
  PCR primer for ORF amplification
caggagctgcacttcccctaaatccgtaaggattgttcag

SEQ ID NO: 13894 - DNA, 40 bp, Artificial Sequence
  PCR primer for ORF amplification
caggagctgcacttccttcatattctagagcggcggtcca

SEQ ID NO: 13895 - DNA, 40 bp, Artificial Sequence
  PCR primer for ORF amplification
caggagctgcacttccctcgtattctagcgcagcggtcca

SEQ ID NO: 13896 - DNA, 40 bp, Artificial Sequence
  PCR primer for ORF amplification
caggagctgcacttcctttagtggacatgcccaaaagtga

SEQ ID NO: 13897 - DNA, 40 bp, Artificial Sequence
  PCR primer for ORF amplification
caggagctgcacttccatctctacccgatgcaatagaggc

SEQ ID NO: 13898 - DNA, 40 bp, Artificial Sequence
  PCR primer for ORF amplification
caggagctgcacttccttctgcagctttgcaaattccctt

SEQ ID NO: 13899 - DNA, 40 bp, Artificial Sequence
  PCR primer for ORF amplification
caggagctgcacttcctttcttgatggagccacttatttt

SEQ ID NO: 13900 - DNA, 40 bp, Artificial Sequence
  PCR primer for ORF amplification
caggagctgcacttccatcagttttttcatcttgtttgat

SEQ ID NO: 13901 - DNA, 40 bp, Artificial Sequence
  PCR primer for ORF amplification
caggagctgcacttccaatatcgtgaacggaaattttcag

SEQ ID NO: 13902 - DNA, 40 bp, Artificial Sequence
  PCR primer for ORF amplification
caggagctgcacttccatagttcgtgatatttaagccgtt

SEQ ID NO: 13903 - DNA, 40 bp, Artificial Sequence
  PCR primer for ORF amplification
caggagctgcacttcctcctcctttattcccttcttgttt

SEQ ID NO: 13904 - DNA, 40 bp, Artificial Sequence
  PCR primer for ORF amplification
caggagctgcacttccgatatgctggataaatttatctgg

SEQ ID NO: 13905 - DNA, 40 bp, Artificial Sequence
  PCR primer for ORF amplification
caggagctgcacttcccaaatctaatagcagggacccgtc

SEQ ID NO: 13906 - DNA, 40 bp, Artificial Sequence
  PCR primer for ORF amplification
caggagctgcacttccttcctgttgatattcagattcagg

SEQ ID NO: 13907 - DNA, 40 bp, Artificial Sequence
  PCR primer for ORF amplification
caggagctgcacttccttctaccttaggcttcttcgaagg

SEQ ID NO: 13908 - DNA, 40 bp, Artificial Sequence
  PCR primer for ORF amplification
caggagctgcacttccctcttcatccattctaacctttaa

SEQ ID NO: 13909 - DNA, 40 bp, Artificial Sequence
  PCR primer for ORF amplification
caggagctgcacttccttcaacactgacttttttggtgga

SEQ ID NO: 13910 - DNA, 40 bp, Artificial Sequence
  PCR primer for ORF amplification
caggagctgcacttcctttttccaacatcataacctctgg

SEQ ID NO: 13911 - DNA, 40 bp, Artificial Sequence
  PCR primer for ORF amplification
caggagctgcacttccccatgctaccccaggcaagtagac

SEQ ID NO: 13912 - DNA, 40 bp, Artificial Sequence
  PCR primer for ORF amplification
caggagctgcacttccggatagtctcttgagacatctatc

SEQ ID NO: 13913 - DNA, 40 bp, Artificial Sequence
  PCR primer for ORF amplification
caggagctgcacttccttttacagtaaaggatgctacacc

SEQ ID NO: 13914 - DNA, 40 bp, Artificial Sequence
  PCR primer for ORF amplification
caggagctgcacttccatcataaatagtttcataagtgtg

SEQ ID NO: 13915 - DNA, 40 bp, Artificial Sequence
  PCR primer for ORF amplification
caggagctgcacttccgttcatggacttaaccaatttgtt

SEQ ID NO: 13916 - DNA, 40 bp, Artificial Sequence
  PCR primer for ORF amplification
caggagctgcacttcccagttgtggctttttctccgctcc

SEQ ID NO: 13917 - DNA, 40 bp, Artificial Sequence
  PCR primer for ORF amplification
caggagctgcacttccttttttatcttcagtctctagaga

SEQ ID NO: 13918 - DNA, 40 bp, Artificial Sequence
  PCR primer for ORF amplification
caggagctgcacttccggtcaaagcagatgttatgaagat

SEQ ID NO: 13919 - DNA, 40 bp, Artificial Sequence
  PCR primer for ORF amplification
caggagctgcacttccaaatacttgtacctttaaaaaatc

SEQ ID NO: 13920 - DNA, 40 bp, Artificial Sequence
  PCR primer for ORF amplification
caggagctgcacttccctgtgaattgaataaatttccatt

SEQ ID NO: 13921 - DNA, 40 bp, Artificial Sequence
  PCR primer for ORF amplification
caggagctgcacttcctatagttgaattgagagtgtctgt

SEQ ID NO: 13922 - DNA, 40 bp, Artificial Sequence
  PCR primer for ORF amplification
caggagctgcacttccgccgaatctgctcaatgcctcttc

SEQ ID NO: 13923 - DNA, 40 bp, Artificial Sequence
  PCR primer for ORF amplification
caggagctgcacttcctaatttacttaagtcaactggttt

SEQ ID NO: 13924 - DNA, 40 bp, Artificial Sequence
  PCR primer for ORF amplification
caggagctgcacttcccaatttgctcaaatcagtgggcgt

SEQ ID NO: 13925 - DNA, 40 bp, Artificial Sequence
  PCR primer for ORF amplification
caggagctgcacttcctggcttacatctaccgctgaaacg

SEQ ID NO: 13926 - DNA, 40 bp, Artificial Sequence
  PCR primer for ORF amplification
caggagctgcacttcccatccattccttgaattgattgat

SEQ ID NO: 13927 - DNA, 40 bp, Artificial Sequence
  PCR primer for ORF amplification
caggagctgcacttcctagaagaattccagcagctatcat

SEQ ID NO: 13928 - DNA, 40 bp, Artificial Sequence
  PCR primer for ORF amplification
caggagctgcacttccattagtagtctcagttggtttttc

SEQ ID NO: 13929 - DNA, 40 bp, Artificial Sequence
  PCR primer for ORF amplification
caggagctgcacttccttgcttgtcaagcatctgttggtg

SEQ ID NO: 13930 - DNA, 40 bp, Artificial Sequence
  PCR primer for ORF amplification
caggagctgcacttcctcttctgtttttctttcgagatgg

SEQ ID NO: 13931 - DNA, 40 bp, Artificial Sequence
  PCR primer for ORF amplification
caggagctgcacttccaggcccgtccagcggagggttctt

SEQ ID NO: 13932 - DNA, 40 bp, Artificial Sequence
  PCR primer for ORF amplification
caggagctgcacttccatggtaggtacgaaagacataatg

SEQ ID NO: 13933 - DNA, 40 bp, Artificial Sequence
  PCR primer for ORF amplification
caggagctgcacttccccatattcttttagaaaccatttt

SEQ ID NO: 13934 - DNA, 40 bp, Artificial Sequence
  PCR primer for ORF amplification
caggagctgcacttccggctcgattatgagatacggtact

SEQ ID NO: 13935 - DNA, 40 bp, Artificial Sequence
  PCR primer for ORF amplification
caggagctgcacttccttctataattacacttttatcatg

SEQ ID NO: 13936 - DNA, 40 bp, Artificial Sequence
  PCR primer for ORF amplification
caggagctgcacttccccattggtagtaccaatagggatt

SEQ ID NO: 13937 - DNA, 40 bp, Artificial Sequence
  PCR primer for ORF amplification
caggagctgcacttccactaaatagagcttctgcgtccac

SEQ ID NO: 13938 - DNA, 40 bp, Artificial Sequence
  PCR primer for ORF amplification
caggagctgcacttccagcagatgccttaacgtgctccac

SEQ ID NO: 13939 - DNA, 40 bp, Artificial Sequence
  PCR primer for ORF amplification
caggagctgcacttccgtttccgctgatggtcttatcatt

SEQ ID NO: 13940 - DNA, 40 bp, Artificial Sequence
  PCR primer for ORF amplification
caggagctgcacttcccaatgaccacggtttgtacacctg

SEQ ID NO: 13941 - DNA, 40 bp, Artificial Sequence
  PCR primer for ORF amplification
caggagctgcacttcctattgtgggcaaactggtcgtgcc

SEQ ID NO: 13942 - DNA, 40 bp, Artificial Sequence
  PCR primer for ORF amplification
caggagctgcacttcctttctttacgccattttctttgaa

SEQ ID NO: 13943 - DNA, 40 bp, Artificial Sequence
  PCR primer for ORF amplification
caggagctgcacttccaattcttttcgacatgtatggacc

SEQ ID NO: 13944 - DNA, 40 bp, Artificial Sequence
  PCR primer for ORF amplification
caggagctgcacttcctggtcttaatctctttggatctct

SEQ ID NO: 13945 - DNA, 40 bp, Artificial Sequence
  PCR primer for ORF amplification
caggagctgcacttccaatatctttattccatatgtcgac

SEQ ID NO: 13946 - DNA, 40 bp, Artificial Sequence
  PCR primer for ORF amplification
caggagctgcacttcctttattagattcttggcaacaggc

SEQ ID NO: 13947 - DNA, 40 bp, Artificial Sequence
  PCR primer for ORF amplification
caggagctgcacttccggtgaaaatgttgctgaggtatct

SEQ ID NO: 13948 - DNA, 40 bp, Artificial Sequence
  PCR primer for ORF amplification
caggagctgcacttccccgatagtggctataaaaagggtg

SEQ ID NO: 13949 - DNA, 40 bp, Artificial Sequence
  PCR primer for ORF amplification
caggagctgcacttccaaacttaaggtcaaatttgatatc

SEQ ID NO: 13950 - DNA, 40 bp, Artificial Sequence
  PCR primer for ORF amplification
caggagctgcacttcctatccatctatgctcgtcagttag

SEQ ID NO: 13951 - DNA, 40 bp, Artificial Sequence
  PCR primer for ORF amplification
caggagctgcacttccatgatcgtgcggatcttctttggg

SEQ ID NO: 13952 - DNA, 40 bp, Artificial Sequence
  PCR primer for ORF amplification
caggagctgcacttccaaccaaagcaaaaccgacaccagc

SEQ ID NO: 13953 - DNA, 40 bp, Artificial Sequence
  PCR primer for ORF amplification
caggagctgcacttccttgattatagatgtataagcaacc

SEQ ID NO: 13954 - DNA, 40 bp, Artificial Sequence
  PCR primer for ORF amplification
caggagctgcacttcctaaacgcggtttattctgccaggc

SEQ ID NO: 13955 - DNA, 40 bp, Artificial Sequence
  PCR primer for ORF amplification
caggagctgcacttcctggcttacagttgtgcattattgt

SEQ ID NO: 13956 - DNA, 40 bp, Artificial Sequence
  PCR primer for ORF amplification
caggagctgcacttccgatagatgaatctctacccaagaa

SEQ ID NO: 13957 - DNA, 40 bp, Artificial Sequence
  PCR primer for ORF amplification
caggagctgcacttccttgcaatatcgtattatactcaga

SEQ ID NO: 13958 - DNA, 40 bp, Artificial Sequence
  PCR primer for ORF amplification
caggagctgcacttcccgtacatctccaggaactgattgg

SEQ ID NO: 13959 - DNA, 40 bp, Artificial Sequence
  PCR primer for ORF amplification
caggagctgcacttccctggattaacacagatgcgccatt

SEQ ID NO: 13960 - DNA, 40 bp, Artificial Sequence
  PCR primer for ORF amplification
caggagctgcacttccaagcttataaagagacattcttct

SEQ ID NO: 13961 - DNA, 40 bp, Artificial Sequence
  PCR primer for ORF amplification
caggagctgcacttccgcattttaggtaaattccgtgcct

SEQ ID NO: 13962 - DNA, 40 bp, Artificial Sequence
  PCR primer for ORF amplification
caggagctgcacttcccagtttttcgaaatcttcttcatt

SEQ ID NO: 13963 - DNA, 40 bp, Artificial Sequence
  PCR primer for ORF amplification
caggagctgcacttccgatgcatgtagggaaaacaacgat

SEQ ID NO: 13964 - DNA, 40 bp, Artificial Sequence
  PCR primer for ORF amplification
caggagctgcacttccattaacaaaatacttgtcgtcctt

SEQ ID NO: 13965 - DNA, 40 bp, Artificial Sequence
  PCR primer for ORF amplification
caggagctgcacttcctgcaatgggcgaagtacttgcgac

SEQ ID NO: 13966 - DNA, 40 bp, Artificial Sequence
  PCR primer for ORF amplification
caggagctgcacttcctgataatctctggtgctttttgat

SEQ ID NO: 13967 - DNA, 40 bp, Artificial Sequence
  PCR primer for ORF amplification
caggagctgcacttccattggcacttgcaatggaccaagt

SEQ ID NO: 13968 - DNA, 40 bp, Artificial Sequence
  PCR primer for ORF amplification
caggagctgcacttccgagggttttgggatgttcatctga

SEQ ID NO: 13969 - DNA, 40 bp, Artificial Sequence
  PCR primer for ORF amplification
caggagctgcacttccttgatgcttatctattatacctgg

SEQ ID NO: 13970 - DNA, 40 bp, Artificial Sequence
  PCR primer for ORF amplification
caggagctgcacttccagaacttgaactacgtttgtaagt

SEQ ID NO: 13971 - DNA, 40 bp, Artificial Sequence
  PCR primer for ORF amplification
caggagctgcacttccaagagaagcgcaaagagcggcaat

SEQ ID NO: 13972 - DNA, 40 bp, Artificial Sequence
  PCR primer for ORF amplification
caggagctgcacttcccatcccatcttctaaatgaggatc

SEQ ID NO: 13973 - DNA, 40 bp, Artificial Sequence
  PCR primer for ORF amplification
caggagctgcacttccatactcatctttaccactaatgat

SEQ ID NO: 13974 - DNA, 40 bp, Artificial Sequence
  PCR primer for ORF amplification
caggagctgcacttccaaagtaattgctttccaaataaga

SEQ ID NO: 13975 - DNA, 40 bp, Artificial Sequence
  PCR primer for ORF amplification
caggagctgcacttcccgtcgaaactttttctgaattttt

SEQ ID NO: 13976 - DNA, 40 bp, Artificial Sequence
  PCR primer for ORF amplification
caggagctgcacttccttgtatatctagcttataggaaat

SEQ ID NO: 13977 - DNA, 40 bp, Artificial Sequence
  PCR primer for ORF amplification
caggagctgcacttcccttctttccccacggtacgtgttc

SEQ ID NO: 13978 - DNA, 40 bp, Artificial Sequence
  PCR primer for ORF amplification
caggagctgcacttccatcttcatctatgctaataatctc

SEQ ID NO: 13979 - DNA, 40 bp, Artificial Sequence
  PCR primer for ORF amplification
caggagctgcacttccttgtttagcgttagtagcggcagt

SEQ ID NO: 13980 - DNA, 40 bp, Artificial Sequence
  PCR primer for ORF amplification
caggagctgcacttccttgtttggcatttgtagcggcagt

SEQ ID NO: 13981 - DNA, 40 bp, Artificial Sequence
  PCR primer for ORF amplification
caggagctgcacttccttgcttagcgttggtagcagcagt

SEQ ID NO: 13982 - DNA, 40 bp, Artificial Sequence
  PCR primer for ORF amplification
caggagctgcacttccattcttttcattaccgctatcgtt

SEQ ID NO: 13983 - DNA, 40 bp, Artificial Sequence
  PCR primer for ORF amplification
caggagctgcacttccatcagaaccctttgagaacttcaa

SEQ ID NO: 13984 - DNA, 40 bp, Artificial Sequence
  PCR primer for ORF amplification
caggagctgcacttcctttcgagaaatgtttttttgaaag

SEQ ID NO: 13985 - DNA, 40 bp, Artificial Sequence
  PCR primer for ORF amplification
caggagctgcacttccatcagaattctttgagaacttcaa

SEQ ID NO: 13986 - DNA, 40 bp, Artificial Sequence
  PCR primer for ORF amplification
caggagctgcacttccataaaaagttgaaaaagggtctga

SEQ ID NO: 13987 - DNA, 40 bp, Artificial Sequence
  PCR primer for ORF amplification
caggagctgcacttcccattgcgtctttataaactttcaa

SEQ ID NO: 13988 - DNA, 40 bp, Artificial Sequence
  PCR primer for ORF amplification
caggagctgcacttcctatactgtcactctgtctccctat

SEQ ID NO: 13989 - DNA, 40 bp, Artificial Sequence
  PCR primer for ORF amplification
caggagctgcacttccctttctttttttcttcttcaactt

SEQ ID NO: 13990 - DNA, 40 bp, Artificial Sequence
  PCR primer for ORF amplification
caggagctgcacttcccaattccattgatgtgccaaagtc

SEQ ID NO: 13991 - DNA, 40 bp, Artificial Sequence
  PCR primer for ORF amplification
caggagctgcacttccgttggtcaactcatggtagtattc

SEQ ID NO: 13992 - DNA, 40 bp, Artificial Sequence
  PCR primer for ORF amplification
caggagctgcacttcctgtatgagaaccacgcagtcttga

SEQ ID NO: 13993 - DNA, 40 bp, Artificial Sequence
  PCR primer for ORF amplification
caggagctgcacttccgtgtgtcggaagagtgcttgtgaa

SEQ ID NO: 13994 - DNA, 40 bp, Artificial Sequence
  PCR primer for ORF amplification
caggagctgcacttcctatatgcgagggccaataagagtt

SEQ ID NO: 13995 - DNA, 40 bp, Artificial Sequence
  PCR primer for ORF amplification
caggagctgcacttccgctaacgatatcctgaaatttttc

SEQ ID NO: 13996 - DNA, 40 bp, Artificial Sequence
  PCR primer for ORF amplification
caggagctgcacttccagcattgataaacctttcaaatag

SEQ ID NO: 13997 - DNA, 40 bp, Artificial Sequence
  PCR primer for ORF amplification
caggagctgcacttcccattcgtccatttgataatatgac

SEQ ID NO: 13998 - DNA, 40 bp, Artificial Sequence
  PCR primer for ORF amplification
caggagctgcacttccacgtatttgattaaatgcgtcaaa

SEQ ID NO: 13999 - DNA, 40 bp, Artificial Sequence
  PCR primer for ORF amplification
caggagctgcacttccattaaaactctttgggaacttcaa

SEQ ID NO: 14000 - DNA, 40 bp, Artificial Sequence
  PCR primer for ORF amplification
caggagctgcacttcctttcttgccgaacattttcttgta

SEQ ID NO: 14001 - DNA, 40 bp, Artificial Sequence
  PCR primer for ORF amplification
caggagctgcacttccatggtttcttgggtttcttttcaa

SEQ ID NO: 14002 - DNA, 40 bp, Artificial Sequence
  PCR primer for ORF amplification
caggagctgcacttcccattgaaccgccaccttgatgttg

SEQ ID NO: 14003 - DNA, 40 bp, Artificial Sequence
  PCR primer for ORF amplification
caggagctgcacttccgctggaaaagaacctcttgtaaat

SEQ ID NO: 14004 - DNA, 40 bp, Artificial Sequence
  PCR primer for ORF amplification
caggagctgcacttccgctggaaaagaacctcttgtagat

SEQ ID NO: 14005 - DNA, 40 bp, Artificial Sequence
  PCR primer for ORF amplification
caggagctgcacttccgtttacgtcaacagctgcggttgt

SEQ ID NO: 14006 - DNA, 40 bp, Artificial Sequence
  PCR primer for ORF amplification
caggagctgcacttccgtcttcttggtcccagttacctgg

SEQ ID NO: 14007 - DNA, 40 bp, Artificial Sequence
  PCR primer for ORF amplification
caggagctgcacttccgaggcgtttagcgtacgatatatc

SEQ ID NO: 14008 - DNA, 40 bp, Artificial Sequence
  PCR primer for ORF amplification
caggagctgcacttcctatatctattaagttaggattttc

SEQ ID NO: 14009 - DNA, 40 bp, Artificial Sequence
  PCR primer for ORF amplification
caggagctgcacttccagcgtttattttgacttttctaaa

SEQ ID NO: 14010 - DNA, 40 bp, Artificial Sequence
  PCR primer for ORF amplification
caggagctgcacttccgatgaatgcaaaaagaagagaaat

SEQ ID NO: 14011 - DNA, 40 bp, Artificial Sequence
  PCR primer for ORF amplification
caggagctgcacttccaccctcaaaatttgctttatcgtt

SEQ ID NO: 14012 - DNA, 40 bp, Artificial Sequence
  PCR primer for ORF amplification
caggagctgcacttccaaacattcttttgtagaagggttt

SEQ ID NO: 14013 - DNA, 40 bp, Artificial Sequence
  PCR primer for ORF amplification
caggagctgcacttccagatgacaaccaagtcttcggaat

SEQ ID NO: 14014 - DNA, 40 bp, Artificial Sequence
  PCR primer for ORF amplification
caggagctgcacttccagtacgaaccgttggttcttcagt

SEQ ID NO: 14015 - DNA, 40 bp, Artificial Sequence
  PCR primer for ORF amplification
caggagctgcacttcctttggtgctgaacattctcttgta

SEQ ID NO: 14016 - DNA, 40 bp, Artificial Sequence; identical to SEQ ID NO: 14015
  PCR primer for ORF amplification

SEQ ID NO: 14017 - DNA, 40 bp, Artificial Sequence
  PCR primer for ORF amplification
caggagctgcacttcctaatccgtaagtctcacagacaaa

SEQ ID NO: 14018 - DNA, 40 bp, Artificial Sequence
  PCR primer for ORF amplification
caggagctgcacttcctttcctgctaaacaaactcttgta

SEQ ID NO: 14019 - DNA, 40 bp, Artificial Sequence
  PCR primer for ORF amplification
caggagctgcacttcctgaagtgttgggacgggcttttgg

SEQ ID NO: 14020 - DNA, 40 bp, Artificial Sequence
  PCR primer for ORF amplification
caggagctgcacttccattgatttgttccaacaatgaatc

SEQ ID NO: 14021 - DNA, 40 bp, Artificial Sequence
  PCR primer for ORF amplification
caggagctgcacttccaaccacgacaaacttctgtcttat

SEQ ID NO: 14022 - DNA, 40 bp, Artificial Sequence
  PCR primer for ORF amplification
caggagctgcacttcctgtgcggactgttggttcgtctgt

SEQ ID NO: 14023 - DNA, 40 bp, Artificial Sequence
  PCR primer for ORF amplification
caggagctgcacttcctattatctcaagatcgctggcact

SEQ ID NO: 14024 - DNA, 40 bp, Artificial Sequence
  PCR primer for ORF amplification
caggagctgcacttccaacttcggttttcacgtcttcctc

SEQ ID NO: 14025 - DNA, 40 bp, Artificial Sequence
  PCR primer for ORF amplification
caggagctgcacttccgataggagttctccagacgttttc

SEQ ID NO: 14026 - DNA, 40 bp, Artificial Sequence
  PCR primer for ORF amplification
caggagctgcacttcctggttcctgtttggacataattgt

SEQ ID NO: 14027 - DNA, 40 bp, Artificial Sequence
  PCR primer for ORF amplification
caggagctgcacttcccttgttttctagataagcttcgta

SEQ ID NO: 14028 - DNA, 40 bp, Artificial Sequence
  PCR primer for ORF amplification
caggagctgcacttccgtaaaaggttgaaaaggggtctga

SEQ ID NO: 14029 - DNA, 40 bp, Artificial Sequence
  PCR primer for ORF amplification
caggagctgcacttccggctttgtgccgttcaggcttttt

SEQ ID NO: 14030 - DNA, 40 bp, Artificial Sequence
  PCR primer for ORF amplification
caggagctgcacttccaaattctttggcagtatattttct

SEQ ID NO: 14031 - DNA, 40 bp, Artificial Sequence
  PCR primer for ORF amplification
caggagctgcacttccttcgtattccatggcggcggtcca

SEQ ID NO: 14032 - DNA, 40 bp, Artificial Sequence
  PCR primer for ORF amplification
caggagctgcacttcctaatctaggttttggctttgttgt

SEQ ID NO: 14033 - DNA, 40 bp, Artificial Sequence
  PCR primer for ORF amplification
caggagctgcacttccagcactgacgtgcttttcgtgtat

SEQ ID NO: 14034 - DNA, 40 bp, Artificial Sequence
  PCR primer for ORF amplification
caggagctgcacttccttcgatatgtttttcatgaatttg

SEQ ID NO: 14035 - DNA, 40 bp, Artificial Sequence
  PCR primer for ORF amplification
caggagctgcacttcccatcatacctggcattcctggcat

SEQ ID NO: 14036 - DNA, 40 bp, Artificial Sequence
  PCR primer for ORF amplification
caggagctgcacttccgacaacagtagtatcaatagtaga

SEQ ID NO: 14037 - DNA, 40 bp, Artificial Sequence
  PCR primer for ORF amplification
caggagctgcacttcctgaaaggacatcccaaactcgttg

SEQ ID NO: 14038 - DNA, 40 bp, Artificial Sequence
  PCR primer for ORF amplification
caggagctgcacttccagccttctcagcaaccatttccag

SEQ ID NO: 14039 - DNA, 40 bp, Artificial Sequence
  PCR primer for ORF amplification
caggagctgcacttccaaagcctgtttggtcaatgacagc

SEQ ID NO: 14040 - DNA, 40 bp, Artificial Sequence
  PCR primer for ORF amplification
caggagctgcacttcctaagtagtaatgtgtatacttagc

SEQ ID NO: 14041 - DNA, 40 bp, Artificial Sequence
  PCR primer for ORF amplification
caggagctgcacttccatctttcttaatgacaaaagtctt

SEQ ID NO: 14042 - DNA, 40 bp, Artificial Sequence
  PCR primer for ORF amplification
caggagctgcacttccttctagcatggccttgtaccacgg

SEQ ID NO: 14043 - DNA, 40 bp, Artificial Sequence
  PCR primer for ORF amplification
caggagctgcacttcctacatctttagaattggaaaccgc

SEQ ID NO: 14044 - DNA, 40 bp, Artificial Sequence
  PCR primer for ORF amplification
caggagctgcacttcctgtcatttggtattccacaccaaa

SEQ ID NO: 14045 - DNA, 40 bp, Artificial Sequence
  PCR primer for ORF amplification
caggagctgcacttccatcttttgtcgaattgattaccat

SEQ ID NO: 14046 - DNA, 40 bp, Artificial Sequence
  PCR primer for ORF amplification
caggagctgcacttcccagcgatttttcttgttcactttt

SEQ ID NO: 14047 - DNA, 40 bp, Artificial Sequence
  PCR primer for ORF amplification
caggagctgcacttcctgaaatatttttttcattttccca

SEQ ID NO: 14048 - DNA, 40 bp, Artificial Sequence
  PCR primer for ORF amplification
caggagctgcacttcctgagtgtttggagcctctgctttt

SEQ ID NO: 14049 - DNA, 40 bp, Artificial Sequence
  PCR primer for ORF amplification
caggagctgcacttccaaattgcgtttcggtaaagctctc

SEQ ID NO: 14050 - DNA, 40 bp, Artificial Sequence
  PCR primer for ORF amplification
caggagctgcacttcctgacctcatattcgtttgttcctc

SEQ ID NO: 14051 - DNA, 40 bp, Artificial Sequence
  PCR primer for ORF amplification
caggagctgcacttccgctttgttgttgttgctgctgctg

SEQ ID NO: 14052 - DNA, 40 bp, Artificial Sequence
  PCR primer for ORF amplification
caggagctgcacttccttcataattcgatggatatttgaa

SEQ ID NO: 14053 - DNA, 40 bp, Artificial Sequence
  PCR primer for ORF amplification
caggagctgcacttccatctttgtattccgatgcgtcgac

SEQ ID NO: 14054 - DNA, 40 bp, Artificial Sequence
  PCR primer for ORF amplification
caggagctgcacttccactgatatcaccatgagacatgcc

SEQ ID NO: 14055 - DNA, 40 bp, Artificial Sequence
  PCR primer for ORF amplification
caggagctgcacttccctgcctgtttacatcatccacaca

SEQ ID NO: 14056 - DNA, 40 bp, Artificial Sequence
  PCR primer for ORF amplification
caggagctgcacttcccacgcgtgttggaagttttcttct

SEQ ID NO: 14057 - DNA, 40 bp, Artificial Sequence
  PCR primer for ORF amplification
caggagctgcacttcctaaatccagttttttactgaaaga

SEQ ID NO: 14058 - DNA, 40 bp, Artificial Sequence
  PCR primer for ORF amplification
caggagctgcacttccagcgtattcgttaacattaacgat

SEQ ID NO: 14059 - DNA, 40 bp, Artificial Sequence
  PCR primer for ORF amplification
caggagctgcacttcctgccatgtcatcatgctcatctcc

SEQ ID NO: 14060 - DNA, 40 bp, Artificial Sequence
  PCR primer for ORF amplification
caggagctgcacttccatatttcaagaatttttgataaac

SEQ ID NO: 14061 - DNA, 40 bp, Artificial Sequence
  PCR primer for ORF amplification
caggagctgcacttccaacttttaaatcgacctttaaggt

SEQ ID NO: 14062 - DNA, 40 bp, Artificial Sequence
  PCR primer for ORF amplification
caggagctgcacttccgtcttcatgcttatcacagaactt

SEQ ID NO: 14063 - DNA, 40 bp, Artificial Sequence
  PCR primer for ORF amplification
caggagctgcacttcccttttttccgaacatcttcttgta

SEQ ID NO: 14064 - DNA, 40 bp, Artificial Sequence
  PCR primer for ORF amplification
caggagctgcacttcccatatcctttagcaatacgccaat

SEQ ID NO: 14065 - DNA, 40 bp, Artificial Sequence
  PCR primer for ORF amplification
caggagctgcacttccctgccatagtaattcgtcaaaatt

SEQ ID NO: 14066 - DNA, 40 bp, Artificial Sequence
  PCR primer for ORF amplification
caggagctgcacttccttttgcagatctaatagaatccat

SEQ ID NO: 14067 - DNA, 40 bp, Artificial Sequence
  PCR primer for ORF amplification
caggagctgcacttccagcttgctcagtttgttgttcttg

SEQ ID NO: 14068 - DNA, 40 bp, Artificial Sequence
  PCR primer for ORF amplification
caggagctgcacttcccaatgtcatggtaatggttgtggt

SEQ ID NO: 14069 - DNA, 40 bp, Artificial Sequence
  PCR primer for ORF amplification
caggagctgcacttcctctatgccgttgccttcttgcagg

SEQ ID NO: 14070 - DNA, 40 bp, Artificial Sequence
  PCR primer for ORF amplification
caggagctgcacttccttcattttcatttccctcgcttag

SEQ ID NO: 14071 - DNA, 40 bp, Artificial Sequence
  PCR primer for ORF amplification
caggagctgcacttccaacagattctggagaattaccgtc

SEQ ID NO: 14072 - DNA, 40 bp, Artificial Sequence
  PCR primer for ORF amplification
caggagctgcacttccatgtaaaaattgtaaaatctgttg

SEQ ID NO: 14073 - DNA, 40 bp, Artificial Sequence
  PCR primer for ORF amplification
caggagctgcacttccacgctcaaataatccgtcatcttc

SEQ ID NO: 14074 - DNA, 40 bp, Artificial Sequence
  PCR primer for ORF amplification
caggagctgcacttccaaagttgaatttgttttcgccggc

SEQ ID NO: 14075 - DNA, 40 bp, Artificial Sequence
  PCR primer for ORF amplification
caggagctgcacttccacgaccaaatttacgtagctctaa

SEQ ID NO: 14076 - DNA, 40 bp, Artificial Sequence
  PCR primer for ORF amplification
caggagctgcacttcctgctactggtgttgcattcttaat

SEQ ID NO: 14077 - DNA, 40 bp, Artificial Sequence
  PCR primer for ORF amplification
caggagctgcacttccagtattttgtgaagaaggttgatt

SEQ ID NO: 14078 - DNA, 40 bp, Artificial Sequence
  PCR primer for ORF amplification
caggagctgcacttccttttctcgatctgttcttcttttt

SEQ ID NO: 14079 - DNA, 40 bp, Artificial Sequence
  PCR primer for ORF amplification
caggagctgcacttcccgcgatagcaccgagactcatcaa

SEQ ID NO: 14080 - DNA, 40 bp, Artificial Sequence
  PCR primer for ORF amplification
caggagctgcacttccgccgctttcctgaaggatcatgac

SEQ ID NO: 14081 - DNA, 40 bp, Artificial Sequence
  PCR primer for ORF amplification
caggagctgcacttccgcgagttttcttgaggttgctact

SEQ ID NO: 14082 - DNA, 40 bp, Artificial Sequence
  PCR primer for ORF amplification
caggagctgcacttcctacaaccttgttccataattctac

SEQ ID NO: 14083 - DNA, 40 bp, Artificial Sequence
  PCR primer for ORF amplification
caggagctgcacttccccaaaggctacctataatcatacc

SEQ ID NO: 14084 - DNA, 40 bp, Artificial Sequence
  PCR primer for ORF amplification
caggagctgcacttcctaaccccgacgtgttttccatgta

SEQ ID NO: 14085 - DNA, 40 bp, Artificial Sequence
  PCR primer for ORF amplification
caggagctgcacttcccttcaacaagtaaagtcttccttc

SEQ ID NO: 14086 - DNA, 40 bp, Artificial Sequence
  PCR primer for ORF amplification
caggagctgcacttcccttcaccatcttctccaggatatg

SEQ ID NO: 14087 - DNA, 40 bp, Artificial Sequence
  PCR primer for ORF amplification
caggagctgcacttccgttatacccaaccataagccgcct

SEQ ID NO: 14088 - DNA, 40 bp, Artificial Sequence; identical to SEQ ID NO: 13289
  PCR primer for ORF amplification

SEQ ID NO: 14089 - DNA, 40 bp, Artificial Sequence
  PCR primer for ORF amplification
caggagctgcacttcctctggtatacttcaccggcgtacc

SEQ ID NO: 14090 - DNA, 40 bp, Artificial Sequence
  PCR primer for ORF amplification
caggagctgcacttcccaaataactagtatcgaggaactt

SEQ ID NO: 14091 - DNA, 40 bp, Artificial Sequence
  PCR primer for ORF amplification
caggagctgcacttcctgcagtttttttttcccattcgat

SEQ ID NO: 14092 - DNA, 40 bp, Artificial Sequence
  PCR primer for ORF amplification
caggagctgcacttcccttccttgaaaaaatatgtctaaa

SEQ ID NO: 14093 - DNA, 40 bp, Artificial Sequence
  PCR primer for ORF amplification
caggagctgcacttccacagaaaaaccgatagatcctata

SEQ ID NO: 14094 - DNA, 40 bp, Artificial Sequence
  PCR primer for ORF amplification
caggagctgcacttcctactttaccgtcacatctttcgga

SEQ ID NO: 14095 - DNA, 40 bp, Artificial Sequence
  PCR primer for ORF amplification
caggagctgcacttcccttacgtactaaaatagtctcttc

SEQ ID NO: 14096 - DNA, 40 bp, Artificial Sequence
  PCR primer for ORF amplification
caggagctgcacttccaacccgccagtataagcaactttt

SEQ ID NO: 14097 - DNA, 40 bp, Artificial Sequence
  PCR primer for ORF amplification
caggagctgcacttccatagtccaattccacagccggagt

SEQ ID NO: 14098 - DNA, 40 bp, Artificial Sequence
  PCR primer for ORF amplification
caggagctgcacttcctttgacgaggtagattctaccttc

SEQ ID NO: 14099 - DNA, 40 bp, Artificial Sequence
  PCR primer for ORF amplification
caggagctgcacttccttgttcttcattttcctcatcttc

SEQ ID NO: 14100 - DNA, 40 bp, Artificial Sequence
  PCR primer for ORF amplification
caggagctgcacttcctatatcctctataatctcttgagt

SEQ ID NO: 14101 - DNA, 40 bp, Artificial Sequence
  PCR primer for ORF amplification
caggagctgcacttccaagggtataaggattatatccatc

SEQ ID NO: 14102 - DNA, 40 bp, Artificial Sequence
  PCR primer for ORF amplification
caggagctgcacttcccaaggcgctttgaacccccttcaa

SEQ ID NO: 14103 - DNA, 40 bp, Artificial Sequence
  PCR primer for ORF amplification
caggagctgcacttcctattcgccctccattactcgtctt

SEQ ID NO: 14104 - DNA, 40 bp, Artificial Sequence
  PCR primer for ORF amplification
caggagctgcacttccaatctgtaagtcgtatgccttctt

SEQ ID NO: 14105 - DNA, 40 bp, Artificial Sequence
  PCR primer for ORF amplification
caggagctgcacttcccttcatacttgattcaagaataat

SEQ ID NO: 14106 - DNA, 40 bp, Artificial Sequence
  PCR primer for ORF amplification
caggagctgcacttccttggcttatgtgctcatctggtac

SEQ ID NO: 14107 - DNA, 40 bp, Artificial Sequence
  PCR primer for ORF amplification
caggagctgcacttccgtcatcctgaaagaaagccgcata

SEQ ID NO: 14108 - DNA, 40 bp, Artificial Sequence
  PCR primer for ORF amplification
caggagctgcacttcctttccctgcttttttatttttgtt

SEQ ID NO: 14109 - DNA, 40 bp, Artificial Sequence
  PCR primer for ORF amplification
caggagctgcacttccagcatctaaaacacaaccgttgga

SEQ ID NO: 14110 - DNA, 40 bp, Artificial Sequence
  PCR primer for ORF amplification
caggagctgcacttcctacattaggtaacgtaaaaacagc

SEQ ID NO: 14111 - DNA, 40 bp, Artificial Sequence
  PCR primer for ORF amplification
caggagctgcacttccacatgttcctctatagtttctcgt

SEQ ID NO: 14112 - DNA, 40 bp, Artificial Sequence
  PCR primer for ORF amplification
caggagctgcacttcctatctgcatggtttcatcaccatc

SEQ ID NO: 14113 - DNA, 40 bp, Artificial Sequence
  PCR primer for ORF amplification
caggagctgcacttccgtttttctcccccatagcttcttt

SEQ ID NO: 14114 - DNA, 40 bp, Artificial Sequence
  PCR primer for ORF amplification
caggagctgcacttccgcagatgcgcgcacctgcgttgtt

SEQ ID NO: 14115 - DNA, 40 bp, Artificial Sequence
  PCR primer for ORF amplification
caggagctgcacttcccacaccgtctctcaaattgacaga

SEQ ID NO: 14116 - DNA, 40 bp, Artificial Sequence
  PCR primer for ORF amplification
caggagctgcacttccattatgattatcgttctggtctct

SEQ ID NO: 14117 - DNA, 40 bp, Artificial Sequence
  PCR primer for ORF amplification
caggagctgcacttccagcggcgtaagcatacttggattt

SEQ ID NO: 14118 - DNA, 40 bp, Artificial Sequence
  PCR primer for ORF amplification
caggagctgcacttccatgaatagagttcctgggattgtg

SEQ ID NO: 14119 - DNA, 40 bp, Artificial Sequence
  PCR primer for ORF amplification
caggagctgcacttccgtcatcgtcgcagtaagcgggtac

SEQ ID NO: 14120 - DNA, 40 bp, Artificial Sequence
  PCR primer for ORF amplification
caggagctgcacttccattgtcatcaaattcaaacaaact

SEQ ID NO: 14121 - DNA, 40 bp, Artificial Sequence
  PCR primer for ORF amplification
caggagctgcacttccgtttgaatacttctccctaattct

SEQ ID NO: 14122 - DNA, 40 bp, Artificial Sequence
  PCR primer for ORF amplification
caggagctgcacttccaccctgatatgactgtctcaagtc

SEQ ID NO: 14123 - DNA, 40 bp, Artificial Sequence
  PCR primer for ORF amplification
caggagctgcacttcctgcttcatgttgaagttgagatgg

SEQ ID NO: 14124 - DNA, 40 bp, Artificial Sequence
  PCR primer for ORF amplification
caggagctgcacttccattaccggcgataattttccttcc

SEQ ID NO: 14125 - DNA, 40 bp, Artificial Sequence
  PCR primer for ORF amplification
caggagctgcacttccagaagattcgtcatccaagagatc

SEQ ID NO: 14126 - DNA, 40 bp, Artificial Sequence
  PCR primer for ORF amplification
caggagctgcacttccacaccaaaatctgtagattttgta

SEQ ID NO: 14127 - DNA, 40 bp, Artificial Sequence
  PCR primer for ORF amplification
caggagctgcacttcctctgattgcttgttgaacaatgtc

SEQ ID NO: 14128 - DNA, 40 bp, Artificial Sequence
  PCR primer for ORF amplification
caggagctgcacttccatatgttggtttacagacatttat

SEQ ID NO: 14129 - DNA, 40 bp, Artificial Sequence
  PCR primer for ORF amplification
caggagctgcacttcccctgtaatcattagcgggctcgtt

SEQ ID NO: 14130 - DNA, 40 bp, Artificial Sequence
  PCR primer for ORF amplification
caggagctgcacttccttttatcttttcagaattgggtaa

SEQ ID NO: 14131 - DNA, 40 bp, Artificial Sequence
  PCR primer for ORF amplification
caggagctgcacttcccataacttccagcgttgttccaca

SEQ ID NO: 14132 - DNA, 40 bp, Artificial Sequence
  PCR primer for ORF amplification
caggagctgcacttccatatataatctcattactgagctg

SEQ ID NO: 14133 - DNA, 40 bp, Artificial Sequence
  PCR primer for ORF amplification
caggagctgcacttccttcttcataaaattgcacgccaat

SEQ ID NO: 14134 - DNA, 40 bp, Artificial Sequence
  PCR primer for ORF amplification
caggagctgcacttccattctctactgtctcagttatgta

SEQ ID NO: 14135 - DNA, 40 bp, Artificial Sequence
  PCR primer for ORF amplification
caggagctgcacttccttcagatatgtaaattctgccctc

SEQ ID NO: 14136 - DNA, 40 bp, Artificial Sequence
  PCR primer for ORF amplification
caggagctgcacttccttcgctgatatatattcttccttc

SEQ ID NO: 14137 - DNA, 40 bp, Artificial Sequence
  PCR primer for ORF amplification
caggagctgcacttcccttggtggcggtatcctctcctgg

SEQ ID NO: 14138 - DNA, 40 bp, Artificial Sequence
  PCR primer for ORF amplification
caggagctgcacttccgcggccagtccggatgataccagc

SEQ ID NO: 14139 - DNA, 40 bp, Artificial Sequence
  PCR primer for ORF amplification
caggagctgcacttcctaatttagaagattgacttgataa

SEQ ID NO: 14140 - DNA, 40 bp, Artificial Sequence
  PCR primer for ORF amplification
caggagctgcacttcctattcttttggtcttgactttctt

SEQ ID NO: 14141 - DNA, 40 bp, Artificial Sequence
  PCR primer for ORF amplification
caggagctgcacttcctgctacaacattccaaaatttgtc

SEQ ID NO: 14142 - DNA, 40 bp, Artificial Sequence
  PCR primer for ORF amplification
caggagctgcacttcctatggaagaagaagaatttagcat

SEQ ID NO: 14143 - DNA, 40 bp, Artificial Sequence
  PCR primer for ORF amplification
caggagctgcacttccttttttggtgcgatatgtttttgg

SEQ ID NO: 14144 - DNA, 40 bp, Artificial Sequence
  PCR primer for ORF amplification
caggagctgcacttccctcatcaccctctgcaccaaatag

SEQ ID NO: 14145 - DNA, 40 bp, Artificial Sequence
  PCR primer for ORF amplification
caggagctgcacttccctttttctggtggcctttatgttt

SEQ ID NO: 14146 - DNA, 40 bp, Artificial Sequence
  PCR primer for ORF amplification
caggagctgcacttcctgcatcctcaaattctgttaaagt

SEQ ID NO: 14147 - DNA, 40 bp, Artificial Sequence
  PCR primer for ORF amplification
caggagctgcacttccagctttgtcgtcactattatcgtg

SEQ ID NO: 14148 - DNA, 40 bp, Artificial Sequence
  PCR primer for ORF amplification
caggagctgcacttccgtggtggaataaacgaattgggtt

SEQ ID NO: 14149 - DNA, 40 bp, Artificial Sequence
  PCR primer for ORF amplification
caggagctgcacttccattttcttcttcctttttgacttc

SEQ ID NO: 14150 - DNA, 40 bp, Artificial Sequence
  PCR primer for ORF amplification
caggagctgcacttccgtacccagcagctgtaacaaatcc

SEQ ID NO: 14151 - DNA, 40 bp, Artificial Sequence
  PCR primer for ORF amplification
caggagctgcacttccacaccagaaatggaactgtctcac

SEQ ID NO: 14152 - DNA, 40 bp, Artificial Sequence
  PCR primer for ORF amplification
caggagctgcacttccatggtggaacaaacggattgggtt

SEQ ID NO: 14153 - DNA, 40 bp, Artificial Sequence
  PCR primer for ORF amplification
caggagctgcacttccgttgcccaaagacacataattgct

SEQ ID NO: 14154 - DNA, 40 bp, Artificial Sequence
  PCR primer for ORF amplification
caggagctgcacttcctttttctttagtgaacatcctttt

SEQ ID NO: 14155 - DNA, 40 bp, Artificial Sequence
  PCR primer for ORF amplification
caggagctgcacttccgtcacggtattggtcaaaaaattc

SEQ ID NO: 14156 - DNA, 40 bp, Artificial Sequence
  PCR primer for ORF amplification
caggagctgcacttcccgaggaccgctttaaatagtagta

SEQ ID NO: 14157 - DNA, 40 bp, Artificial Sequence
  PCR primer for ORF amplification
caggagctgcacttcccattttcatggtttcttcaactcc

SEQ ID NO: 14158 - DNA, 40 bp, Artificial Sequence
  PCR primer for ORF amplification
caggagctgcacttccgtataacttaaatagactatctac

SEQ ID NO: 14159 - DNA, 40 bp, Artificial Sequence
  PCR primer for ORF amplification
caggagctgcacttcctttttcatcagatactgataaggt

SEQ ID NO: 14160 - DNA, 40 bp, Artificial Sequence
  PCR primer for ORF amplification
caggagctgcacttccaagttttatatttgtgctatctgg

SEQ ID NO: 14161 - DNA, 40 bp, Artificial Sequence
  PCR primer for ORF amplification
caggagctgcacttccatctagctgaggtaatgttattgt

SEQ ID NO: 14162 - DNA, 40 bp, Artificial Sequence
  PCR primer for ORF amplification
caggagctgcacttccgtagtggtttaatttccagagcct

SEQ ID NO: 14163 - DNA, 40 bp, Artificial Sequence
  PCR primer for ORF amplification
caggagctgcacttcctttgaagttcttcaacgggtctac

SEQ ID NO: 14164 - DNA, 40 bp, Artificial Sequence
  PCR primer for ORF amplification
caggagctgcacttccttgatcaatctcaggctcttcttc

SEQ ID NO: 14165 - DNA, 40 bp, Artificial Sequence
  PCR primer for ORF amplification
caggagctgcacttccatggataaattcctgtttcacgac

SEQ ID NO: 14166 - DNA, 40 bp, Artificial Sequence
  PCR primer for ORF amplification
caggagctgcacttcctaggaagacttcggcattaacctc

SEQ ID NO: 14167 - DNA, 40 bp, Artificial Sequence
  PCR primer for ORF amplification
caggagctgcacttccaatgtgatgaaaaatagctgtaat

SEQ ID NO: 14168 - DNA, 40 bp, Artificial Sequence
  PCR primer for ORF amplification
caggagctgcacttcctgctttgctataatattgaaattt

SEQ ID NO: 14169 - DNA, 40 bp, Artificial Sequence
  PCR primer for ORF amplification
caggagctgcacttccaagaacaataagtatcgagaatat

SEQ ID NO: 14170 - DNA, 40 bp, Artificial Sequence
  PCR primer for ORF amplification
caggagctgcacttcccctaaacaaaccgtcaatggcgtc

SEQ ID NO: 14171 - DNA, 40 bp, Artificial Sequence
  PCR primer for ORF amplification
caggagctgcacttccttcattttttatgatcgaaccatt

SEQ ID NO: 14172 - DNA, 40 bp, Artificial Sequence
  PCR primer for ORF amplification
caggagctgcacttcctttaccggcaatcgccttatcatg

SEQ ID NO: 14173 - DNA, 40 bp, Artificial Sequence
  PCR primer for ORF amplification
caggagctgcacttcctaaattatgtaaaggctgttcatc

SEQ ID NO: 14174 - DNA, 40 bp, Artificial Sequence
  PCR primer for ORF amplification
caggagctgcacttccgacaacttgttgagtggtactaaa

SEQ ID NO: 14175 - DNA, 40 bp, Artificial Sequence
  PCR primer for ORF amplification
caggagctgcacttccagcagctttttcactggcggtgga

SEQ ID NO: 14176 - DNA, 40 bp, Artificial Sequence
  PCR primer for ORF amplification
caggagctgcacttcccaaagacgatgaaggtgcagaaac

SEQ ID NO: 14177 - DNA, 40 bp, Artificial Sequence
  PCR primer for ORF amplification
caggagctgcacttccgaactgcacaaatgcttctctagg

SEQ ID NO: 14178 - DNA, 40 bp, Artificial Sequence
  PCR primer for ORF amplification
caggagctgcacttccggcaatttgtttttcactggaagt

SEQ ID NO: 14179 - DNA, 40 bp, Artificial Sequence
  PCR primer for ORF amplification
caggagctgcacttccccacctttgtttcatttcattcat

SEQ ID NO: 14180 - DNA, 40 bp, Artificial Sequence
  PCR primer for ORF amplification
caggagctgcacttccacgaccaaataggcccaagaaacc

SEQ ID NO: 14181 - DNA, 40 bp, Artificial Sequence
  PCR primer for ORF amplification
caggagctgcacttcctaggcttagtaggatggaatggat

SEQ ID NO: 14182 - DNA, 40 bp, Artificial Sequence
  PCR primer for ORF amplification
caggagctgcacttccctgagcaaaatataggttatttag

SEQ ID NO: 14183 - DNA, 40 bp, Artificial Sequence
  PCR primer for ORF amplification
caggagctgcacttccgatgagagtcttttccagttcgct

SEQ ID NO: 14184 - DNA, 40 bp, Artificial Sequence
  PCR primer for ORF amplification
caggagctgcacttccatatttggtggtggatcttagact

SEQ ID NO: 14185 - DNA, 40 bp, Artificial Sequence
  PCR primer for ORF amplification
caggagctgcacttcccttccgcgctgcgctcagcttccg

SEQ ID NO: 14186 - DNA, 40 bp, Artificial Sequence
  PCR primer for ORF amplification
caggagctgcacttccttcctctgcaatggaagcttcgat

SEQ ID NO: 14187 - DNA, 40 bp, Artificial Sequence
  PCR primer for ORF amplification
caggagctgcacttccacgagtaaaaaaacgagttaacaa

SEQ ID NO: 14188 - DNA, 40 bp, Artificial Sequence
  PCR primer for ORF amplification
caggagctgcacttccacaccagaaattccagattctata

SEQ ID NO: 14189 - DNA, 40 bp, Artificial Sequence
  PCR primer for ORF amplification
caggagctgcacttccaaattgagaaaagtaatcccgtaa

SEQ ID NO: 14190 - DNA, 40 bp, Artificial Sequence
  PCR primer for ORF amplification
caggagctgcacttcctgaaataattgcagcaccaacacc

SEQ ID NO: 14191 - DNA, 40 bp, Artificial Sequence
  PCR primer for ORF amplification
caggagctgcacttcctatattgaatttcggctttttatc

SEQ ID NO: 14192 - DNA, 40 bp, Artificial Sequence
  PCR primer for ORF amplification
caggagctgcacttccttctaagtctatatcgtaaataag

SEQ ID NO: 14193 - DNA, 40 bp, Artificial Sequence
  PCR primer for ORF amplification
caggagctgcacttcctttcaatgcgcgcccattatggca

SEQ ID NO: 14194 - DNA, 40 bp, Artificial Sequence
  PCR primer for ORF amplification
caggagctgcacttccttcacgtgttatacccacaccaaa

SEQ ID NO: 14195 - DNA, 40 bp, Artificial Sequence
  PCR primer for ORF amplification
caggagctgcacttccacaccagaaatgtaaaaatcttgt

SEQ ID NO: 14196 - DNA, 40 bp, Artificial Sequence
  PCR primer for ORF amplification
caggagctgcacttcctatctccatttcacctacaaattc

SEQ ID NO: 14197 - DNA, 40 bp, Artificial Sequence
  PCR primer for ORF amplification
caggagctgcacttcctgacattgtagtagaagagggcgt

SEQ ID NO: 14198 - DNA, 40 bp, Artificial Sequence
  PCR primer for ORF amplification
caggagctgcacttccatcttgttgttttgatttgtggat

SEQ ID NO: 14199 - DNA, 40 bp, Artificial Sequence
  PCR primer for ORF amplification
caggagctgcacttcctattctgacatttctgagatcgcg

SEQ ID NO: 14200 - DNA, 40 bp, Artificial Sequence
  PCR primer for ORF amplification
caggagctgcacttccccaccaagaagagttgtttgaacc

SEQ ID NO: 14201 - DNA, 40 bp, Artificial Sequence
  PCR primer for ORF amplification
caggagctgcacttccctctgccagtagaacatccccgga

SEQ ID NO: 14202 - DNA, 40 bp, Artificial Sequence
  PCR primer for ORF amplification
caggagctgcacttccttgtggcaattgcttaacggccgt

SEQ ID NO: 14203 - DNA, 40 bp, Artificial Sequence
  PCR primer for ORF amplification
caggagctgcacttccacaccaaaatttgtagactctgac

SEQ ID NO: 14204 - DNA, 40 bp, Artificial Sequence
  PCR primer for ORF amplification
caggagctgcacttcctttgctatcattctttgcatcatg

SEQ ID NO: 14205 - DNA, 40 bp, Artificial Sequence
  PCR primer for ORF amplification
caggagctgcacttcctttcttggaatctagtttattcag

SEQ ID NO: 14206 - DNA, 40 bp, Artificial Sequence
  PCR primer for ORF amplification
caggagctgcacttccttcgttcattagccgcagaaccct

SEQ ID NO: 14207 - DNA, 40 bp, Artificial Sequence
  PCR primer for ORF amplification
caggagctgcacttcctattcggtctatgtctattgtagt

SEQ ID NO: 14208 - DNA, 40 bp, Artificial Sequence
  PCR primer for ORF amplification
caggagctgcacttccaacaatatatgcgtactcttcgtc

SEQ ID NO: 14209 - DNA, 40 bp, Artificial Sequence
  PCR primer for ORF amplification
caggagctgcacttccccagttacttttcaaagtcttttt

SEQ ID NO: 14210 - DNA, 40 bp, Artificial Sequence
  PCR primer for ORF amplification
caggagctgcacttccaacctccccaactattctcctctt

SEQ ID NO: 14211 - DNA, 40 bp, Artificial Sequence
  PCR primer for ORF amplification
caggagctgcacttccatatccaattacacgacggagcca

SEQ ID NO: 14212 - DNA, 40 bp, Artificial Sequence
  PCR primer for ORF amplification
caggagctgcacttcccaaagacggggttggcatatttgc

SEQ ID NO: 14213 - DNA, 40 bp, Artificial Sequence
  PCR primer for ORF amplification
caggagctgcacttcctaagtcgtcaaaattgccttggat

SEQ ID NO: 14214 - DNA, 40 bp, Artificial Sequence
  PCR primer for ORF amplification
caggagctgcacttccacaccaggtgaatacgggggtgga

SEQ ID NO: 14215 - DNA, 40 bp, Artificial Sequence
  PCR primer for ORF amplification
caggagctgcacttccgtaaagtatgcgaccccaaaattc

SEQ ID NO: 14216 - DNA, 40 bp, Artificial Sequence
  PCR primer for ORF amplification
caggagctgcacttccggagtatatatatttagaggccag

SEQ ID NO: 14217 - DNA, 40 bp, Artificial Sequence
  PCR primer for ORF amplification
caggagctgcacttcccattctttctacgggagttaaacc

SEQ ID NO: 14218 - DNA, 40 bp, Artificial Sequence
  PCR primer for ORF amplification
caggagctgcacttccgaagatattacccaaaaatttttc

SEQ ID NO: 14219 - DNA, 40 bp, Artificial Sequence
  PCR primer for ORF amplification
caggagctgcacttcccatgagcaaccagtagaagatagc

SEQ ID NO: 14220 - DNA, 40 bp, Artificial Sequence
  PCR primer for ORF amplification
caggagctgcacttccaataccggtgttatccaagaaaaa

SEQ ID NO: 14221 - DNA, 40 bp, Artificial Sequence
  PCR primer for ORF amplification
caggagctgcacttcccgtgaccaaagtgtcaccctctcc

SEQ ID NO: 14222 - DNA, 40 bp, Artificial Sequence
  PCR primer for ORF amplification
caggagctgcacttccggaaagtatgtcagaaatgttata

SEQ ID NO: 14223 - DNA, 40 bp, Artificial Sequence
  PCR primer for ORF amplification
caggagctgcacttcctaggtgatgggatacattgctatt

SEQ ID NO: 14224 - DNA, 40 bp, Artificial Sequence
  PCR primer for ORF amplification
caggagctgcacttccactttctacaatttcctgtgtagg

SEQ ID NO: 14225 - DNA, 40 bp, Artificial Sequence
  PCR primer for ORF amplification
caggagctgcacttccgtatccaacttgatttttttttag

SEQ ID NO: 14226 - DNA, 40 bp, Artificial Sequence
  PCR primer for ORF amplification
caggagctgcacttcctgcctgaatagtcagccttttgta

SEQ ID NO: 14227 - DNA, 40 bp, Artificial Sequence
  PCR primer for ORF amplification
caggagctgcacttccacaccagaaatgataagcttttct

SEQ ID NO: 14228 - DNA, 40 bp, Artificial Sequence
  PCR primer for ORF amplification
caggagctgcacttcccttgatggagtgcggaacttgtct

SEQ ID NO: 14229 - DNA, 40 bp, Artificial Sequence
  PCR primer for ORF amplification
caggagctgcacttccagatgttaaggtggaggcgccatt

SEQ ID NO: 14230 - DNA, 40 bp, Artificial Sequence
  PCR primer for ORF amplification
caggagctgcacttccacatttcaagttgatgccatgtct

SEQ ID NO: 14231 - DNA, 40 bp, Artificial Sequence
  PCR primer for ORF amplification
caggagctgcacttcctaaggtcaggtacaacgtcataat

SEQ ID NO: 14232 - DNA, 40 bp, Artificial Sequence
  PCR primer for ORF amplification
caggagctgcacttccttgtgatgatcgttgctcattgtt

SEQ ID NO: 14233 - DNA, 40 bp, Artificial Sequence
  PCR primer for ORF amplification
caggagctgcacttccgtctgttttagtcttttttttccc

SEQ ID NO: 14234 - DNA, 40 bp, Artificial Sequence
  PCR primer for ORF amplification
caggagctgcacttcccaaaacaacgttcttggccaattt

SEQ ID NO: 14235 - DNA, 40 bp, Artificial Sequence
  PCR primer for ORF amplification
caggagctgcacttcccctgatcaaatattggctggtact

SEQ ID NO: 14236 - DNA, 40 bp, Artificial Sequence
  PCR primer for ORF amplification
caggagctgcacttccttccctgatagtggcgcttattgg

SEQ ID NO: 14237 - DNA, 40 bp, Artificial Sequence
  PCR primer for ORF amplification
caggagctgcacttccattcttgaatttaacagacctcgt

SEQ ID NO: 14238 - DNA, 40 bp, Artificial Sequence
  PCR primer for ORF amplification
caggagctgcacttcctattttttgacgaatattactgat

SEQ ID NO: 14239 - DNA, 40 bp, Artificial Sequence
  PCR primer for ORF amplification
caggagctgcacttcctgtggtacagcgttggttacttaa

SEQ ID NO: 14240 - DNA, 40 bp, Artificial Sequence
  PCR primer for ORF amplification
caggagctgcacttccctgagttatttcggatattttacc

SEQ ID NO: 14241 - DNA, 40 bp, Artificial Sequence
  PCR primer for ORF amplification
caggagctgcacttcctgcaacagcagcccagaatttctc

SEQ ID NO: 14242 - DNA, 40 bp, Artificial Sequence
  PCR primer for ORF amplification
caggagctgcacttcctcttttaaatcctaacgagcttgc

SEQ ID NO: 14243 - DNA, 40 bp, Artificial Sequence
  PCR primer for ORF amplification
caggagctgcacttccctgatgtacaaaagttgagagcca

SEQ ID NO: 14244 - DNA, 40 bp, Artificial Sequence
  PCR primer for ORF amplification
caggagctgcacttccttgattgtttgttccacggactag

SEQ ID NO: 14245 - DNA, 40 bp, Artificial Sequence
  PCR primer for ORF amplification
caggagctgcacttccaaacgaaaattctcctttaaatct

SEQ ID NO: 14246 - DNA, 40 bp, Artificial Sequence
  PCR primer for ORF amplification
caggagctgcacttccttgcatcatcttttgatatatctc

SEQ ID NO: 14247 - DNA, 40 bp, Artificial Sequence
  PCR primer for ORF amplification
caggagctgcacttccacgtgattggtgggggacgttacc

SEQ ID NO: 14248 - DNA, 40 bp, Artificial Sequence
  PCR primer for ORF amplification
caggagctgcacttccgtcaaatataccccttggcttttc

SEQ ID NO: 14249 - DNA, 40 bp, Artificial Sequence
  PCR primer for ORF amplification
caggagctgcacttccacgagaagacatggccttggtgac

SEQ ID NO: 14250 - DNA, 40 bp, Artificial Sequence; identical to SEQ ID NO: 14249
  PCR primer for ORF amplification

SEQ ID NO: 14251 - DNA, 40 bp, Artificial Sequence
  PCR primer for ORF amplification
caggagctgcacttcctctcaggcttgctgtgactttctt

SEQ ID NO: 14252 - DNA, 40 bp, Artificial Sequence
  PCR primer for ORF amplification
caggagctgcacttcctaatttcatttgaactttgatgaa

SEQ ID NO: 14253 - DNA, 40 bp, Artificial Sequence
  PCR primer for ORF amplification
caggagctgcacttccaagatcaattaagcttacaccttg

SEQ ID NO: 14254 - DNA, 40 bp, Artificial Sequence
  PCR primer for ORF amplification
caggagctgcacttcctttgttcacaacagatgaggtgtt

SEQ ID NO: 14255 - DNA, 40 bp, Artificial Sequence
  PCR primer for ORF amplification
caggagctgcacttcccatctcaacactgtcgatggaata

SEQ ID NO: 14256 - DNA, 40 bp, Artificial Sequence
  PCR primer for ORF amplification
caggagctgcacttccactttgcttttctttcgaccttac

SEQ ID NO: 14257 - DNA, 40 bp, Artificial Sequence
  PCR primer for ORF amplification
caggagctgcacttccacatcctgatttcttgttacttcg

SEQ ID NO: 14258 - DNA, 40 bp, Artificial Sequence
  PCR primer for ORF amplification
caggagctgcacttccacatcctaatttcttgttacttcg

SEQ ID NO: 14259 - DNA, 40 bp, Artificial Sequence
  PCR primer for ORF amplification
caggagctgcacttcccgacgagctattgtggtctacaag

SEQ ID NO: 14260 - DNA, 40 bp, Artificial Sequence
  PCR primer for ORF amplification
caggagctgcacttccgctattaattaccttaaattctcc

SEQ ID NO: 14261 - DNA, 40 bp, Artificial Sequence
  PCR primer for ORF amplification
caggagctgcacttccctcgaggacaacattccacctttt

SEQ ID NO: 14262 - DNA, 40 bp, Artificial Sequence
  PCR primer for ORF amplification
caggagctgcacttccacatttatcagctgcatttaattc

SEQ ID NO: 14263 - DNA, 40 bp, Artificial Sequence
  PCR primer for ORF amplification
caggagctgcacttccaattcctctccagacacatttttc

SEQ ID NO: 14264 - DNA, 40 bp, Artificial Sequence
  PCR primer for ORF amplification
caggagctgcacttccatggattaaaaacctgccatatac

SEQ ID NO: 14265 - DNA, 40 bp, Artificial Sequence
  PCR primer for ORF amplification
caggagctgcacttccaatatctgccgctggaatatcgct

SEQ ID NO: 14266 - DNA, 40 bp, Artificial Sequence
  PCR primer for ORF amplification
caggagctgcacttccctctactgcatactcaaaaatatc

SEQ ID NO: 14267 - DNA, 40 bp, Artificial Sequence
  PCR primer for ORF amplification
caggagctgcacttccaacggtctcaatatgctcctcata

SEQ ID NO: 14268 - DNA, 40 bp, Artificial Sequence
  PCR primer for ORF amplification
caggagctgcacttcccattaaaccctgttcgcgtaattt

SEQ ID NO: 14269 - DNA, 40 bp, Artificial Sequence
  PCR primer for ORF amplification
caggagctgcacttccccaccatgaagcgttgctatttcc

SEQ ID NO: 14270 - DNA, 40 bp, Artificial Sequence
  PCR primer for ORF amplification
caggagctgcacttccgtccatttcaaaaattggtaaaaa

SEQ ID NO: 14271 - DNA, 40 bp, Artificial Sequence
  PCR primer for ORF amplification
caggagctgcacttcctatatcatatctacgatcatcggc

SEQ ID NO: 14272 - DNA, 40 bp, Artificial Sequence
  PCR primer for ORF amplification
caggagctgcacttcctatcttaacaggcgacagtccaaa

SEQ ID NO: 14273 - DNA, 40 bp, Artificial Sequence
  PCR primer for ORF amplification
caggagctgcacttcctttttcgttagaaggtcttttagc

SEQ ID NO: 14274 - DNA, 40 bp, Artificial Sequence
  PCR primer for ORF amplification
caggagctgcacttccatcactattttcgtaattataaat

SEQ ID NO: 14275 - DNA, 40 bp, Artificial Sequence
  PCR primer for ORF amplification
caggagctgcacttccgaagtaaacctccttcaacctgcc

SEQ ID NO: 14276 - DNA, 40 bp, Artificial Sequence
  PCR primer for ORF amplification
caggagctgcacttccgcaccagaaattggtcatcctctt

SEQ ID NO: 14277 - DNA, 40 bp, Artificial Sequence
  PCR primer for ORF amplification
caggagctgcacttcctgcagagccagatgccgcagcatt

SEQ ID NO: 14278 - DNA, 40 bp, Artificial Sequence
  PCR primer for ORF amplification
caggagctgcacttccctcttccttttttgaaataggctt

SEQ ID NO: 14279 - DNA, 40 bp, Artificial Sequence
  PCR primer for ORF amplification
caggagctgcacttccctcaggtatgctattttcatccct

SEQ ID NO: 14280 - DNA, 40 bp, Artificial Sequence
  PCR primer for ORF amplification
caggagctgcacttccggtccccaagcgaaattctttacg

SEQ ID NO: 14281 - DNA, 40 bp, Artificial Sequence
  PCR primer for ORF amplification
caggagctgcacttcctgacctgcctaaggcctttgcaaa

SEQ ID NO: 14282 - DNA, 40 bp, Artificial Sequence
  PCR primer for ORF amplification
caggagctgcacttccgtagccaaaactctcgctgtgtaa

SEQ ID NO: 14283 - DNA, 40 bp, Artificial Sequence
  PCR primer for ORF amplification
caggagctgcacttcctagagtatttaaaacggttttcag

SEQ ID NO: 14284 - DNA, 40 bp, Artificial Sequence
  PCR primer for ORF amplification
caggagctgcacttccaattaaataatgtgtaaagcactt

SEQ ID NO: 14285 - DNA, 40 bp, Artificial Sequence
  PCR primer for ORF amplification
caggagctgcacttccttggttagtagaattttcattcat

SEQ ID NO: 14286 - DNA, 40 bp, Artificial Sequence
  PCR primer for ORF amplification
caggagctgcacttccatttgaatctttattcccgtgttg

SEQ ID NO: 14287 - DNA, 40 bp, Artificial Sequence
  PCR primer for ORF amplification
caggagctgcacttccagctaacaaagccttggataactc

SEQ ID NO: 14288 - DNA, 40 bp, Artificial Sequence
  PCR primer for ORF amplification
caggagctgcacttccttttaaagcgtcggttaaaatcaa

SEQ ID NO: 14289 - DNA, 40 bp, Artificial Sequence
  PCR primer for ORF amplification
caggagctgcacttccagacattaatgtattaacagccca

SEQ ID NO: 14290 - DNA, 40 bp, Artificial Sequence
  PCR primer for ORF amplification
caggagctgcacttccttcaatactatctatggaataatc

SEQ ID NO: 14291 - DNA, 40 bp, Artificial Sequence
  PCR primer for ORF amplification
caggagctgcacttccttgcttccccttatagatgtactg

SEQ ID NO: 14292 - DNA, 40 bp, Artificial Sequence
  PCR primer for ORF amplification
caggagctgcacttcctgatagctggttttcttgaagtgt

SEQ ID NO: 14293 - DNA, 40 bp, Artificial Sequence
  PCR primer for ORF amplification
caggagctgcacttccaaccatggcaccaaacccaaacaa

SEQ ID NO: 14294 - DNA, 40 bp, Artificial Sequence
  PCR primer for ORF amplification
caggagctgcacttccgggattgttgattgataggttgaa

SEQ ID NO: 14295 - DNA, 40 bp, Artificial Sequence
  PCR primer for ORF amplification
caggagctgcacttccaagctctattagcagttcctcttg

SEQ ID NO: 14296 - DNA, 40 bp, Artificial Sequence
  PCR primer for ORF amplification
caggagctgcacttccaaattttgtaactatattcatttc

SEQ ID NO: 14297 - DNA, 40 bp, Artificial Sequence
  PCR primer for ORF amplification
caggagctgcacttccgccgcgagaaacctctatttcatt

SEQ ID NO: 14298 - DNA, 40 bp, Artificial Sequence
  PCR primer for ORF amplification
caggagctgcacttcctacatgtacattctcgtacggtgt

SEQ ID NO: 14299 - DNA, 40 bp, Artificial Sequence
  PCR primer for ORF amplification
caggagctgcacttccatctctttttaaaggatccggctt

SEQ ID NO: 14300 - DNA, 40 bp, Artificial Sequence
  PCR primer for ORF amplification
caggagctgcacttcctctcactaattggttaagaacagt

SEQ ID NO: 14301 - DNA, 40 bp, Artificial Sequence
  PCR primer for ORF amplification
caggagctgcacttccattattcatagctacttcgttgct

SEQ ID NO: 14302 - DNA, 40 bp, Artificial Sequence
  PCR primer for ORF amplification
caggagctgcacttccatttgtcaaacttcgaagagcatc

SEQ ID NO: 14303 - DNA, 40 bp, Artificial Sequence
  PCR primer for ORF amplification
caggagctgcacttccccaagtttcctggatatatctatc

SEQ ID NO: 14304 - DNA, 40 bp, Artificial Sequence
  PCR primer for ORF amplification
caggagctgcacttccctctccaacttctctgctcgaatc

SEQ ID NO: 14305 - DNA, 40 bp, Artificial Sequence
  PCR primer for ORF amplification
caggagctgcacttcctttactatctgaaacaggatgaac

SEQ ID NO: 14306 - DNA, 40 bp, Artificial Sequence; identical to SEQ ID NO: 10306
  PCR primer for ORF amplification

SEQ ID NO: 14307 - DNA, 40 bp, Artificial Sequence
  PCR primer for ORF amplification
caggagctgcacttccttgtttgacactggtgatttgctt

SEQ ID NO: 14308 - DNA, 40 bp, Artificial Sequence
  PCR primer for ORF amplification
caggagctgcacttccccttattcttttgttatgtgttgt

SEQ ID NO: 14309 - DNA, 40 bp, Artificial Sequence
  PCR primer for ORF amplification
caggagctgcacttcccatggattcaaactctgtatcgat

SEQ ID NO: 14310 - DNA, 40 bp, Artificial Sequence
  PCR primer for ORF amplification
caggagctgcacttccaatagcgttatttcccgcacgagc

SEQ ID NO: 14311 - DNA, 40 bp, Artificial Sequence
  PCR primer for ORF amplification
caggagctgcacttcctcttttgtgtcttctgcttctcat

SEQ ID NO: 14312 - DNA, 40 bp, Artificial Sequence
  PCR primer for ORF amplification
caggagctgcacttcctagggcctcgtcgatttgtaactt

SEQ ID NO: 14313 - DNA, 40 bp, Artificial Sequence
  PCR primer for ORF amplification
caggagctgcacttcctggtaagacatttatccagaaatt

SEQ ID NO: 14314 - DNA, 40 bp, Artificial Sequence
  PCR primer for ORF amplification
caggagctgcacttcctaccaaaattttgggatacttggt

SEQ ID NO: 14315 - DNA, 40 bp, Artificial Sequence
  PCR primer for ORF amplification
caggagctgcacttcccatatgccttctgcactcccgagc

SEQ ID NO: 14316 - DNA, 40 bp, Artificial Sequence
  PCR primer for ORF amplification
caggagctgcacttccttttgtgaccaatttctttaagtc

SEQ ID NO: 14317 - DNA, 40 bp, Artificial Sequence
  PCR primer for ORF amplification
caggagctgcacttccatacttatagaaactatcttcctc

SEQ ID NO: 14318 - DNA, 40 bp, Artificial Sequence
  PCR primer for ORF amplification
caggagctgcacttccgaactgctgccgttgattttcaaa

SEQ ID NO: 14319 - DNA, 40 bp, Artificial Sequence
  PCR primer for ORF amplification
caggagctgcacttccgtcatccgacccatcactttcata

SEQ ID NO: 14320 - DNA, 40 bp, Artificial Sequence
  PCR primer for ORF amplification
caggagctgcacttcctttggtagcttcaggttgcttcac

SEQ ID NO: 14321 - DNA, 40 bp, Artificial Sequence
  PCR primer for ORF amplification
caggagctgcacttccttcccgtttaaaagtgaattttga

SEQ ID NO: 14322 - DNA, 40 bp, Artificial Sequence
  PCR primer for ORF amplification
caggagctgcacttcccaacaaggcgtccaagaacttgtc

SEQ ID NO: 14323 - DNA, 40 bp, Artificial Sequence
  PCR primer for ORF amplification
caggagctgcacttcctaactggggggatgtgtgacgatt

SEQ ID NO: 14324 - DNA, 40 bp, Artificial Sequence
  PCR primer for ORF amplification
caggagctgcacttccttttctatttacatgttgtaaaaa

SEQ ID NO: 14325 - DNA, 40 bp, Artificial Sequence
  PCR primer for ORF amplification
caggagctgcacttccatctttcctatctttactgcttgt

SEQ ID NO: 14326 - DNA, 40 bp, Artificial Sequence
  PCR primer for ORF amplification
caggagctgcacttccgccgaacaaaaccttcaccaattc

SEQ ID NO: 14327 - DNA, 40 bp, Artificial Sequence
  PCR primer for ORF amplification
caggagctgcacttccaacctttaccttcttggatgattt

SEQ ID NO: 14328 - DNA, 40 bp, Artificial Sequence
  PCR primer for ORF amplification
caggagctgcacttccttgaggaacgtcaaacacagcttg

SEQ ID NO: 14329 - DNA, 40 bp, Artificial Sequence
  PCR primer for ORF amplification
caggagctgcacttcctttaccttccttaagaaattcttc

SEQ ID NO: 14330 - DNA, 40 bp, Artificial Sequence
  PCR primer for ORF amplification
caggagctgcacttccctgatcatcgattaatcttttcaa

SEQ ID NO: 14331 - DNA, 40 bp, Artificial Sequence
  PCR primer for ORF amplification
caggagctgcacttccattattgctattgtttggacttcc

SEQ ID NO: 14332 - DNA, 40 bp, Artificial Sequence
  PCR primer for ORF amplification
caggagctgcacttccagcttgtgcggtgttattgtgata

SEQ ID NO: 14333 - DNA, 40 bp, Artificial Sequence
  PCR primer for ORF amplification
caggagctgcacttccaaaatcaccgtgctttttgtgagt

SEQ ID NO: 14334 - DNA, 40 bp, Artificial Sequence
  PCR primer for ORF amplification
caggagctgcacttccatcatatagcctactgtccttaaa

SEQ ID NO: 14335 - DNA, 40 bp, Artificial Sequence
  PCR primer for ORF amplification
caggagctgcacttccattagcattccaggttcgagaaat

SEQ ID NO: 14336 - DNA, 40 bp, Artificial Sequence
  PCR primer for ORF amplification
caggagctgcacttccatgttcttcatcatttgataatag

SEQ ID NO: 14337 - DNA, 40 bp, Artificial Sequence
  PCR primer for ORF amplification
caggagctgcacttccagcaatctcatcagattcatcatc

SEQ ID NO: 14338 - DNA, 40 bp, Artificial Sequence
  PCR primer for ORF amplification
caggagctgcacttcctttgcttccacttagatcggtgaa

SEQ ID NO: 14339 - DNA, 40 bp, Artificial Sequence
  PCR primer for ORF amplification
caggagctgcacttccagttagcgtgtactttggtccatc

SEQ ID NO: 14340 - DNA, 40 bp, Artificial Sequence
  PCR primer for ORF amplification
caggagctgcacttccaagactggttttcctggttttgat

SEQ ID NO: 14341 - DNA, 40 bp, Artificial Sequence
  PCR primer for ORF amplification
caggagctgcacttccgtatttctttttcatcctttcttc

SEQ ID NO: 14342 - DNA, 40 bp, Artificial Sequence
  PCR primer for ORF amplification
caggagctgcacttccttttatattctttttagagtttaa

SEQ ID NO: 14343 - DNA, 40 bp, Artificial Sequence
  PCR primer for ORF amplification
caggagctgcacttccaagtttaccaaaagcatcatatat

SEQ ID NO: 14344 - DNA, 40 bp, Artificial Sequence
  PCR primer for ORF amplification
caggagctgcacttcctcttttcatgaattggccacgtct

SEQ ID NO: 14345 - DNA, 40 bp, Artificial Sequence
  PCR primer for ORF amplification
caggagctgcacttcctttttttcttgtaaaaaatgataa

SEQ ID NO: 14346 - DNA, 40 bp, Artificial Sequence
  PCR primer for ORF amplification
caggagctgcacttccattgctttgactgttaacggctaa

SEQ ID NO: 14347 - DNA, 40 bp, Artificial Sequence
  PCR primer for ORF amplification
caggagctgcacttcctttacagtaacttgtaggaaatag

SEQ ID NO: 14348 - DNA, 40 bp, Artificial Sequence
  PCR primer for ORF amplification
caggagctgcacttccgtcacccttgtcttttttcttcct

SEQ ID NO: 14349 - DNA, 40 bp, Artificial Sequence
  PCR primer for ORF amplification
caggagctgcacttccaatgaaagtcttttcgtgttcgtg

SEQ ID NO: 14350 - DNA, 40 bp, Artificial Sequence
  PCR primer for ORF amplification
caggagctgcacttccgtggttttgggaagagaaatctgc

SEQ ID NO: 14351 - DNA, 40 bp, Artificial Sequence
  PCR primer for ORF amplification
caggagctgcacttccaaagaacgattttgcaagcgcttc

SEQ ID NO: 14352 - DNA, 40 bp, Artificial Sequence
  PCR primer for ORF amplification
caggagctgcacttccccaatcatcaccattgtccatatc

SEQ ID NO: 14353 - DNA, 40 bp, Artificial Sequence
  PCR primer for ORF amplification
caggagctgcacttccatcgctttctttcttgttcgttgt

SEQ ID NO: 14354 - DNA, 40 bp, Artificial Sequence
  PCR primer for ORF amplification
caggagctgcacttccacaccagaaggcaacgaccctttt

SEQ ID NO: 14355 - DNA, 40 bp, Artificial Sequence
  PCR primer for ORF amplification
caggagctgcacttccataggatctgacagctggagggac

SEQ ID NO: 14356 - DNA, 40 bp, Artificial Sequence
  PCR primer for ORF amplification
caggagctgcacttccaataatattcaatttatcaagaat

SEQ ID NO: 14357 - DNA, 40 bp, Artificial Sequence
  PCR primer for ORF amplification
caggagctgcacttccgaaactactccaattccagtttgc

SEQ ID NO: 14358 - DNA, 40 bp, Artificial Sequence
  PCR primer for ORF amplification
caggagctgcacttccttttttatttcttttaagtgccgc

SEQ ID NO: 14359 - DNA, 40 bp, Artificial Sequence
  PCR primer for ORF amplification
caggagctgcacttccgtaaactatcttttcctcggtgcc

SEQ ID NO: 14360 - DNA, 40 bp, Artificial Sequence
  PCR primer for ORF amplification
caggagctgcacttccattttttaaaagttcttgacattc

SEQ ID NO: 14361 - DNA, 40 bp, Artificial Sequence
  PCR primer for ORF amplification
caggagctgcacttcctataatttccctcaagaacccttg

SEQ ID NO: 14362 - DNA, 40 bp, Artificial Sequence
  PCR primer for ORF amplification
caggagctgcacttccgaagaaccgtttggctttagttaa

SEQ ID NO: 14363 - DNA, 40 bp, Artificial Sequence
  PCR primer for ORF amplification
caggagctgcacttccgtctaattcaacaatatcagaatt

SEQ ID NO: 14364 - DNA, 40 bp, Artificial Sequence
  PCR primer for ORF amplification
caggagctgcacttccgtgacaaactcctttgtgcgagac

SEQ ID NO: 14365 - DNA, 40 bp, Artificial Sequence
  PCR primer for ORF amplification
caggagctgcacttcccatatcaattaaattgaggttgtt

SEQ ID NO: 14366 - DNA, 40 bp, Artificial Sequence
  PCR primer for ORF amplification
caggagctgcacttccatgcttcttgatgattaatgcacc

SEQ ID NO: 14367 - DNA, 40 bp, Artificial Sequence
  PCR primer for ORF amplification
caggagctgcacttcccagccagtgcgacgtagcatcttt

SEQ ID NO: 14368 - DNA, 40 bp, Artificial Sequence
  PCR primer for ORF amplification
caggagctgcacttcccttatccaaggataactttcgtcc

SEQ ID NO: 14369 - DNA, 40 bp, Artificial Sequence
  PCR primer for ORF amplification
caggagctgcacttccatcactgtcactgtcgctactatc

SEQ ID NO: 14370 - DNA, 40 bp, Artificial Sequence
  PCR primer for ORF amplification
caggagctgcacttcctacaccaatgtggaataacagctg

SEQ ID NO: 14371 - DNA, 40 bp, Artificial Sequence
  PCR primer for ORF amplification
caggagctgcacttccttcccctaaagctttctcaatggc

SEQ ID NO: 14372 - DNA, 40 bp, Artificial Sequence
  PCR primer for ORF amplification
caggagctgcacttccgatatatcgtatcttttcatagcc

SEQ ID NO: 14373 - DNA, 40 bp, Artificial Sequence
  PCR primer for ORF amplification
caggagctgcacttccaaaaacatcctcatcaagcgatat

SEQ ID NO: 14374 - DNA, 40 bp, Artificial Sequence
  PCR primer for ORF amplification
caggagctgcacttccaagcatgcctttagccctataacg

SEQ ID NO: 14375 - DNA, 40 bp, Artificial Sequence
  PCR primer for ORF amplification
caggagctgcacttccgattctcttcattatacacacact

SEQ ID NO: 14376 - DNA, 40 bp, Artificial Sequence
  PCR primer for ORF amplification
caggagctgcacttccatcaacttcttcgacagttggacc

SEQ ID NO: 14377 - DNA, 40 bp, Artificial Sequence
  PCR primer for ORF amplification
caggagctgcacttccaagtaaaggctggaaaaccggctg

SEQ ID NO: 14378 - DNA, 40 bp, Artificial Sequence
  PCR primer for ORF amplification
caggagctgcacttccatcattgagatcgaatttgtacat

SEQ ID NO: 14379 - DNA, 40 bp, Artificial Sequence
  PCR primer for ORF amplification
caggagctgcacttccattattttcaatgctaaaaacttt

SEQ ID NO: 14380 - DNA, 40 bp, Artificial Sequence
  PCR primer for ORF amplification
caggagctgcacttccataataaatattagaattgtgctc

SEQ ID NO: 14381 - DNA, 40 bp, Artificial Sequence
  PCR primer for ORF amplification
caggagctgcacttccgtaggctcttacagttggaggtac

SEQ ID NO: 14382 - DNA, 40 bp, Artificial Sequence
  PCR primer for ORF amplification
caggagctgcacttcctttacggcccttcttcttgttctt

SEQ ID NO: 14383 - DNA, 40 bp, Artificial Sequence
  PCR primer for ORF amplification
caggagctgcacttcctatttgaccattatctgcaaagtt

SEQ ID NO: 14384 - DNA, 40 bp, Artificial Sequence
  PCR primer for ORF amplification
caggagctgcacttcctgcaaaatcttgatgtcttttgac

SEQ ID NO: 14385 - DNA, 40 bp, Artificial Sequence
  PCR primer for ORF amplification
caggagctgcacttccatttctggtgaaagcttcaactaa

SEQ ID NO: 14386 - DNA, 40 bp, Artificial Sequence
  PCR primer for ORF amplification
caggagctgcacttcccgagcgtatgttcatctcttctat

SEQ ID NO: 14387 - DNA, 40 bp, Artificial Sequence
  PCR primer for ORF amplification
caggagctgcacttcccctactccgtcttgctcttattat

SEQ ID NO: 14388 - DNA, 40 bp, Artificial Sequence
  PCR primer for ORF amplification
caggagctgcacttccaagagcctggcctttagagagcca

SEQ ID NO: 14389 - DNA, 40 bp, Artificial Sequence
  PCR primer for ORF amplification
caggagctgcacttccggtaagccttggaaccttagctat

SEQ ID NO: 14390 - DNA, 40 bp, Artificial Sequence
  PCR primer for ORF amplification
caggagctgcacttccgaatgtcaagtacaacgtacacat

SEQ ID NO: 14391 - DNA, 40 bp, Artificial Sequence
  PCR primer for ORF amplification
caggagctgcacttccaaggttcatctgtactttcagaaa

SEQ ID NO: 14392 - DNA, 40 bp, Artificial Sequence
  PCR primer for ORF amplification
caggagctgcacttccatcaacttcttcaacggttggacc

SEQ ID NO: 14393 - DNA, 40 bp, Artificial Sequence
  PCR primer for ORF amplification
caggagctgcacttccatcaacctcttcaaccgttgggcc

SEQ ID NO: 14394 - DNA, 40 bp, Artificial Sequence
  PCR primer for ORF amplification
caggagctgcacttccgttcgaattgttgttatattcgtt

SEQ ID NO: 14395 - DNA, 40 bp, Artificial Sequence
  PCR primer for ORF amplification
caggagctgcacttccttcatccttccaacccaacttttc

SEQ ID NO: 14396 - DNA, 40 bp, Artificial Sequence
  PCR primer for ORF amplification
caggagctgcacttccttccatctcaacgtcactatatcc

SEQ ID NO: 14397 - DNA, 40 bp, Artificial Sequence
  PCR primer for ORF amplification
caggagctgcacttccaagtgtccatacattgatgtctcc

SEQ ID NO: 14398 - DNA, 40 bp, Artificial Sequence
  PCR primer for ORF amplification
caggagctgcacttccaaagcttaaaacatcattgataaa

SEQ ID NO: 14399 - DNA, 40 bp, Artificial Sequence
  PCR primer for ORF amplification
caggagctgcacttcccattctatcaaccgggactagtcc

SEQ ID NO: 14400 - DNA, 40 bp, Artificial Sequence
  PCR primer for ORF amplification
caggagctgcacttcccgcttcatcttcctgaccatcttc

SEQ ID NO: 14401 - DNA, 40 bp, Artificial Sequence
  PCR primer for ORF amplification
caggagctgcacttccatcctcggttagtttgccaagctc

SEQ ID NO: 14402 - DNA, 40 bp, Artificial Sequence
  PCR primer for ORF amplification
caggagctgcacttccaaacacggccccatcacttataaa

SEQ ID NO: 14403 - DNA, 40 bp, Artificial Sequence
  PCR primer for ORF amplification
caggagctgcacttccataagttggggttttatctaaacg

SEQ ID NO: 14404 - DNA, 40 bp, Artificial Sequence
  PCR primer for ORF amplification
caggagctgcacttccgctggcttctttagctaaagagaa

SEQ ID NO: 14405 - DNA, 40 bp, Artificial Sequence
  PCR primer for ORF amplification
caggagctgcacttcctttattttctctcccgttcttagt

SEQ ID NO: 14406 - DNA, 40 bp, Artificial Sequence
  PCR primer for ORF amplification
caggagctgcacttccaagcccaaaattcattttaaagcc

SEQ ID NO: 14407 - DNA, 40 bp, Artificial Sequence
  PCR primer for ORF amplification
caggagctgcacttccacggcgcaaaaaagcctgatatgc

SEQ ID NO: 14408 - DNA, 40 bp, Artificial Sequence
  PCR primer for ORF amplification
caggagctgcacttccgaaggttacatttccaaaatgttg

SEQ ID NO: 14409 - DNA, 40 bp, Artificial Sequence
  PCR primer for ORF amplification
caggagctgcacttccttccagattgttagaggccagttt

SEQ ID NO: 14410 - DNA, 40 bp, Artificial Sequence
  PCR primer for ORF amplification
caggagctgcacttcctgacgaagtaggcacagatttctt

SEQ ID NO: 14411 - DNA, 40 bp, Artificial Sequence
  PCR primer for ORF amplification
caggagctgcacttccttgctccttagcaataaagctatg

SEQ ID NO: 14412 - DNA, 40 bp, Artificial Sequence
  PCR primer for ORF amplification
caggagctgcacttccagtgcttccccccataggctcaac

SEQ ID NO: 14413 - DNA, 40 bp, Artificial Sequence
  PCR primer for ORF amplification
caggagctgcacttccttgttttgagtttgttttaaattt

SEQ ID NO: 14414 - DNA, 40 bp, Artificial Sequence
  PCR primer for ORF amplification
caggagctgcacttcctattgtaattctttcactcgtgta

SEQ ID NO: 14415 - DNA, 40 bp, Artificial Sequence
  PCR primer for ORF amplification
caggagctgcacttccacggaaatctgtcttaccgacacc

SEQ ID NO: 14416 - DNA, 40 bp, Artificial Sequence
  PCR primer for ORF amplification
caggagctgcacttccatctgtcacagaggaatgcttgct

SEQ ID NO: 14417 - DNA, 40 bp, Artificial Sequence
  PCR primer for ORF amplification
caggagctgcacttccagtgagctttttctttcttttaca

SEQ ID NO: 14418 - DNA, 40 bp, Artificial Sequence
  PCR primer for ORF amplification
caggagctgcacttccattattgtgaggtagagtggatag

SEQ ID NO: 14419 - DNA, 40 bp, Artificial Sequence
  PCR primer for ORF amplification
caggagctgcacttcccttcgacaaaccatcattggtgtt

SEQ ID NO: 14420 - DNA, 40 bp, Artificial Sequence
  PCR primer for ORF amplification
caggagctgcacttccgggtgacggcgacttataaaaata

SEQ ID NO: 14421 - DNA, 40 bp, Artificial Sequence
  PCR primer for ORF amplification
caggagctgcacttcccagatcgacttcatcaacaaatcc

SEQ ID NO: 14422 - DNA, 40 bp, Artificial Sequence
  PCR primer for ORF amplification
caggagctgcacttcctatttctaccgttttatcaattgc

SEQ ID NO: 14423 - DNA, 40 bp, Artificial Sequence
  PCR primer for ORF amplification
caggagctgcacttcctgatttcccgtaacttccattaaa

SEQ ID NO: 14424 - DNA, 40 bp, Artificial Sequence
  PCR primer for ORF amplification
caggagctgcacttccatcaacctcttccactgttggacc

SEQ ID NO: 14425 - DNA, 40 bp, Artificial Sequence
  PCR primer for ORF amplification
caggagctgcacttccgacaccaaacgtcttgatgaagtt

SEQ ID NO: 14426 - DNA, 40 bp, Artificial Sequence
  PCR primer for ORF amplification
caggagctgcacttccgttcatatgcttattcaaagctaa

SEQ ID NO: 14427 - DNA, 40 bp, Artificial Sequence
  PCR primer for ORF amplification
caggagctgcacttcctaacaatccactcaaggtcagctt

SEQ ID NO: 14428 - DNA, 40 bp, Artificial Sequence
  PCR primer for ORF amplification
caggagctgcacttccgaatagcaggtacgacaaaagcag

SEQ ID NO: 14429 - DNA, 40 bp, Artificial Sequence
  PCR primer for ORF amplification
caggagctgcacttcctgcggaacctttgtactctcttaa

SEQ ID NO: 14430 - DNA, 40 bp, Artificial Sequence
  PCR primer for ORF amplification
caggagctgcacttccttttgacagttcgccaattttttg

SEQ ID NO: 14431 - DNA, 40 bp, Artificial Sequence
  PCR primer for ORF amplification
caggagctgcacttccccttcttttggaaggtttagtagt

SEQ ID NO: 14432 - DNA, 40 bp, Artificial Sequence
  PCR primer for ORF amplification
caggagctgcacttcctctgatacctgccaacctgttggt

SEQ ID NO: 14433 - DNA, 40 bp, Artificial Sequence
  PCR primer for ORF amplification
caggagctgcacttccaacattttgtttttcttttggaaa

SEQ ID NO: 14434 - DNA, 40 bp, Artificial Sequence
  PCR primer for ORF amplification
caggagctgcacttcctttatttttaacaccacctctttt

SEQ ID NO: 14435 - DNA, 40 bp, Artificial Sequence
  PCR primer for ORF amplification
caggagctgcacttccagccctgttagcagagcctgaacg

SEQ ID NO: 14436 - DNA, 40 bp, Artificial Sequence
  PCR primer for ORF amplification
caggagctgcacttccatcgttacagtttcccatatatag

SEQ ID NO: 14437 - DNA, 40 bp, Artificial Sequence
  PCR primer for ORF amplification
caggagctgcacttccctgcttagtttcaccagattcggc

SEQ ID NO: 14438 - DNA, 40 bp, Artificial Sequence
  PCR primer for ORF amplification
caggagctgcacttcctgccatttggaaaacttcccaaag

SEQ ID NO: 14439 - DNA, 40 bp, Artificial Sequence
  PCR primer for ORF amplification
caggagctgcacttcctcttaagtaacgtttgacagccga

SEQ ID NO: 14440 - DNA, 40 bp, Artificial Sequence
  PCR primer for ORF amplification
caggagctgcacttccatgccactttaaggatactttgag

SEQ ID NO: 14441 - DNA, 40 bp, Artificial Sequence
  PCR primer for ORF amplification
caggagctgcacttcccgtagcattagggttgcctgaggc

SEQ ID NO: 14442 - DNA, 40 bp, Artificial Sequence
  PCR primer for ORF amplification
caggagctgcacttcctacatttcctggtttttttgccct

SEQ ID NO: 14443 - DNA, 40 bp, Artificial Sequence
  PCR primer for ORF amplification
caggagctgcacttcccatggatgccttgacacggtcata

SEQ ID NO: 14444 - DNA, 40 bp, Artificial Sequence
  PCR primer for ORF amplification
caggagctgcacttcccaactttaatattataaatataag

SEQ ID NO: 14445 - DNA, 40 bp, Artificial Sequence
  PCR primer for ORF amplification
caggagctgcacttcctgaagaagttcgtgttcgagatct

SEQ ID NO: 14446 - DNA, 40 bp, Artificial Sequence
  PCR primer for ORF amplification
caggagctgcacttccgcttccagaagagggactttttgg

SEQ ID NO: 14447 - DNA, 40 bp, Artificial Sequence
  PCR primer for ORF amplification
caggagctgcacttccttttaacaatttagccaaaagctg

SEQ ID NO: 14448 - DNA, 40 bp, Artificial Sequence
  PCR primer for ORF amplification
caggagctgcacttcccagctgattgctttttctagggga

SEQ ID NO: 14449 - DNA, 40 bp, Artificial Sequence
  PCR primer for ORF amplification
caggagctgcacttccatttattctgccattgtaggggtt

SEQ ID NO: 14450 - DNA, 40 bp, Artificial Sequence
  PCR primer for ORF amplification
caggagctgcacttccatatagatctgcaatatcactatt

SEQ ID NO: 14451 - DNA, 40 bp, Artificial Sequence
  PCR primer for ORF amplification
caggagctgcacttcctttaccttgattctgctggttttt

SEQ ID NO: 14452 - DNA, 40 bp, Artificial Sequence
  PCR primer for ORF amplification
caggagctgcacttccggcttggtcgagtaacatttccca

SEQ ID NO: 14453 - DNA, 40 bp, Artificial Sequence
  PCR primer for ORF amplification
caggagctgcacttcctttttttgaattactatacttgat

SEQ ID NO: 14454 - DNA, 40 bp, Artificial Sequence
  PCR primer for ORF amplification
caggagctgcacttcctgagtaacagtagtctttaaagca

SEQ ID NO: 14455 - DNA, 40 bp, Artificial Sequence
  PCR primer for ORF amplification
caggagctgcacttccaactgtaaatccgaggctttcagc

SEQ ID NO: 14456 - DNA, 40 bp, Artificial Sequence
  PCR primer for ORF amplification
caggagctgcacttccaaccattctggcggaagcatcggt

SEQ ID NO: 14457 - DNA, 40 bp, Artificial Sequence
  PCR primer for ORF amplification
caggagctgcacttccgagtatttccagatctgaatctga

SEQ ID NO: 14458 - DNA, 40 bp, Artificial Sequence
  PCR primer for ORF amplification
caggagctgcacttccgtcatgagggagataaggaggaaa

SEQ ID NO: 14459 - DNA, 40 bp, Artificial Sequence
  PCR primer for ORF amplification
caggagctgcacttccattgtatagacgtttttcatagga

SEQ ID NO: 14460 - DNA, 40 bp, Artificial Sequence
  PCR primer for ORF amplification
caggagctgcacttccgtatacggaggagattcctctttt

SEQ ID NO: 14461 - DNA, 40 bp, Artificial Sequence
  PCR primer for ORF amplification
caggagctgcacttccgtcaaaggtggctttgcgaagacg

SEQ ID NO: 14462 - DNA, 40 bp, Artificial Sequence
  PCR primer for ORF amplification
caggagctgcacttccttggtcttcaaatgtcaaactctt

SEQ ID NO: 14463 - DNA, 40 bp, Artificial Sequence
  PCR primer for ORF amplification
caggagctgcacttccgttttttatatgaccaacattaga

SEQ ID NO: 14464 - DNA, 40 bp, Artificial Sequence
  PCR primer for ORF amplification
caggagctgcacttcccattgggaagggcatctgagaaac

SEQ ID NO: 14465 - DNA, 40 bp, Artificial Sequence
  PCR primer for ORF amplification
caggagctgcacttcctttagccgcccgcgttttcctaac

SEQ ID NO: 14466 - DNA, 40 bp, Artificial Sequence
  PCR primer for ORF amplification
caggagctgcacttccctttgcaaggcaatctaacgattc

SEQ ID NO: 14467 - DNA, 40 bp, Artificial Sequence
  PCR primer for ORF amplification
caggagctgcacttccggtcgaagccggaacttgagaaga

SEQ ID NO: 14468 - DNA, 40 bp, Artificial Sequence
  PCR primer for ORF amplification
caggagctgcacttccttttgagaattttgatgatttgaa

SEQ ID NO: 14469 - DNA, 40 bp, Artificial Sequence
  PCR primer for ORF amplification
caggagctgcacttcctgtagaagtatgacgatgaataat

SEQ ID NO: 14470 - DNA, 40 bp, Artificial Sequence
  PCR primer for ORF amplification
caggagctgcacttcctttttgttgcatttgcttagatct

SEQ ID NO: 14471 - DNA, 40 bp, Artificial Sequence
  PCR primer for ORF amplification
caggagctgcacttccacaccagaaatcaagaactctttt

SEQ ID NO: 14472 - DNA, 40 bp, Artificial Sequence
  PCR primer for ORF amplification
caggagctgcacttcccataacagtggctattcttgcaat

SEQ ID NO: 14473 - DNA, 40 bp, Artificial Sequence
  PCR primer for ORF amplification
caggagctgcacttccttctggtgattcatcatcttcagc

SEQ ID NO: 14474 - DNA, 40 bp, Artificial Sequence
  PCR primer for ORF amplification
caggagctgcacttccccatcccatgaaatcttcggatgt

SEQ ID NO: 14475 - DNA, 40 bp, Artificial Sequence
  PCR primer for ORF amplification
caggagctgcacttccttctttccattcccaacatgtcat

SEQ ID NO: 14476 - DNA, 40 bp, Artificial Sequence
  PCR primer for ORF amplification
caggagctgcacttcctttagaacactctttagatctaga

SEQ ID NO: 14477 - DNA, 40 bp, Artificial Sequence
  PCR primer for ORF amplification
caggagctgcacttcctgccgtcttctcaacttctttctt

SEQ ID NO: 14478 - DNA, 40 bp, Artificial Sequence
  PCR primer for ORF amplification
caggagctgcacttccaattagaccgaagacggcactaat

SEQ ID NO: 14479 - DNA, 40 bp, Artificial Sequence
  PCR primer for ORF amplification
caggagctgcacttccgagtcgatatttcaaaccattaag

SEQ ID NO: 14480 - DNA, 40 bp, Artificial Sequence
  PCR primer for ORF amplification
caggagctgcacttccatatatgttgctgtttctactgga

SEQ ID NO: 14481 - DNA, 40 bp, Artificial Sequence
  PCR primer for ORF amplification
caggagctgcacttccatcaaaataaaaattttgggttac

SEQ ID NO: 14482 - DNA, 40 bp, Artificial Sequence
  PCR primer for ORF amplification
caggagctgcacttccttcaggctcaaaagcttgatctga

SEQ ID NO: 14483 - DNA, 40 bp, Artificial Sequence
  PCR primer for ORF amplification
caggagctgcacttccttgtgtagtagttgaagtgtttgt

SEQ ID NO: 14484 - DNA, 40 bp, Artificial Sequence
  PCR primer for ORF amplification
caggagctgcacttcctgcatcgttgttgctgctattact

SEQ ID NO: 14485 - DNA, 40 bp, Artificial Sequence
  PCR primer for ORF amplification
caggagctgcacttcctctatagtgcttttgctttttgaa

SEQ ID NO: 14486 - DNA, 40 bp, Artificial Sequence
  PCR primer for ORF amplification
caggagctgcacttccgtcagtttcagcttcagcttcagc

SEQ ID NO: 14487 - DNA, 40 bp, Artificial Sequence
  PCR primer for ORF amplification
caggagctgcacttccgtatatgtattttttgcatgcggc

SEQ ID NO: 14488 - DNA, 40 bp, Artificial Sequence
  PCR primer for ORF amplification
caggagctgcacttccgtcaactttaatggatgagtagat

SEQ ID NO: 14489 - DNA, 40 bp, Artificial Sequence
  PCR primer for ORF amplification
caggagctgcacttcctgtggattctggagcaaataaacg

SEQ ID NO: 14490 - DNA, 40 bp, Artificial Sequence
  PCR primer for ORF amplification
caggagctgcacttcctaaaccacccatatgtaatgccgg

SEQ ID NO: 14491 - DNA, 40 bp, Artificial Sequence
  PCR primer for ORF amplification
caggagctgcacttccccatagattcttcttgttttggtt

SEQ ID NO: 14492 - DNA, 40 bp, Artificial Sequence
  PCR primer for ORF amplification
caggagctgcacttccggaatctctgtttgcataagagct

SEQ ID NO: 14493 - DNA, 40 bp, Artificial Sequence
  PCR primer for ORF amplification
caggagctgcacttccattgatttcactcaatgacaacgc

SEQ ID NO: 14494 - DNA, 40 bp, Artificial Sequence
  PCR primer for ORF amplification
caggagctgcacttccgttaatgtcattctgcagtttgaa

SEQ ID NO: 14495 - DNA, 40 bp, Artificial Sequence
  PCR primer for ORF amplification
caggagctgcacttccaagaccttgatgcagtagctgaat

SEQ ID NO: 14496 - DNA, 40 bp, Artificial Sequence
  PCR primer for ORF amplification
caggagctgcacttcctgttaccttcttagcattaccata

SEQ ID NO: 14497 - DNA, 40 bp, Artificial Sequence
  PCR primer for ORF amplification
caggagctgcacttcccatgactggttggcttggcttccg

SEQ ID NO: 14498 - DNA, 40 bp, Artificial Sequence
  PCR primer for ORF amplification
caggagctgcacttcccaattggttggtgtgcaccgatgg

SEQ ID NO: 14499 - DNA, 40 bp, Artificial Sequence
  PCR primer for ORF amplification
caggagctgcacttcctaatttaattgtttgtgcatcgat

SEQ ID NO: 14500 - DNA, 40 bp, Artificial Sequence
  PCR primer for ORF amplification
caggagctgcacttcctaactttgcttttcgtttattctc

SEQ ID NO: 14501 - DNA, 40 bp, Artificial Sequence
  PCR primer for ORF amplification
caggagctgcacttccacccaaggcttgatgattgctgct

SEQ ID NO: 14502 - DNA, 40 bp, Artificial Sequence
  PCR primer for ORF amplification
caggagctgcacttcccagcatatccttgaagatagtgtt

SEQ ID NO: 14503 - DNA, 40 bp, Artificial Sequence
  PCR primer for ORF amplification
caggagctgcacttccattatcagaatcgatgtcatcgtc

SEQ ID NO: 14504 - DNA, 40 bp, Artificial Sequence
  PCR primer for ORF amplification
caggagctgcacttcctttctttttccctttcttcttatt

SEQ ID NO: 14505 - DNA, 40 bp, Artificial Sequence
  PCR primer for ORF amplification
caggagctgcacttccaagacctaaatcttgtttcacaag

SEQ ID NO: 14506 - DNA, 40 bp, Artificial Sequence
  PCR primer for ORF amplification
caggagctgcacttccctcaactttaatggcagagtatat

SEQ ID NO: 14507 - DNA, 40 bp, Artificial Sequence
  PCR primer for ORF amplification
caggagctgcacttccttctttctgaaccttctcaaaaat

SEQ ID NO: 14508 - DNA, 40 bp, Artificial Sequence
  PCR primer for ORF amplification
caggagctgcacttccatgtagaagagaaggatgaattgg

SEQ ID NO: 14509 - DNA, 40 bp, Artificial Sequence
  PCR primer for ORF amplification
caggagctgcacttcctgacaggtattcgagtgttaatag

SEQ ID NO: 14510 - DNA, 40 bp, Artificial Sequence
  PCR primer for ORF amplification
caggagctgcacttccgaccttcattggatataccattct

SEQ ID NO: 14511 - DNA, 40 bp, Artificial Sequence
  PCR primer for ORF amplification
caggagctgcacttccagatcgctgtagccctcctttatc

SEQ ID NO: 14512 - DNA, 40 bp, Artificial Sequence
  PCR primer for ORF amplification
caggagctgcacttcctgtgtaattaggggtattggatct

SEQ ID NO: 14513 - DNA, 40 bp, Artificial Sequence
  PCR primer for ORF amplification
caggagctgcacttccttttataccagtaaaatagtcatt

SEQ ID NO: 14514 - DNA, 40 bp, Artificial Sequence
  PCR primer for ORF amplification
caggagctgcacttccatcatctttatatccagaagacgc

SEQ ID NO: 14515 - DNA, 40 bp, Artificial Sequence
  PCR primer for ORF amplification
caggagctgcacttcccaacttcagttctaccaattgcag

SEQ ID NO: 14516 - DNA, 40 bp, Artificial Sequence
  PCR primer for ORF amplification
caggagctgcacttccccttgcaaagtttttttcagcatc

SEQ ID NO: 14517 - DNA, 40 bp, Artificial Sequence
  PCR primer for ORF amplification
caggagctgcacttccaagattggtttggtagaatgtctc

SEQ ID NO: 14518 - DNA, 40 bp, Artificial Sequence
  PCR primer for ORF amplification
caggagctgcacttccctctttcttatcctttatgtctaa

SEQ ID NO: 14519 - DNA, 40 bp, Artificial Sequence
  PCR primer for ORF amplification
caggagctgcacttccctgcattatttctcccttcaaaga

SEQ ID NO: 14520 - DNA, 40 bp, Artificial Sequence
  PCR primer for ORF amplification
caggagctgcacttcccaagtaacgaggaactcgcacgtt

SEQ ID NO: 14521 - DNA, 40 bp, Artificial Sequence
  PCR primer for ORF amplification
caggagctgcacttcctattttgcttgaatttttttctcc

SEQ ID NO: 14522 - DNA, 40 bp, Artificial Sequence
  PCR primer for ORF amplification
caggagctgcacttccgactatattcaacttactgtaacc

SEQ ID NO: 14523 - DNA, 40 bp, Artificial Sequence
  PCR primer for ORF amplification
caggagctgcacttccgatattctccttaacatcacacat

SEQ ID NO: 14524 - DNA, 40 bp, Artificial Sequence
  PCR primer for ORF amplification
caggagctgcacttccactaatgcttctcccctgcgaagg

SEQ ID NO: 14525 - DNA, 40 bp, Artificial Sequence
  PCR primer for ORF amplification
caggagctgcacttccacctgacttggtgctctcaactgt

SEQ ID NO: 14526 - DNA, 40 bp, Artificial Sequence
  PCR primer for ORF amplification
caggagctgcacttccaagttcgaaaagttttctgacaac

SEQ ID NO: 14527 - DNA, 40 bp, Artificial Sequence
  PCR primer for ORF amplification
caggagctgcacttcctttgtggaatatttgcttacattt

SEQ ID NO: 14528 - DNA, 40 bp, Artificial Sequence
  PCR primer for ORF amplification
caggagctgcacttccacatttgctttctattgaaggctt

SEQ ID NO: 14529 - DNA, 40 bp, Artificial Sequence
  PCR primer for ORF amplification
caggagctgcacttcctgatacgcctggttcaggcttttg

SEQ ID NO: 14530 - DNA, 40 bp, Artificial Sequence
  PCR primer for ORF amplification
caggagctgcacttccactctcttgtcccgatttctcctg

SEQ ID NO: 14531 - DNA, 40 bp, Artificial Sequence
  PCR primer for ORF amplification
caggagctgcacttcctttgttcaaagtcattaacgaagc

SEQ ID NO: 14532 - DNA, 40 bp, Artificial Sequence
  PCR primer for ORF amplification
caggagctgcacttccaagagagctttcctctaactctct

SEQ ID NO: 14533 - DNA, 40 bp, Artificial Sequence
  PCR primer for ORF amplification
caggagctgcacttccaagggagtgaaaagacgcttcttc

SEQ ID NO: 14534 - DNA, 40 bp, Artificial Sequence
  PCR primer for ORF amplification
caggagctgcacttccttgggtgatggatcgaaaggtgga

SEQ ID NO: 14535 - DNA, 40 bp, Artificial Sequence
  PCR primer for ORF amplification
caggagctgcacttcctcgatttatgccatgaactgaacc

SEQ ID NO: 14536 - DNA, 40 bp, Artificial Sequence
  PCR primer for ORF amplification
caggagctgcacttcctaaataattacctaatttatattt

SEQ ID NO: 14537 - DNA, 40 bp, Artificial Sequence
  PCR primer for ORF amplification
caggagctgcacttccgaaagcttttttcaaaggagaaat

SEQ ID NO: 14538 - DNA, 40 bp, Artificial Sequence
  PCR primer for ORF amplification
caggagctgcacttccggcatatacaattatttcgtcctc

SEQ ID NO: 14539 - DNA, 40 bp, Artificial Sequence
  PCR primer for ORF amplification
caggagctgcacttcctctaatgcttctaccttgcaccat

SEQ ID NO: 14540 - DNA, 40 bp, Artificial Sequence
  PCR primer for ORF amplification
caggagctgcacttccgaaagctcttcccataggagaaag

SEQ ID NO: 14541 - DNA, 40 bp, Artificial Sequence
  PCR primer for ORF amplification
caggagctgcacttccttgatctagctcatcttggccaaa

SEQ ID NO: 14542 - DNA, 40 bp, Artificial Sequence
  PCR primer for ORF amplification
caggagctgcacttccaagcgattcatcttgctgtaggta

SEQ ID NO: 14543 - DNA, 40 bp, Artificial Sequence
  PCR primer for ORF amplification
caggagctgcacttcccaattcgtcgtgttcgaaataatc

SEQ ID NO: 14544 - DNA, 40 bp, Artificial Sequence
  PCR primer for ORF amplification
caggagctgcacttcccaaataatcgtcaatgttggggta

SEQ ID NO: 14545 - DNA, 40 bp, Artificial Sequence
  PCR primer for ORF amplification
caggagctgcacttcctttctttttttgagagaaaaattg

SEQ ID NO: 14546 - DNA, 40 bp, Artificial Sequence
  PCR primer for ORF amplification
caggagctgcacttccgtgagtggagtggcccctgtgata

SEQ ID NO: 14547 - DNA, 40 bp, Artificial Sequence
  PCR primer for ORF amplification
caggagctgcacttccttcggattggttttcgggattttc

SEQ ID NO: 14548 - DNA, 40 bp, Artificial Sequence
  PCR primer for ORF amplification
caggagctgcacttccattagcagcgctaggagcttcagt

SEQ ID NO: 14549 - DNA, 40 bp, Artificial Sequence
  PCR primer for ORF amplification
caggagctgcacttccatttagacttttcaacgtctctct

SEQ ID NO: 14550 - DNA, 40 bp, Artificial Sequence
  PCR primer for ORF amplification
caggagctgcacttccggaacgaatatgcaacccaaagcg

SEQ ID NO: 14551 - DNA, 40 bp, Artificial Sequence
  PCR primer for ORF amplification
caggagctgcacttccagtcatctgaacatccctatcctc

SEQ ID NO: 14552 - DNA, 40 bp, Artificial Sequence
  PCR primer for ORF amplification
caggagctgcacttcctttttttgcgtgctttctcttacg

SEQ ID NO: 14553 - DNA, 40 bp, Artificial Sequence
  PCR primer for ORF amplification
caggagctgcacttccctcggcaattttaacaattttacc

SEQ ID NO: 14554 - DNA, 40 bp, Artificial Sequence
  PCR primer for ORF amplification
caggagctgcacttccttgtaccaaatcactattcatttc

SEQ ID NO: 14555 - DNA, 40 bp, Artificial Sequence
  PCR primer for ORF amplification
caggagctgcacttcctaatgcaaaactttctccgtgaaa

SEQ ID NO: 14556 - DNA, 40 bp, Artificial Sequence
  PCR primer for ORF amplification
caggagctgcacttccctcttcttcactttcgctgctaac

SEQ ID NO: 14557 - DNA, 40 bp, Artificial Sequence
  PCR primer for ORF amplification
caggagctgcacttcctactgctccggtaaacatcaataa

SEQ ID NO: 14558 - DNA, 40 bp, Artificial Sequence
  PCR primer for ORF amplification
caggagctgcacttccccatgtaaaactttcttcttctag

SEQ ID NO: 14559 - DNA, 40 bp, Artificial Sequence
  PCR primer for ORF amplification
caggagctgcacttcctgatttgaaatcgtttattggagt

SEQ ID NO: 14560 - DNA, 40 bp, Artificial Sequence
  PCR primer for ORF amplification
caggagctgcacttccggcaactgccatgtctccaggcga

SEQ ID NO: 14561 - DNA, 40 bp, Artificial Sequence
  PCR primer for ORF amplification
caggagctgcacttcccaccttcttttgctggatgtactc

SEQ ID NO: 14562 - DNA, 40 bp, Artificial Sequence
  PCR primer for ORF amplification
caggagctgcacttcccatagaatcgaaatctgtgtccac

SEQ ID NO: 14563 - DNA, 40 bp, Artificial Sequence
  PCR primer for ORF amplification
caggagctgcacttccgtgcttaccgcctgtacgcttatg

SEQ ID NO: 14564 - DNA, 40 bp, Artificial Sequence
  PCR primer for ORF amplification
caggagctgcacttccaccggacacgctcacgtcgaagta

SEQ ID NO: 14565 - DNA, 40 bp, Artificial Sequence
  PCR primer for ORF amplification
caggagctgcacttcctgtggcattctccgcgccctttga

SEQ ID NO: 14566 - DNA, 40 bp, Artificial Sequence
  PCR primer for ORF amplification
caggagctgcacttccaagtgcctgttcctgtttccattt

SEQ ID NO: 14567 - DNA, 40 bp, Artificial Sequence
  PCR primer for ORF amplification
caggagctgcacttccgaactgaacagaacccatggcttt

SEQ ID NO: 14568 - DNA, 40 bp, Artificial Sequence
  PCR primer for ORF amplification
caggagctgcacttccggttgcatctggaaggtttttatc

SEQ ID NO: 14569 - DNA, 40 bp, Artificial Sequence
  PCR primer for ORF amplification
caggagctgcacttccataagaacgaccgaacatacagta

SEQ ID NO: 14570 - DNA, 40 bp, Artificial Sequence
  PCR primer for ORF amplification
caggagctgcacttccctttctattaaacatatcaaatcc

SEQ ID NO: 14571 - DNA, 40 bp, Artificial Sequence
  PCR primer for ORF amplification
caggagctgcacttccgctactgcaggaagcttgcatcat

SEQ ID NO: 14572 - DNA, 40 bp, Artificial Sequence
  PCR primer for ORF amplification
caggagctgcacttccaaacttgtcatagctggtttcaag

SEQ ID NO: 14573 - DNA, 40 bp, Artificial Sequence
  PCR primer for ORF amplification
caggagctgcacttccacctttattgagagaaattccttc

SEQ ID NO: 14574 - DNA, 40 bp, Artificial Sequence
  PCR primer for ORF amplification
caggagctgcacttccaattaaccttattaatgatgtttt

SEQ ID NO: 14575 - DNA, 40 bp, Artificial Sequence
  PCR primer for ORF amplification
caggagctgcacttccctttataaaagatcttcttttttg

SEQ ID NO: 14576 - DNA, 40 bp, Artificial Sequence
  PCR primer for ORF amplification
caggagctgcacttccatcaattttgtcgtacaatttttg

SEQ ID NO: 14577 - DNA, 40 bp, Artificial Sequence
  PCR primer for ORF amplification
caggagctgcacttccgatatatatctcttcttgtatagt

SEQ ID NO: 14578 - DNA, 40 bp, Artificial Sequence
  PCR primer for ORF amplification
caggagctgcacttccactctgaacctttttagcaattaa

SEQ ID NO: 14579 - DNA, 40 bp, Artificial Sequence
  PCR primer for ORF amplification
caggagctgcacttcctagttcttgctggtcttttagttc

SEQ ID NO: 14580 - DNA, 40 bp, Artificial Sequence
  PCR primer for ORF amplification
caggagctgcacttccatcttctggcttcacatacttcaa

SEQ ID NO: 14581 - DNA, 40 bp, Artificial Sequence
  PCR primer for ORF amplification
caggagctgcacttccagatatagagttcatgatccttgt

SEQ ID NO: 14582 - DNA, 40 bp, Artificial Sequence
  PCR primer for ORF amplification
caggagctgcacttccaagtgtctttctatgctcacccaa

SEQ ID NO: 14583 - DNA, 40 bp, Artificial Sequence
  PCR primer for ORF amplification
caggagctgcacttccttcaatagtatcatttggatcagt

SEQ ID NO: 14584 - DNA, 40 bp, Artificial Sequence
  PCR primer for ORF amplification
caggagctgcacttccatttgttacgttatgttcagtttc

SEQ ID NO: 14585 - DNA, 40 bp, Artificial Sequence
  PCR primer for ORF amplification
caggagctgcacttccccagacatcttcttggtatctacc

SEQ ID NO: 14586 - DNA, 40 bp, Artificial Sequence
  PCR primer for ORF amplification
caggagctgcacttccctggctccacattttaatcgtctg

SEQ ID NO: 14587 - DNA, 40 bp, Artificial Sequence
  PCR primer for ORF amplification
caggagctgcacttccagtcaacttttctggaacagtaat

SEQ ID NO: 14588 - DNA, 40 bp, Artificial Sequence
  PCR primer for ORF amplification
caggagctgcacttccttttcttttcttagcaaggagact

SEQ ID NO: 14589 - DNA, 40 bp, Artificial Sequence
  PCR primer for ORF amplification
caggagctgcacttccatggtcgtccaacgtttcttcatt

SEQ ID NO: 14590 - DNA, 40 bp, Artificial Sequence
  PCR primer for ORF amplification
caggagctgcacttccctccagcttaaacatggcggttgc

SEQ ID NO: 14591 - DNA, 40 bp, Artificial Sequence
  PCR primer for ORF amplification
caggagctgcacttccctgttgagattcgttatcatttgt

SEQ ID NO: 14592 - DNA, 40 bp, Artificial Sequence
  PCR primer for ORF amplification
caggagctgcacttccatcaaggtccatgttttcatcatt

SEQ ID NO: 14593 - DNA, 40 bp, Artificial Sequence
  PCR primer for ORF amplification
caggagctgcacttccgtccatgtcaacatcaccttcagt

SEQ ID NO: 14594 - DNA, 40 bp, Artificial Sequence
  PCR primer for ORF amplification
caggagctgcacttcctagttgggatttgacccaaccttc

SEQ ID NO: 14595 - DNA, 40 bp, Artificial Sequence
  PCR primer for ORF amplification
caggagctgcacttcccaacacgtctccccttcttggtct

SEQ ID NO: 14596 - DNA, 40 bp, Artificial Sequence
  PCR primer for ORF amplification
caggagctgcacttccagtgttttctttataaactctttc

SEQ ID NO: 14597 - DNA, 40 bp, Artificial Sequence
  PCR primer for ORF amplification
caggagctgcacttccccacagcaatgccttaatgatttt

SEQ ID NO: 14598 - DNA, 40 bp, Artificial Sequence
  PCR primer for ORF amplification
caggagctgcacttccccaattctggaattcctccacgta

SEQ ID NO: 14599 - DNA, 40 bp, Artificial Sequence
  PCR primer for ORF amplification
caggagctgcacttcctaacgaagacatgaaattatccaa

SEQ ID NO: 14600 - DNA, 40 bp, Artificial Sequence
  PCR primer for ORF amplification
caggagctgcacttccagaattttctttgtaaaccctttc

SEQ ID NO: 14601 - DNA, 40 bp, Artificial Sequence
  PCR primer for ORF amplification
caggagctgcacttcctttcgcgattgctatgagcttaag

SEQ ID NO: 14602 - DNA, 40 bp, Artificial Sequence
  PCR primer for ORF amplification
caggagctgcacttccggggctgtctggcgtgaagaggca

SEQ ID NO: 14603 - DNA, 40 bp, Artificial Sequence
  PCR primer for ORF amplification
caggagctgcacttcctacttcccgggcaacactattgtc

SEQ ID NO: 14604 - DNA, 40 bp, Artificial Sequence
  PCR primer for ORF amplification
caggagctgcacttccagcccctaagagggctgtgttttc

SEQ ID NO: 14605 - DNA, 40 bp, Artificial Sequence
  PCR primer for ORF amplification
caggagctgcacttcccataattacacagtcttttttttt

SEQ ID NO: 14606 - DNA, 40 bp, Artificial Sequence
  PCR primer for ORF amplification
caggagctgcacttcctaaagctccgtaaataattccgaa

SEQ ID NO: 14607 - DNA, 40 bp, Artificial Sequence
  PCR primer for ORF amplification
caggagctgcacttccccatcttccaccacttcttgttgt

SEQ ID NO: 14608 - DNA, 40 bp, Artificial Sequence
  PCR primer for ORF amplification
caggagctgcacttccagaccttttgggcacaatttgacg

SEQ ID NO: 14609 - DNA, 40 bp, Artificial Sequence
  PCR primer for ORF amplification
caggagctgcacttccgcacttttcttggatttctattaa

SEQ ID NO: 14610 - DNA, 40 bp, Artificial Sequence
  PCR primer for ORF amplification
caggagctgcacttcctccaataaagctaacacttgttct

SEQ ID NO: 14611 - DNA, 40 bp, Artificial Sequence
  PCR primer for ORF amplification
caggagctgcacttccaatgaaagctagaggaagagcggc

SEQ ID NO: 14612 - DNA, 40 bp, Artificial Sequence
  PCR primer for ORF amplification
caggagctgcacttccggaaaatctgtagacaatcttgga

SEQ ID NO: 14613 - DNA, 40 bp, Artificial Sequence
  PCR primer for ORF amplification
caggagctgcacttccagtaggagtatctggcacttggac

SEQ ID NO: 14614 - DNA, 40 bp, Artificial Sequence
  PCR primer for ORF amplification
caggagctgcacttcctccatctagttgtggatcaatgtc

SEQ ID NO: 14615 - DNA, 40 bp, Artificial Sequence
  PCR primer for ORF amplification
caggagctgcacttcccgttcgctgatgcaggccgccaat

SEQ ID NO: 14616 - DNA, 40 bp, Artificial Sequence; identical to SEQ ID NO: 14364
  PCR primer for ORF amplification

SEQ ID NO: 14617 - DNA, 40 bp, Artificial Sequence
  PCR primer for ORF amplification
caggagctgcacttcccaagtgcactgtcaataaatcatt

SEQ ID NO: 14618 - DNA, 40 bp, Artificial Sequence
  PCR primer for ORF amplification
caggagctgcacttccagacgaactataaacggcgtcaac

SEQ ID NO: 14619 - DNA, 40 bp, Artificial Sequence
  PCR primer for ORF amplification
caggagctgcacttcccgaaaagggccgtttcatagagag

SEQ ID NO: 14620 - DNA, 40 bp, Artificial Sequence
  PCR primer for ORF amplification
caggagctgcacttccatcttgatttttttttttctccat

SEQ ID NO: 14621 - DNA, 40 bp, Artificial Sequence
  PCR primer for ORF amplification
caggagctgcacttcctaatatgttaccatatataatcct

SEQ ID NO: 14622 - DNA, 40 bp, Artificial Sequence
  PCR primer for ORF amplification
caggagctgcacttcctgtgatattcagatgtttgatacc

SEQ ID NO: 14623 - DNA, 40 bp, Artificial Sequence
  PCR primer for ORF amplification
caggagctgcacttcctaaatcgaaatgatattgtttata

SEQ ID NO: 14624 - DNA, 40 bp, Artificial Sequence
  PCR primer for ORF amplification
caggagctgcacttccatttagttccacgtccttattagt

SEQ ID NO: 14625 - DNA, 40 bp, Artificial Sequence
  PCR primer for ORF amplification
caggagctgcacttcctttacctttataaacaaattggga

SEQ ID NO: 14626 - DNA, 40 bp, Artificial Sequence
  PCR primer for ORF amplification
caggagctgcacttccttcacttaaattgaacttaggggg

SEQ ID NO: 14627 - DNA, 40 bp, Artificial Sequence
  PCR primer for ORF amplification
caggagctgcacttcccatatacagatattcacagttcga

SEQ ID NO: 14628 - DNA, 40 bp, Artificial Sequence
  PCR primer for ORF amplification
caggagctgcacttccaatgtctccatgttttttatgagt

SEQ ID NO: 14629 - DNA, 40 bp, Artificial Sequence
  PCR primer for ORF amplification
caggagctgcacttccaatttccctggattcccaccagtc

SEQ ID NO: 14630 - DNA, 40 bp, Artificial Sequence
  PCR primer for ORF amplification
caggagctgcacttccccattctaaggttaataacttctt

SEQ ID NO: 14631 - DNA, 40 bp, Artificial Sequence
  PCR primer for ORF amplification
caggagctgcacttccaacagaggagacgatttgactagc

SEQ ID NO: 14632 - DNA, 40 bp, Artificial Sequence
  PCR primer for ORF amplification
caggagctgcacttcctatttgaaatctgagattttcaat

SEQ ID NO: 14633 - DNA, 40 bp, Artificial Sequence
  PCR primer for ORF amplification
caggagctgcacttccttcttttaaggcaagcaccaaagc

SEQ ID NO: 14634 - DNA, 40 bp, Artificial Sequence
  PCR primer for ORF amplification
caggagctgcacttcctctggaaaagaagtcctcaaaatt

SEQ ID NO: 14635 - DNA, 40 bp, Artificial Sequence
  PCR primer for ORF amplification
caggagctgcacttcctgaatcatttcctagtaatccttt

SEQ ID NO: 14636 - DNA, 40 bp, Artificial Sequence
  PCR primer for ORF amplification
caggagctgcacttccactagcaatcaagtcaactctagc

SEQ ID NO: 14637 - DNA, 40 bp, Artificial Sequence
  PCR primer for ORF amplification
caggagctgcacttccatcaacttcttccatctcggtgtc

SEQ ID NO: 14638 - DNA, 40 bp, Artificial Sequence
  PCR primer for ORF amplification
caggagctgcacttccactgtcatcagcatatgggccatc

SEQ ID NO: 14639 - DNA, 40 bp, Artificial Sequence
  PCR primer for ORF amplification
caggagctgcacttccatctacggtaacaattgtggactt

SEQ ID NO: 14640 - DNA, 40 bp, Artificial Sequence
  PCR primer for ORF amplification
caggagctgcacttcccaggttgactttctggtggtatat

SEQ ID NO: 14641 - DNA, 40 bp, Artificial Sequence
  PCR primer for ORF amplification
caggagctgcacttcctttatcgttatccacgacagggtg

SEQ ID NO: 14642 - DNA, 40 bp, Artificial Sequence
  PCR primer for ORF amplification
caggagctgcacttccaattagtccaaataatgctgttat

SEQ ID NO: 14643 - DNA, 40 bp, Artificial Sequence
  PCR primer for ORF amplification
caggagctgcacttcctatacgtctgaaaacgctcttaca

SEQ ID NO: 14644 - DNA, 40 bp, Artificial Sequence
  PCR primer for ORF amplification
caggagctgcacttccttcttcatcactccattcttcaaa

SEQ ID NO: 14645 - DNA, 40 bp, Artificial Sequence
  PCR primer for ORF amplification
caggagctgcacttccgttgaagttgatgagcctcgttct

SEQ ID NO: 14646 - DNA, 40 bp, Artificial Sequence
  PCR primer for ORF amplification
caggagctgcacttcctctttttatggtcgacgaggagcc

SEQ ID NO: 14647 - DNA, 40 bp, Artificial Sequence
  PCR primer for ORF amplification
caggagctgcacttcctctcatttttccttgcatttctac

SEQ ID NO: 14648 - DNA, 40 bp, Artificial Sequence
  PCR primer for ORF amplification
caggagctgcacttcccataccacggaacgcatttttgct

SEQ ID NO: 14649 - DNA, 40 bp, Artificial Sequence
  PCR primer for ORF amplification
caggagctgcacttccggcagatgggtcttcttcgaatct

SEQ ID NO: 14650 - DNA, 40 bp, Artificial Sequence
  PCR primer for ORF amplification
caggagctgcacttccataattaggacacaattgatcagt

SEQ ID NO: 14651 - DNA, 40 bp, Artificial Sequence
  PCR primer for ORF amplification
caggagctgcacttcctttctttgcaccatacttgttgac

SEQ ID NO: 14652 - DNA, 40 bp, Artificial Sequence
  PCR primer for ORF amplification
caggagctgcacttccgaggtcaagggcccataaataaat

SEQ ID NO: 14653 - DNA, 40 bp, Artificial Sequence
  PCR primer for ORF amplification
caggagctgcacttccgtctctttttacctttttcacaat

SEQ ID NO: 14654 - DNA, 40 bp, Artificial Sequence
  PCR primer for ORF amplification
caggagctgcacttccattatcctcgtagtatgcagacgt

SEQ ID NO: 14655 - DNA, 40 bp, Artificial Sequence
  PCR primer for ORF amplification
caggagctgcacttcctttacgaataatttcatccaattg

SEQ ID NO: 14656 - DNA, 40 bp, Artificial Sequence
  PCR primer for ORF amplification
caggagctgcacttcccctttgattagttttcattggcga

SEQ ID NO: 14657 - DNA, 40 bp, Artificial Sequence
  PCR primer for ORF amplification
caggagctgcacttccatctacctcttccatttcggtgtc

SEQ ID NO: 14658 - DNA, 40 bp, Artificial Sequence
  PCR primer for ORF amplification
caggagctgcacttccgaaattagtcacgttgtggaaaat

SEQ ID NO: 14659 - DNA, 40 bp, Artificial Sequence
  PCR primer for ORF amplification
caggagctgcacttccttggaagttttctagaacctgttc

SEQ ID NO: 14660 - DNA, 40 bp, Artificial Sequence
  PCR primer for ORF amplification
caggagctgcacttccagcgtctgacatttcaacatcttc

SEQ ID NO: 14661 - DNA, 40 bp, Artificial Sequence
  PCR primer for ORF amplification
caggagctgcacttccgcgattggctaatttacgttcttg

SEQ ID NO: 14662 - DNA, 40 bp, Artificial Sequence
  PCR primer for ORF amplification
caggagctgcacttcctaattctctatcaaggaaagattg

SEQ ID NO: 14663 - DNA, 40 bp, Artificial Sequence
  PCR primer for ORF amplification
caggagctgcacttccccagcattgatactcttcaaagta

SEQ ID NO: 14664 - DNA, 40 bp, Artificial Sequence
  PCR primer for ORF amplification
caggagctgcacttccccaactttggtattcttcaaagta

SEQ ID NO: 14665 - DNA, 40 bp, Artificial Sequence
  PCR primer for ORF amplification
caggagctgcacttccccaacactgatattcctcgaaata

SEQ ID NO: 14666 - DNA, 40 bp, Artificial Sequence
  PCR primer for ORF amplification
caggagctgcacttccgttctgtaagcccagctccttcaa

SEQ ID NO: 14667 - DNA, 40 bp, Artificial Sequence
  PCR primer for ORF amplification
caggagctgcacttcccaattctatttgagtgggcgagag

SEQ ID NO: 14668 - DNA, 40 bp, Artificial Sequence
  PCR primer for ORF amplification
caggagctgcacttccttcctcttctgaggaagattcttc

SEQ ID NO: 14669 - DNA, 40 bp, Artificial Sequence
  PCR primer for ORF amplification
caggagctgcacttccgtaatctaaactataagctttgtt

SEQ ID NO: 14670 - DNA, 40 bp, Artificial Sequence
  PCR primer for ORF amplification
caggagctgcacttccatttggcgctatttttttatactt

SEQ ID NO: 14671 - DNA, 40 bp, Artificial Sequence
  PCR primer for ORF amplification
caggagctgcacttccaatgtccaagtattccatggtgta

SEQ ID NO: 14672 - DNA, 40 bp, Artificial Sequence
  PCR primer for ORF amplification
caggagctgcacttccgacaccgaatatactctggtaaga

SEQ ID NO: 14673 - DNA, 40 bp, Artificial Sequence
  PCR primer for ORF amplification
caggagctgcacttccttgagttttagtagtaaattcctg

SEQ ID NO: 14674 - DNA, 40 bp, Artificial Sequence
  PCR primer for ORF amplification
caggagctgcacttcccaacttgaccgaatcaattagatg

SEQ ID NO: 14675 - DNA, 40 bp, Artificial Sequence
  PCR primer for ORF amplification
caggagctgcacttcctaaaggcatgtctgttgttctgtt

SEQ ID NO: 14676 - DNA, 40 bp, Artificial Sequence
  PCR primer for ORF amplification
caggagctgcacttcctagaccttttctggcattacgcct

SEQ ID NO: 14677 - DNA, 40 bp, Artificial Sequence
  PCR primer for ORF amplification
caggagctgcacttccattttttgaattttgccttttcaa

SEQ ID NO: 14678 - DNA, 40 bp, Artificial Sequence
  PCR primer for ORF amplification
caggagctgcacttccatcaatagacataatgtcaagcgt

SEQ ID NO: 14679 - DNA, 40 bp, Artificial Sequence
  PCR primer for ORF amplification
caggagctgcacttcctacggcccaaatatttacgtcccc

SEQ ID NO: 14680 - DNA, 40 bp, Artificial Sequence
  PCR primer for ORF amplification
caggagctgcacttcctctactaaaggacccttctacttt

SEQ ID NO: 14681 - DNA, 40 bp, Artificial Sequence
  PCR primer for ORF amplification
caggagctgcacttcccttcaattctgcaatgggtaccat

SEQ ID NO: 14682 - DNA, 40 bp, Artificial Sequence
  PCR primer for ORF amplification
caggagctgcacttccaccagtctttctttttacatatat

SEQ ID NO: 14683 - DNA, 40 bp, Artificial Sequence
  PCR primer for ORF amplification
caggagctgcacttccggagagatcgtcgaaaatatcctt

SEQ ID NO: 14684 - DNA, 40 bp, Artificial Sequence
  PCR primer for ORF amplification
caggagctgcacttccaattatgtgtgcatccagccatgg

SEQ ID NO: 14685 - DNA, 40 bp, Artificial Sequence
  PCR primer for ORF amplification
caggagctgcacttccttcgacggtaacagatttagccaa

SEQ ID NO: 14686 - DNA, 40 bp, Artificial Sequence
  PCR primer for ORF amplification
caggagctgcacttccacagaattcttcttcatagttctc

SEQ ID NO: 14687 - DNA, 40 bp, Artificial Sequence
  PCR primer for ORF amplification
caggagctgcacttccgactctcaagcctaattcaggtct

SEQ ID NO: 14688 - DNA, 40 bp, Artificial Sequence
  PCR primer for ORF amplification
caggagctgcacttccccaacgtattgaactattaaaacc

SEQ ID NO: 14689 - DNA, 40 bp, Artificial Sequence
  PCR primer for ORF amplification
caggagctgcacttcctattccagcaaggctctcttgcaa

SEQ ID NO: 14690 - DNA, 40 bp, Artificial Sequence
  PCR primer for ORF amplification
caggagctgcacttccccaggcttggtattcctccaagta

SEQ ID NO: 14691 - DNA, 40 bp, Artificial Sequence
  PCR primer for ORF amplification
caggagctgcacttcctttaaaaacctttttaaatcctga

SEQ ID NO: 14692 - DNA, 40 bp, Artificial Sequence
  PCR primer for ORF amplification
caggagctgcacttcctagttcaggtatgatgtctttaaa

SEQ ID NO: 14693 - DNA, 40 bp, Artificial Sequence
  PCR primer for ORF amplification
caggagctgcacttccagaggataacttgaacttcgagct

SEQ ID NO: 14694 - DNA, 40 bp, Artificial Sequence
  PCR primer for ORF amplification
caggagctgcacttcctttcatttcttttttagcatcttc

SEQ ID NO: 14695 - DNA, 40 bp, Artificial Sequence
  PCR primer for ORF amplification
caggagctgcacttcctttagcaactaggttgcagaaaaa

SEQ ID NO: 14696 - DNA, 40 bp, Artificial Sequence
  PCR primer for ORF amplification
caggagctgcacttcctttaaattcataaatttccttttg

SEQ ID NO: 14697 - DNA, 40 bp, Artificial Sequence
  PCR primer for ORF amplification
caggagctgcacttcctttatggccactggtactactatt

SEQ ID NO: 14698 - DNA, 40 bp, Artificial Sequence
  PCR primer for ORF amplification
caggagctgcacttccaccctcattttcatttgactcttc

SEQ ID NO: 14699 - DNA, 40 bp, Artificial Sequence
  PCR primer for ORF amplification
caggagctgcacttcctttcaaagtttctaaacgtttata

SEQ ID NO: 14700 - DNA, 40 bp, Artificial Sequence
  PCR primer for ORF amplification
caggagctgcacttccatttgctataggctgtagcggtaa

SEQ ID NO: 14701 - DNA, 40 bp, Artificial Sequence
  PCR primer for ORF amplification
caggagctgcacttcctgtggaatcatatattaggcagca

SEQ ID NO: 14702 - DNA, 40 bp, Artificial Sequence
  PCR primer for ORF amplification
caggagctgcacttcctttatcatggtgagattttctttt

SEQ ID NO: 14703 - DNA, 40 bp, Artificial Sequence
  PCR primer for ORF amplification
caggagctgcacttccattatcgaaagtgtcattcgtgaa

SEQ ID NO: 14704 - DNA, 40 bp, Artificial Sequence
  PCR primer for ORF amplification
caggagctgcacttccactgaaaattacattgcaagcaac

SEQ ID NO: 14705 - DNA, 40 bp, Artificial Sequence
  PCR primer for ORF amplification
caggagctgcacttccatagtgagggacatttaagcagat

SEQ ID NO: 14706 - DNA, 40 bp, Artificial Sequence
  PCR primer for ORF amplification
caggagctgcacttccgctaaacagttctagaagtatatt

SEQ ID NO: 14707 - DNA, 40 bp, Artificial Sequence
  PCR primer for ORF amplification
caggagctgcacttcccaatgaatggtcaacgcggtcaat

SEQ ID NO: 14708 - DNA, 40 bp, Artificial Sequence
  PCR primer for ORF amplification
caggagctgcacttccgaataaatcgaggagatcctgtga

SEQ ID NO: 14709 - DNA, 40 bp, Artificial Sequence
  PCR primer for ORF amplification
caggagctgcacttccgttcgaaagggttgctgtgcgagc

SEQ ID NO: 14710 - DNA, 40 bp, Artificial Sequence
  PCR primer for ORF amplification
caggagctgcacttccatctgatgttaaatcgaccacttc

SEQ ID NO: 14711 - DNA, 40 bp, Artificial Sequence
  PCR primer for ORF amplification
caggagctgcacttccttttggtatcacatcatcggagta

SEQ ID NO: 14712 - DNA, 40 bp, Artificial Sequence
  PCR primer for ORF amplification
caggagctgcacttcctctatctaacttaacaccaacttg

SEQ ID NO: 14713 - DNA, 40 bp, Artificial Sequence
  PCR primer for ORF amplification
caggagctgcacttccacggctgctttttttcttgaacag

SEQ ID NO: 14714 - DNA, 40 bp, Artificial Sequence
  PCR primer for ORF amplification
caggagctgcacttccttttctactaaccaatctggtaga

SEQ ID NO: 14715 - DNA, 40 bp, Artificial Sequence
  PCR primer for ORF amplification
caggagctgcacttccaaaatcagtcatctcaaaagattc

SEQ ID NO: 14716 - DNA, 40 bp, Artificial Sequence
  PCR primer for ORF amplification
caggagctgcacttccacataagtcataactagagaaact

SEQ ID NO: 14717 - DNA, 40 bp, Artificial Sequence
  PCR primer for ORF amplification
caggagctgcacttcctattttgccgaataagaacaatga

SEQ ID NO: 14718 - DNA, 40 bp, Artificial Sequence
  PCR primer for ORF amplification
caggagctgcacttcctataccaaattttaaccaatccaa

SEQ ID NO: 14719 - DNA, 40 bp, Artificial Sequence
  PCR primer for ORF amplification
caggagctgcacttccaagcgtatgtgtttcatatgccct

SEQ ID NO: 14720 - DNA, 40 bp, Artificial Sequence
  PCR primer for ORF amplification
caggagctgcacttccaacacacgttggcttcaaattatg

SEQ ID NO: 14721 - DNA, 40 bp, Artificial Sequence
  PCR primer for ORF amplification
caggagctgcacttccttgacctcttaattctggttgaat

SEQ ID NO: 14722 - DNA, 40 bp, Artificial Sequence
  PCR primer for ORF amplification
caggagctgcacttccagcaagcgcgttttcaactctatc

SEQ ID NO: 14723 - DNA, 40 bp, Artificial Sequence
  PCR primer for ORF amplification
caggagctgcacttccatcatccagcatatccatcaactc

SEQ ID NO: 14724 - DNA, 40 bp, Artificial Sequence
  PCR primer for ORF amplification
caggagctgcacttcctgagtatgaatatgaattaattcc

SEQ ID NO: 14725 - DNA, 40 bp, Artificial Sequence
  PCR primer for ORF amplification
caggagctgcacttccccttttaaatgacagattcttacc

SEQ ID NO: 14726 - DNA, 40 bp, Artificial Sequence
  PCR primer for ORF amplification
caggagctgcacttccagaattttgaacgctatactttga

SEQ ID NO: 14727 - DNA, 40 bp, Artificial Sequence
  PCR primer for ORF amplification
caggagctgcacttcctttatagcggtcttgctttattct

SEQ ID NO: 14728 - DNA, 40 bp, Artificial Sequence
  PCR primer for ORF amplification
caggagctgcacttcctcgtttgttaccctttgatagaaa

SEQ ID NO: 14729 - DNA, 40 bp, Artificial Sequence
  PCR primer for ORF amplification
caggagctgcacttcctgatgatgttgaaggtggaggaga

SEQ ID NO: 14730 - DNA, 40 bp, Artificial Sequence
  PCR primer for ORF amplification
caggagctgcacttccagctaagacgttgtcacctctctt

SEQ ID NO: 14731 - DNA, 40 bp, Artificial Sequence
  PCR primer for ORF amplification
caggagctgcacttccgttgacggtataattatgtgaaga

SEQ ID NO: 14732 - DNA, 40 bp, Artificial Sequence
  PCR primer for ORF amplification
caggagctgcacttccttttgaatcagaaactttttgctt

SEQ ID NO: 14733 - DNA, 40 bp, Artificial Sequence
  PCR primer for ORF amplification
caggagctgcacttccaattatttcatcaacttgtccgaa

SEQ ID NO: 14734 - DNA, 40 bp, Artificial Sequence
  PCR primer for ORF amplification
caggagctgcacttccctctttctttaattccatgtggtc

SEQ ID NO: 14735 - DNA, 40 bp, Artificial Sequence
  PCR primer for ORF amplification
caggagctgcacttcctttcggaccttgtttcatgtactt

SEQ ID NO: 14736 - DNA, 40 bp, Artificial Sequence
  PCR primer for ORF amplification
caggagctgcacttccaacacattcttgaagaacgctaat

SEQ ID NO: 14737 - DNA, 40 bp, Artificial Sequence
  PCR primer for ORF amplification
caggagctgcacttcctgtacgcaatcttcttctcgaaga

SEQ ID NO: 14738 - DNA, 40 bp, Artificial Sequence
  PCR primer for ORF amplification
caggagctgcacttcctccttgggtattattataagttgc

SEQ ID NO: 14739 - DNA, 40 bp, Artificial Sequence
  PCR primer for ORF amplification
caggagctgcacttccaccttctttagaaaggttcatatc

SEQ ID NO: 14740 - DNA, 40 bp, Artificial Sequence
  PCR primer for ORF amplification
caggagctgcacttccgtagaaacctcttgaatttttaga

SEQ ID NO: 14741 - DNA, 40 bp, Artificial Sequence
  PCR primer for ORF amplification
caggagctgcacttccgtgttttctacccttcttcttgct

SEQ ID NO: 14742 - DNA, 40 bp, Artificial Sequence
  PCR primer for ORF amplification
caggagctgcacttcctaaattcgtaaggtcgttagttct

SEQ ID NO: 14743 - DNA, 40 bp, Artificial Sequence
  PCR primer for ORF amplification
caggagctgcacttccttcccacaggttattccaagtcac

SEQ ID NO: 14744 - DNA, 40 bp, Artificial Sequence
  PCR primer for ORF amplification
caggagctgcacttccgtagttaaactcacttgctatttg

SEQ ID NO: 14745 - DNA, 40 bp, Artificial Sequence
  PCR primer for ORF amplification
caggagctgcacttccggtatcagaatcgactaaatcgtc

SEQ ID NO: 14746 - DNA, 40 bp, Artificial Sequence
  PCR primer for ORF amplification
caggagctgcacttccatgtcttttatgatcgcggacttc

SEQ ID NO: 14747 - DNA, 40 bp, Artificial Sequence
  PCR primer for ORF amplification
caggagctgcacttcctgattcagcgtttaattcatagtg

SEQ ID NO: 14748 - DNA, 40 bp, Artificial Sequence
  PCR primer for ORF amplification
caggagctgcacttcctacaagtttatcaacccaagagac

SEQ ID NO: 14749 - DNA, 40 bp, Artificial Sequence
  PCR primer for ORF amplification
caggagctgcacttccttctttcttttcgtgttctctttt

SEQ ID NO: 14750 - DNA, 40 bp, Artificial Sequence
  PCR primer for ORF amplification
caggagctgcacttcccatgaacgcttgacataatttgaa

SEQ ID NO: 14751 - DNA, 40 bp, Artificial Sequence
  PCR primer for ORF amplification
caggagctgcacttccggaaaggtaatggtaataagaggg

SEQ ID NO: 14752 - DNA, 40 bp, Artificial Sequence
  PCR primer for ORF amplification
caggagctgcacttccaagcttttctgtcttgactagtga

SEQ ID NO: 14753 - DNA, 40 bp, Artificial Sequence
  PCR primer for ORF amplification
caggagctgcacttcccatatttctcagttgccttacttt

SEQ ID NO: 14754 - DNA, 40 bp, Artificial Sequence
  PCR primer for ORF amplification
caggagctgcacttccatttcttgaaattttccagatttt

SEQ ID NO: 14755 - DNA, 40 bp, Artificial Sequence
  PCR primer for ORF amplification
caggagctgcacttccaggttgtactgtgtgatctaggtc

SEQ ID NO: 14756 - DNA, 40 bp, Artificial Sequence
  PCR primer for ORF amplification
caggagctgcacttcctttaacggaatttttgctcctttg

SEQ ID NO: 14757 - DNA, 40 bp, Artificial Sequence
  PCR primer for ORF amplification
caggagctgcacttcctgcatcgtagcatccaatggtgca

SEQ ID NO: 14758 - DNA, 40 bp, Artificial Sequence
  PCR primer for ORF amplification
caggagctgcacttcctgcatttaacattgtaggaatttt

SEQ ID NO: 14759 - DNA, 40 bp, Artificial Sequence
  PCR primer for ORF amplification
caggagctgcacttcccagtcccattgagatatataatga

SEQ ID NO: 14760 - DNA, 40 bp, Artificial Sequence
  PCR primer for ORF amplification
caggagctgcacttccgcttttcctaaaactaaacattct

SEQ ID NO: 14761 - DNA, 40 bp, Artificial Sequence
  PCR primer for ORF amplification
caggagctgcacttccctggcatgcaattctgccaactgc

SEQ ID NO: 14762 - DNA, 40 bp, Artificial Sequence
  PCR primer for ORF amplification
caggagctgcacttcctccgctgttaaggattagcttcag

SEQ ID NO: 14763 - DNA, 40 bp, Artificial Sequence
  PCR primer for ORF amplification
caggagctgcacttcccttgtttattttcgataaaatttc

SEQ ID NO: 14764 - DNA, 40 bp, Artificial Sequence
  PCR primer for ORF amplification
caggagctgcacttccctttttatcgtttctcagacatat

SEQ ID NO: 14765 - DNA, 40 bp, Artificial Sequence
  PCR primer for ORF amplification
caggagctgcacttccgtttggacgtaatacttctccttc

SEQ ID NO: 14766 - DNA, 40 bp, Artificial Sequence
  PCR primer for ORF amplification
caggagctgcacttcctagtgggcttgtttctcttttcag

SEQ ID NO: 14767 - DNA, 40 bp, Artificial Sequence
  PCR primer for ORF amplification
caggagctgcacttcctttggcttgtcgctgttcccacag

SEQ ID NO: 14768 - DNA, 40 bp, Artificial Sequence
  PCR primer for ORF amplification
caggagctgcacttccattttgaaaaatgtctgaattgtt

SEQ ID NO: 14769 - DNA, 40 bp, Artificial Sequence
  PCR primer for ORF amplification
caggagctgcacttcctgctaccaaatgtgcattattgtt

SEQ ID NO: 14770 - DNA, 40 bp, Artificial Sequence
  PCR primer for ORF amplification
caggagctgcacttccaagtaccaggattctaccggttag

SEQ ID NO: 14771 - DNA, 40 bp, Artificial Sequence
  PCR primer for ORF amplification
caggagctgcacttccacaaggtaacgcgttctttatctg

SEQ ID NO: 14772 - DNA, 40 bp, Artificial Sequence
  PCR primer for ORF amplification
caggagctgcacttcctagtccatagaggtttctttcttg

SEQ ID NO: 14773 - DNA, 40 bp, Artificial Sequence
  PCR primer for ORF amplification
caggagctgcacttcctttcagtagtttttttctgtaatc

SEQ ID NO: 14774 - DNA, 40 bp, Artificial Sequence
  PCR primer for ORF amplification
caggagctgcacttcccacttgttgaccaccatatttggc

SEQ ID NO: 14775 - DNA, 40 bp, Artificial Sequence
  PCR primer for ORF amplification
caggagctgcacttccatgctttttaaccacacctgcagc

SEQ ID NO: 14776 - DNA, 40 bp, Artificial Sequence
  PCR primer for ORF amplification
caggagctgcacttcccctacggcttttgaagcccttctt

SEQ ID NO: 14777 - DNA, 40 bp, Artificial Sequence
  PCR primer for ORF amplification
caggagctgcacttcctttcatatcttgggtagatgaacc

SEQ ID NO: 14778 - DNA, 40 bp, Artificial Sequence
  PCR primer for ORF amplification
caggagctgcacttcctgtgttacgtatatcttcaacaat

SEQ ID NO: 14779 - DNA, 40 bp, Artificial Sequence
  PCR primer for ORF amplification
caggagctgcacttccccaaccgtttgaagtgtaatcaat

SEQ ID NO: 14780 - DNA, 40 bp, Artificial Sequence
  PCR primer for ORF amplification
caggagctgcacttccatgactccggtggtcgtgattgta

SEQ ID NO: 14781 - DNA, 40 bp, Artificial Sequence
  PCR primer for ORF amplification
caggagctgcacttccgcgaattttatcactgttcttttt

SEQ ID NO: 14782 - DNA, 40 bp, Artificial Sequence
  PCR primer for ORF amplification
caggagctgcacttccgtctgattcctctgacatctctag

SEQ ID NO: 14783 - DNA, 40 bp, Artificial Sequence
  PCR primer for ORF amplification
caggagctgcacttcccactagacttgaattaaataaagt

SEQ ID NO: 14784 - DNA, 40 bp, Artificial Sequence
  PCR primer for ORF amplification
caggagctgcacttcctgacgctgcctgtgttgtcgctag

SEQ ID NO: 14785 - DNA, 40 bp, Artificial Sequence
  PCR primer for ORF amplification
caggagctgcacttcctttgatgaagctcaatattctcga

SEQ ID NO: 14786 - DNA, 40 bp, Artificial Sequence
  PCR primer for ORF amplification
caggagctgcacttccatcatctagagcagtgcctctaat

SEQ ID NO: 14787 - DNA, 40 bp, Artificial Sequence
  PCR primer for ORF amplification
caggagctgcacttccggaaccattactaccgaatttact

SEQ ID NO: 14788 - DNA, 40 bp, Artificial Sequence
  PCR primer for ORF amplification
caggagctgcacttccattttgcatgtgggattggttttc

SEQ ID NO: 14789 - DNA, 40 bp, Artificial Sequence
  PCR primer for ORF amplification
caggagctgcacttccgtcttcaaaatacttcgtattccc

SEQ ID NO: 14790 - DNA, 40 bp, Artificial Sequence
  PCR primer for ORF amplification
caggagctgcacttcccaacgcattttttcttgtcaaata

SEQ ID NO: 14791 - DNA, 40 bp, Artificial Sequence
  PCR primer for ORF amplification
caggagctgcacttccctgtatctcgctgtcacaatcatt

SEQ ID NO: 14792 - DNA, 40 bp, Artificial Sequence
  PCR primer for ORF amplification
caggagctgcacttcccagaatattactaataagggttgc

SEQ ID NO: 14793 - DNA, 40 bp, Artificial Sequence
  PCR primer for ORF amplification
caggagctgcacttccatttactgttgggtcagagctgaa

SEQ ID NO: 14794 - DNA, 40 bp, Artificial Sequence
  PCR primer for ORF amplification
caggagctgcacttccaattttcataccgacaggaagagt

SEQ ID NO: 14795 - DNA, 40 bp, Artificial Sequence
  PCR primer for ORF amplification
caggagctgcacttcccaacggaggtaatggtgacctaca

SEQ ID NO: 14796 - DNA, 40 bp, Artificial Sequence
  PCR primer for ORF amplification
caggagctgcacttccgctatccattagatcaggagaaaa

SEQ ID NO: 14797 - DNA, 40 bp, Artificial Sequence
  PCR primer for ORF amplification
caggagctgcacttccttcttgcatatgacatttttgtaa

SEQ ID NO: 14798 - DNA, 40 bp, Artificial Sequence
  PCR primer for ORF amplification
caggagctgcacttccgtgttttattgactgaaattcacc

SEQ ID NO: 14799 - DNA, 40 bp, Artificial Sequence
  PCR primer for ORF amplification
caggagctgcacttcctgcggattgggtcatcaactcaac

SEQ ID NO: 14800 - DNA, 40 bp, Artificial Sequence
  PCR primer for ORF amplification
caggagctgcacttccgagtttttgaggtgtgcccacccc

SEQ ID NO: 14801 - DNA, 40 bp, Artificial Sequence
  PCR primer for ORF amplification
caggagctgcacttccaggtgcgatatcccaagtagataa

SEQ ID NO: 14802 - DNA, 40 bp, Artificial Sequence
  PCR primer for ORF amplification
caggagctgcacttccaaccttgtaggtctctaagtgagc

SEQ ID NO: 14803 - DNA, 40 bp, Artificial Sequence
  PCR primer for ORF amplification
caggagctgcacttcccgcatctccttctttcccttcttc

SEQ ID NO: 14804 - DNA, 40 bp, Artificial Sequence
  PCR primer for ORF amplification
caggagctgcacttccttgctgttcctgggcatcatcgaa

SEQ ID NO: 14805 - DNA, 40 bp, Artificial Sequence
  PCR primer for ORF amplification
caggagctgcacttccttcaatagtgctactgctatcact

SEQ ID NO: 14806 - DNA, 40 bp, Artificial Sequence
  PCR primer for ORF amplification
caggagctgcacttcctgcttcttgcttgtcggcaatgtc

SEQ ID NO: 14807 - DNA, 40 bp, Artificial Sequence
  PCR primer for ORF amplification
caggagctgcacttcctttaattagccattgggatttcaa

SEQ ID NO: 14808 - DNA, 40 bp, Artificial Sequence
  PCR primer for ORF amplification
caggagctgcacttcctttataaagttttagtaaatctcc

SEQ ID NO: 14809 - DNA, 40 bp, Artificial Sequence
  PCR primer for ORF amplification
caggagctgcacttcctctcaatttgcttctgattttaga

SEQ ID NO: 14810 - DNA, 40 bp, Artificial Sequence
  PCR primer for ORF amplification
caggagctgcacttccccaattcgtatcccaggagtctga

SEQ ID NO: 14811 - DNA, 40 bp, Artificial Sequence
  PCR primer for ORF amplification
caggagctgcacttcctttcttcgcttgcttcttttggaa

SEQ ID NO: 14812 - DNA, 40 bp, Artificial Sequence
  PCR primer for ORF amplification
caggagctgcacttccatttgttgctgcaggtgcctcagg

SEQ ID NO: 14813 - DNA, 40 bp, Artificial Sequence
  PCR primer for ORF amplification
caggagctgcacttcctgggttgttcaactttccacggta

SEQ ID NO: 14814 - DNA, 40 bp, Artificial Sequence
  PCR primer for ORF amplification
caggagctgcacttcccacttggtgaacttctaaaaaaac

SEQ ID NO: 14815 - DNA, 40 bp, Artificial Sequence
  PCR primer for ORF amplification
caggagctgcacttcccttggagaaatttaattctatgtc

SEQ ID NO: 14816 - DNA, 40 bp, Artificial Sequence
  PCR primer for ORF amplification
caggagctgcacttccgctttgttcgtgtctagaattttc

SEQ ID NO: 14817 - DNA, 40 bp, Artificial Sequence
  PCR primer for ORF amplification
caggagctgcacttccttcgaccttttcctttgtttcttc

SEQ ID NO: 14818 - DNA, 40 bp, Artificial Sequence
  PCR primer for ORF amplification
caggagctgcacttcctttttgcccgtaagaataaagaac

SEQ ID NO: 14819 - DNA, 40 bp, Artificial Sequence
  PCR primer for ORF amplification
caggagctgcacttccttggggggaagtgtattggctgtg

SEQ ID NO: 14820 - DNA, 40 bp, Artificial Sequence
  PCR primer for ORF amplification
caggagctgcacttccttcttcttcttcctcctcctcttc

SEQ ID NO: 14821 - DNA, 40 bp, Artificial Sequence
  PCR primer for ORF amplification
caggagctgcacttccagaatctaattcctttgtctgatt

SEQ ID NO: 14822 - DNA, 40 bp, Artificial Sequence
  PCR primer for ORF amplification
caggagctgcacttccgctgataacgcattccgctggtaa

SEQ ID NO: 14823 - DNA, 40 bp, Artificial Sequence
  PCR primer for ORF amplification
caggagctgcacttcctaatttttcctcatcctgcacaca

SEQ ID NO: 14824 - DNA, 40 bp, Artificial Sequence
  PCR primer for ORF amplification
caggagctgcacttcctaccatatcatttccttgttcaac

SEQ ID NO: 14825 - DNA, 40 bp, Artificial Sequence
  PCR primer for ORF amplification
caggagctgcacttccaattttgtaatctgcaaatttcct

SEQ ID NO: 14826 - DNA, 40 bp, Artificial Sequence
  PCR primer for ORF amplification
caggagctgcacttccgtctgccagaggtttgatagtgga

SEQ ID NO: 14827 - DNA, 40 bp, Artificial Sequence
  PCR primer for ORF amplification
caggagctgcacttcccatcttaacctttttgagtgccgg

SEQ ID NO: 14828 - DNA, 40 bp, Artificial Sequence
  PCR primer for ORF amplification
caggagctgcacttcctagtgtatctttctccttattggg

SEQ ID NO: 14829 - DNA, 40 bp, Artificial Sequence
  PCR primer for ORF amplification
caggagctgcacttcctttttcatctgtccgtgtcatgtt

SEQ ID NO: 14830 - DNA, 40 bp, Artificial Sequence
  PCR primer for ORF amplification
caggagctgcacttcctttgtcttcaccaaagtactcttc

SEQ ID NO: 14831 - DNA, 40 bp, Artificial Sequence
  PCR primer for ORF amplification
caggagctgcacttccactttcactgtgtcttaaacccga

SEQ ID NO: 14832 - DNA, 40 bp, Artificial Sequence
  PCR primer for ORF amplification
caggagctgcacttccataccccttcttcttttgtttggt

SEQ ID NO: 14833 - DNA, 40 bp, Artificial Sequence
  PCR primer for ORF amplification
caggagctgcacttcctttcttggagtgcttactcttctt

SEQ ID NO: 14834 - DNA, 40 bp, Artificial Sequence
  PCR primer for ORF amplification
caggagctgcacttccattcttgtattgttcacggaagta

SEQ ID NO: 14835 - DNA, 40 bp, Artificial Sequence
  PCR primer for ORF amplification
caggagctgcacttcctgcctgaccagagacggctacttg

SEQ ID NO: 14836 - DNA, 40 bp, Artificial Sequence
  PCR primer for ORF amplification
caggagctgcacttccagatagtgacaaacaattttgact

SEQ ID NO: 14837 - DNA, 40 bp, Artificial Sequence
  PCR primer for ORF amplification
caggagctgcacttccaaacctccaattttcatctaccga

SEQ ID NO: 14838 - DNA, 40 bp, Artificial Sequence
  PCR primer for ORF amplification
caggagctgcacttccacacctctcaaaaactttgtatag

SEQ ID NO: 14839 - DNA, 40 bp, Artificial Sequence
  PCR primer for ORF amplification
caggagctgcacttccgagagcatcagtttcgtttgaaag

SEQ ID NO: 14840 - DNA, 40 bp, Artificial Sequence
  PCR primer for ORF amplification
caggagctgcacttccaccctggattaatttagctgtcaa

SEQ ID NO: 14841 - DNA, 40 bp, Artificial Sequence
  PCR primer for ORF amplification
caggagctgcacttcccagtttgggctctcgctgttcttc

SEQ ID NO: 14842 - DNA, 40 bp, Artificial Sequence
  PCR primer for ORF amplification
caggagctgcacttccctggtcgtcttcatcactttcaac

SEQ ID NO: 14843 - DNA, 40 bp, Artificial Sequence
  PCR primer for ORF amplification
caggagctgcacttccggataatgagaattttgaactact

SEQ ID NO: 14844 - DNA, 40 bp, Artificial Sequence
  PCR primer for ORF amplification
caggagctgcacttccagacttgtgagactgtgctataaa

SEQ ID NO: 14845 - DNA, 40 bp, Artificial Sequence
  PCR primer for ORF amplification
caggagctgcacttccagtagtttgttcagtcttcttatc

SEQ ID NO: 14846 - DNA, 40 bp, Artificial Sequence
  PCR primer for ORF amplification
caggagctgcacttccattatttctctttttctttttctt

SEQ ID NO: 14847 - DNA, 40 bp, Artificial Sequence
  PCR primer for ORF amplification
caggagctgcacttcccggttgtggtgtgatcttaattgg

SEQ ID NO: 14848 - DNA, 40 bp, Artificial Sequence
  PCR primer for ORF amplification
caggagctgcacttcccatgatggcacaacgctgagattt

SEQ ID NO: 14849 - DNA, 40 bp, Artificial Sequence
  PCR primer for ORF amplification
caggagctgcacttcctacaccacttctgtaaatattctg

SEQ ID NO: 14850 - DNA, 40 bp, Artificial Sequence
  PCR primer for ORF amplification
caggagctgcacttccaaacactaactttggttgaataaa

SEQ ID NO: 14851 - DNA, 40 bp, Artificial Sequence
  PCR primer for ORF amplification
caggagctgcacttcctttttctttttgctcgttttttga

SEQ ID NO: 14852 - DNA, 40 bp, Artificial Sequence
  PCR primer for ORF amplification
caggagctgcacttccctgcatttctatatcttcatcttc

SEQ ID NO: 14853 - DNA, 40 bp, Artificial Sequence
  PCR primer for ORF amplification
caggagctgcacttcctttcttctcatcggccttaatttt

SEQ ID NO: 14854 - DNA, 40 bp, Artificial Sequence
  PCR primer for ORF amplification
caggagctgcacttcctataacgttaccatttcgattagt

SEQ ID NO: 14855 - DNA, 40 bp, Artificial Sequence
  PCR primer for ORF amplification
caggagctgcacttccacatagcggtgtgaccaaattacc

SEQ ID NO: 14856 - DNA, 40 bp, Artificial Sequence
  PCR primer for ORF amplification
caggagctgcacttcctggtattatagttgtcctcgttag

SEQ ID NO: 14857 - DNA, 40 bp, Artificial Sequence
  PCR primer for ORF amplification
caggagctgcacttccccaatcctggtggactttatcgaa

SEQ ID NO: 14858 - DNA, 40 bp, Artificial Sequence
  PCR primer for ORF amplification
caggagctgcacttccgtctttataatttttctggttagg

SEQ ID NO: 14859 - DNA, 40 bp, Artificial Sequence
  PCR primer for ORF amplification
caggagctgcacttccagaaaaagcacctgaataagctaa

SEQ ID NO: 14860 - DNA, 40 bp, Artificial Sequence
  PCR primer for ORF amplification
caggagctgcacttcccgaagatgaaccgcttcttagagc

SEQ ID NO: 14861 - DNA, 40 bp, Artificial Sequence
  PCR primer for ORF amplification
caggagctgcacttcctaggtaatacaattttttctcaga

SEQ ID NO: 14862 - DNA, 40 bp, Artificial Sequence
  PCR primer for ORF amplification
caggagctgcacttccgtagtccatagaataatcaccact

SEQ ID NO: 14863 - DNA, 40 bp, Artificial Sequence
  PCR primer for ORF amplification
caggagctgcacttccgcatcttgtatagaaataaatata

SEQ ID NO: 14864 - DNA, 40 bp, Artificial Sequence
  PCR primer for ORF amplification
caggagctgcacttccgccataaaaatcttggagggaagc

SEQ ID NO: 14865 - DNA, 40 bp, Artificial Sequence
  PCR primer for ORF amplification
caggagctgcacttccatccaacatcggaccctctaattc

SEQ ID NO: 14866 - DNA, 40 bp, Artificial Sequence
  PCR primer for ORF amplification
caggagctgcacttccagtggaggagaaaattttacctct

SEQ ID NO: 14867 - DNA, 40 bp, Artificial Sequence
  PCR primer for ORF amplification
caggagctgcacttcccaaatatgggttgttgttgcgggc

SEQ ID NO: 14868 - DNA, 40 bp, Artificial Sequence
  PCR primer for ORF amplification
caggagctgcacttccaaattcgttcgtgtttattccatg

SEQ ID NO: 14869 - DNA, 40 bp, Artificial Sequence
  PCR primer for ORF amplification
caggagctgcacttcctttttcttgtttttttgtatcatc

SEQ ID NO: 14870 - DNA, 40 bp, Artificial Sequence
  PCR primer for ORF amplification
caggagctgcacttcctccgaaaacttttttgaagatcga

SEQ ID NO: 14871 - DNA, 40 bp, Artificial Sequence
  PCR primer for ORF amplification
caggagctgcacttccttttagcctgtcaagcagtgaatc

SEQ ID NO: 14872 - DNA, 40 bp, Artificial Sequence
  PCR primer for ORF amplification
caggagctgcacttcctgtagaagggacatcgttgacgtt

SEQ ID NO: 14873 - DNA, 40 bp, Artificial Sequence
  PCR primer for ORF amplification
caggagctgcacttccctgcgtatcaaataaatatttata

SEQ ID NO: 14874 - DNA, 40 bp, Artificial Sequence
  PCR primer for ORF amplification
caggagctgcacttcccatgaaaatttgtaagttgctctc

SEQ ID NO: 14875 - DNA, 40 bp, Artificial Sequence
  PCR primer for ORF amplification
caggagctgcacttccagtgcgctgccttttaactctacc

SEQ ID NO: 14876 - DNA, 40 bp, Artificial Sequence
  PCR primer for ORF amplification
caggagctgcacttccttctgggtctgaatcagggtttgc

SEQ ID NO: 14877 - DNA, 40 bp, Artificial Sequence
  PCR primer for ORF amplification
caggagctgcacttccagtaaaccccggcccaaaatatgc

SEQ ID NO: 14878 - DNA, 40 bp, Artificial Sequence
  PCR primer for ORF amplification
caggagctgcacttcccataccattccaaggtaacgaagg

SEQ ID NO: 14879 - DNA, 40 bp, Artificial Sequence
  PCR primer for ORF amplification
caggagctgcacttccttcatatgctaatgagtatatacg

SEQ ID NO: 14880 - DNA, 40 bp, Artificial Sequence
  PCR primer for ORF amplification
caggagctgcacttccgactttaattttagcaaggataac

SEQ ID NO: 14881 - DNA, 40 bp, Artificial Sequence
  PCR primer for ORF amplification
caggagctgcacttccttcgtttcttcgtatattaccaat

SEQ ID NO: 14882 - DNA, 40 bp, Artificial Sequence
  PCR primer for ORF amplification
caggagctgcacttccagaaaagaaatatttaaacaacgc

SEQ ID NO: 14883 - DNA, 40 bp, Artificial Sequence
  PCR primer for ORF amplification
caggagctgcacttccgttattgaataagaactgtaaatc

SEQ ID NO: 14884 - DNA, 40 bp, Artificial Sequence
  PCR primer for ORF amplification
caggagctgcacttccttgattattttgctttttcttttt

SEQ ID NO: 14885 - DNA, 40 bp, Artificial Sequence
  PCR primer for ORF amplification
caggagctgcacttccccatgttaaaacgtcttgttcttc

SEQ ID NO: 14886 - DNA, 40 bp, Artificial Sequence
  PCR primer for ORF amplification
caggagctgcacttcctttgttctttgaaaagcctgagtg

SEQ ID NO: 14887 - DNA, 40 bp, Artificial Sequence
  PCR primer for ORF amplification
caggagctgcacttccctccggagagttggcgcttactga

SEQ ID NO: 14888 - DNA, 40 bp, Artificial Sequence; identical to SEQ ID NO: 14304
  PCR primer for ORF amplification

SEQ ID NO: 14889 - DNA, 40 bp, Artificial Sequence
  PCR primer for ORF amplification
caggagctgcacttcctttggtgaacttcctttttttatt

SEQ ID NO: 14890 - DNA, 40 bp, Artificial Sequence
  PCR primer for ORF amplification
caggagctgcacttcccaaataatcaggatccaggatgtt

SEQ ID NO: 14891 - DNA, 40 bp, Artificial Sequence
  PCR primer for ORF amplification
caggagctgcacttccaagtcgccatcgatcaacctcttg

SEQ ID NO: 14892 - DNA, 40 bp, Artificial Sequence
  PCR primer for ORF amplification
caggagctgcacttccctctccgaggttttctttagtaat

SEQ ID NO: 14893 - DNA, 40 bp, Artificial Sequence
  PCR primer for ORF amplification
caggagctgcacttccaaatccttcaggaacaccttttgc

SEQ ID NO: 14894 - DNA, 40 bp, Artificial Sequence
  PCR primer for ORF amplification
caggagctgcacttccgtttaaaggtgtactctgttgatt

SEQ ID NO: 14895 - DNA, 40 bp, Artificial Sequence
  PCR primer for ORF amplification
caggagctgcacttcctggtttactgtccatatggagccg

SEQ ID NO: 14896 - DNA, 40 bp, Artificial Sequence
  PCR primer for ORF amplification
caggagctgcacttcctacaataaataagttgatgatggg

SEQ ID NO: 14897 - DNA, 40 bp, Artificial Sequence
  PCR primer for ORF amplification
caggagctgcacttcctaaatttcttacacttttttggat

SEQ ID NO: 14898 - DNA, 40 bp, Artificial Sequence
  PCR primer for ORF amplification
caggagctgcacttccctttagttctgatatttcaccatc

SEQ ID NO: 14899 - DNA, 40 bp, Artificial Sequence
  PCR primer for ORF amplification
caggagctgcacttcccgcaattatgagtcgccactcccc

SEQ ID NO: 14900 - DNA, 40 bp, Artificial Sequence
  PCR primer for ORF amplification
caggagctgcacttcctatcctgctcatagtttcatttgc

SEQ ID NO: 14901 - DNA, 40 bp, Artificial Sequence
  PCR primer for ORF amplification
caggagctgcacttcctggcctgaaagcacctcctgcaag

SEQ ID NO: 14902 - DNA, 40 bp, Artificial Sequence
  PCR primer for ORF amplification
caggagctgcacttccccaccatttatcataaccaaatgt

SEQ ID NO: 14903 - DNA, 40 bp, Artificial Sequence
  PCR primer for ORF amplification
caggagctgcacttccgccttcccaattaataaaattgaa

SEQ ID NO: 14904 - DNA, 40 bp, Artificial Sequence
  PCR primer for ORF amplification
caggagctgcacttcccctttgttgtggctgtgtatgcat

SEQ ID NO: 14905 - DNA, 40 bp, Artificial Sequence
  PCR primer for ORF amplification
caggagctgcacttccctggaaatcctttgggatcaaccc

SEQ ID NO: 14906 - DNA, 40 bp, Artificial Sequence
  PCR primer for ORF amplification
caggagctgcacttccaaccctcatgctccttcttttgaa

SEQ ID NO: 14907 - DNA, 40 bp, Artificial Sequence
  PCR primer for ORF amplification
caggagctgcacttccgatatggaacttgttactcctttc

SEQ ID NO: 14908 - DNA, 40 bp, Artificial Sequence
  PCR primer for ORF amplification
caggagctgcacttccctcctcctcctttttattctcttc

SEQ ID NO: 14909 - DNA, 40 bp, Artificial Sequence
  PCR primer for ORF amplification
caggagctgcacttcctttcgttatggtatcaatatcacc

SEQ ID NO: 14910 - DNA, 40 bp, Artificial Sequence
  PCR primer for ORF amplification
caggagctgcacttcccataaatccttcatcgaagaatcc

SEQ ID NO: 14911 - DNA, 40 bp, Artificial Sequence
  PCR primer for ORF amplification
caggagctgcacttccgtaaagcttagttccgttttcaat

SEQ ID NO: 14912 - DNA, 40 bp, Artificial Sequence
  PCR primer for ORF amplification
caggagctgcacttcctttttgtagttttgctaaactatc

SEQ ID NO: 14913 - DNA, 40 bp, Artificial Sequence
  PCR primer for ORF amplification
caggagctgcacttcctgaagcatgcttttttaaaaaatc

SEQ ID NO: 14914 - DNA, 40 bp, Artificial Sequence
  PCR primer for ORF amplification
caggagctgcacttcctatcaaagatccatatacattact

SEQ ID NO: 14915 - DNA, 40 bp, Artificial Sequence
  PCR primer for ORF amplification
caggagctgcacttccttttatttggctaaaaatttcaat

SEQ ID NO: 14916 - DNA, 40 bp, Artificial Sequence
  PCR primer for ORF amplification
caggagctgcacttcctttcctggcagtggccagtagact

SEQ ID NO: 14917 - DNA, 40 bp, Artificial Sequence
  PCR primer for ORF amplification
caggagctgcacttccaaaaattctttcgtaaaataaaac

SEQ ID NO: 14918 - DNA, 40 bp, Artificial Sequence
  PCR primer for ORF amplification
caggagctgcacttccttgcttttcgaattctaatacaaa

SEQ ID NO: 14919 - DNA, 40 bp, Artificial Sequence
  PCR primer for ORF amplification
caggagctgcacttccttcttcgacaatgtgaagtttatt

SEQ ID NO: 14920 - DNA, 40 bp, Artificial Sequence
  PCR primer for ORF amplification
caggagctgcacttccggtggtccataagcgagccgtatt

SEQ ID NO: 14921 - DNA, 40 bp, Artificial Sequence
  PCR primer for ORF amplification
caggagctgcacttcctgcttttaaactgtagtatctata

SEQ ID NO: 14922 - DNA, 40 bp, Artificial Sequence
  PCR primer for ORF amplification
caggagctgcacttcctgtgtacttcatattaacctcagc

SEQ ID NO: 14923 - DNA, 40 bp, Artificial Sequence
  PCR primer for ORF amplification
caggagctgcacttcctttatacccgatgtcattagtctc

SEQ ID NO: 14924 - DNA, 40 bp, Artificial Sequence
  PCR primer for ORF amplification
caggagctgcacttccttcttgaccaaaccctatggtttc

SEQ ID NO: 14925 - DNA, 40 bp, Artificial Sequence
  PCR primer for ORF amplification
caggagctgcacttccgtttacatctttaccagaaatatc

SEQ ID NO: 14926 - DNA, 40 bp, Artificial Sequence
  PCR primer for ORF amplification
caggagctgcacttccaagctccagatgcgaagaagacgt

SEQ ID NO: 14927 - DNA, 40 bp, Artificial Sequence
  PCR primer for ORF amplification
caggagctgcacttcccttggaagttgcgtccttcaagct

SEQ ID NO: 14928 - DNA, 40 bp, Artificial Sequence
  PCR primer for ORF amplification
caggagctgcacttccattgtctttgtaatcatcgaaaag

SEQ ID NO: 14929 - DNA, 40 bp, Artificial Sequence
  PCR primer for ORF amplification
caggagctgcacttccaactttgctgggaaacctttttct

SEQ ID NO: 14930 - DNA, 40 bp, Artificial Sequence
  PCR primer for ORF amplification
caggagctgcacttccattttctgttttcattgaaatatt

SEQ ID NO: 14931 - DNA, 40 bp, Artificial Sequence
  PCR primer for ORF amplification
caggagctgcacttcccttttcttcaatggttctcttgaa

SEQ ID NO: 14932 - DNA, 40 bp, Artificial Sequence
  PCR primer for ORF amplification
caggagctgcacttccagcaggaataggagggagaggcgt

SEQ ID NO: 14933 - DNA, 40 bp, Artificial Sequence
  PCR primer for ORF amplification
caggagctgcacttcctttctttccgccacgtagttttct

SEQ ID NO: 14934 - DNA, 40 bp, Artificial Sequence
  PCR primer for ORF amplification
caggagctgcacttccttgaagtaaatagcgaacgttgct

SEQ ID NO: 14935 - DNA, 40 bp, Artificial Sequence
  PCR primer for ORF amplification
caggagctgcacttccaacttttaggccattgacgaattt

SEQ ID NO: 14936 - DNA, 40 bp, Artificial Sequence
  PCR primer for ORF amplification
caggagctgcacttccactaggattcagtggcaggactga

SEQ ID NO: 14937 - DNA, 40 bp, Artificial Sequence
  PCR primer for ORF amplification
caggagctgcacttcccttttcagcttcctcttcaacaac

SEQ ID NO: 14938 - DNA, 40 bp, Artificial Sequence
  PCR primer for ORF amplification
caggagctgcacttccgttggttggtgggaactggaagtg

SEQ ID NO: 14939 - DNA, 40 bp, Artificial Sequence
  PCR primer for ORF amplification
caggagctgcacttccacgacgatttgatggtgggttaag

SEQ ID NO: 14940 - DNA, 40 bp, Artificial Sequence
  PCR primer for ORF amplification
caggagctgcacttcccgatcgtccggaagatggaggaac

SEQ ID NO: 14941 - DNA, 40 bp, Artificial Sequence
  PCR primer for ORF amplification
caggagctgcacttcccataaaagctgaaaagtttgtagt

SEQ ID NO: 14942 - DNA, 40 bp, Artificial Sequence
  PCR primer for ORF amplification
caggagctgcacttccattactgatctgagacttttgtgt

SEQ ID NO: 14943 - DNA, 40 bp, Artificial Sequence
  PCR primer for ORF amplification
caggagctgcacttccagcaaggtaagcatacgattcacc

SEQ ID NO: 14944 - DNA, 40 bp, Artificial Sequence
  PCR primer for ORF amplification
caggagctgcacttccggcatacatgacgtcttcctcagt

SEQ ID NO: 14945 - DNA, 40 bp, Artificial Sequence
  PCR primer for ORF amplification
caggagctgcacttcctgtacgtcgaacatcattaatcaa

SEQ ID NO: 14946 - DNA, 40 bp, Artificial Sequence
  PCR primer for ORF amplification
caggagctgcacttcccagttttttcttacctattgatgc

SEQ ID NO: 14947 - DNA, 40 bp, Artificial Sequence
  PCR primer for ORF amplification
caggagctgcacttccgtaattgcaataccttagggagcg

SEQ ID NO: 14948 - DNA, 40 bp, Artificial Sequence
  PCR primer for ORF amplification
caggagctgcacttccgaatagcttatccatttccactag

SEQ ID NO: 14949 - DNA, 40 bp, Artificial Sequence
  PCR primer for ORF amplification
caggagctgcacttcccgtaaataatgttaagtccaatgg

SEQ ID NO: 14950 - DNA, 40 bp, Artificial Sequence
  PCR primer for ORF amplification
caggagctgcacttccttccaaaacagcccttttttctac

SEQ ID NO: 14951 - DNA, 40 bp, Artificial Sequence
  PCR primer for ORF amplification
caggagctgcacttcctttgacaaattgcccatcgaaagc

SEQ ID NO: 14952 - DNA, 40 bp, Artificial Sequence
  PCR primer for ORF amplification
caggagctgcacttccctgggttattctattggaatctag

SEQ ID NO: 14953 - DNA, 40 bp, Artificial Sequence
  PCR primer for ORF amplification
caggagctgcacttcctcttgagataaaggcgctcacgga

SEQ ID NO: 14954 - DNA, 40 bp, Artificial Sequence
  PCR primer for ORF amplification
caggagctgcacttccatttaagtcggaatgatgatcaac

SEQ ID NO: 14955 - DNA, 40 bp, Artificial Sequence
  PCR primer for ORF amplification
caggagctgcacttcctataaaaaattttggcttaggtcc

SEQ ID NO: 14956 - DNA, 40 bp, Artificial Sequence
  PCR primer for ORF amplification
caggagctgcacttcccaagtcgtgaagtattgattgtag

SEQ ID NO: 14957 - DNA, 40 bp, Artificial Sequence
  PCR primer for ORF amplification
caggagctgcacttccttttttttcattttctaacaactt

SEQ ID NO: 14958 - DNA, 40 bp, Artificial Sequence
  PCR primer for ORF amplification
caggagctgcacttcccgaaaattgcaaattctcggggcc

SEQ ID NO: 14959 - DNA, 40 bp, Artificial Sequence
  PCR primer for ORF amplification
caggagctgcacttccagtgcctctgttaaagaaccttga

SEQ ID NO: 14960 - DNA, 40 bp, Artificial Sequence
  PCR primer for ORF amplification
caggagctgcacttcctttactgggagagactagttcttc

SEQ ID NO: 14961 - DNA, 40 bp, Artificial Sequence
  PCR primer for ORF amplification
caggagctgcacttcccagcatttctgggatgcgtccgtg

SEQ ID NO: 14962 - DNA, 40 bp, Artificial Sequence
  PCR primer for ORF amplification
caggagctgcacttcctctttgggaagaagcagatgctga

SEQ ID NO: 14963 - DNA, 40 bp, Artificial Sequence
  PCR primer for ORF amplification
caggagctgcacttcctatttcgaatcttccactgacaaa

SEQ ID NO: 14964 - DNA, 40 bp, Artificial Sequence
  PCR primer for ORF amplification
caggagctgcacttccttccaaacctttataaatagcatc

SEQ ID NO: 14965 - DNA, 40 bp, Artificial Sequence
  PCR primer for ORF amplification
caggagctgcacttcctgccgaccaatacctgtaaaattg

SEQ ID NO: 14966 - DNA, 40 bp, Artificial Sequence
  PCR primer for ORF amplification
caggagctgcacttccttttctgccattttgatatttatg

SEQ ID NO: 14967 - DNA, 40 bp, Artificial Sequence
  PCR primer for ORF amplification
caggagctgcacttcctttctttgatttattttttttttt

SEQ ID NO: 14968 - DNA, 40 bp, Artificial Sequence
  PCR primer for ORF amplification
caggagctgcacttccgtttgtagatggcttaggctcatt

SEQ ID NO: 14969 - DNA, 40 bp, Artificial Sequence
  PCR primer for ORF amplification
caggagctgcacttcccagaggcagggaaaaggctctgcc

SEQ ID NO: 14970 - DNA, 40 bp, Artificial Sequence
  PCR primer for ORF amplification
caggagctgcacttccaaaatttaaatatacactgccaac

SEQ ID NO: 14971 - DNA, 40 bp, Artificial Sequence
  PCR primer for ORF amplification
caggagctgcacttcctctcttgttgttatcaaattttct

SEQ ID NO: 14972 - DNA, 40 bp, Artificial Sequence
  PCR primer for ORF amplification
caggagctgcacttcctaacaggtccttctcaaaaaatct

SEQ ID NO: 14973 - DNA, 40 bp, Artificial Sequence
  PCR primer for ORF amplification
caggagctgcacttccaacgtgactttggctgcgattcat

SEQ ID NO: 14974 - DNA, 40 bp, Artificial Sequence
  PCR primer for ORF amplification
caggagctgcacttccatcactgcttggccccattaactt

SEQ ID NO: 14975 - DNA, 40 bp, Artificial Sequence
  PCR primer for ORF amplification
caggagctgcacttccacctgcattacaataatgaacaag

SEQ ID NO: 14976 - DNA, 40 bp, Artificial Sequence
  PCR primer for ORF amplification
caggagctgcacttccgaaggtcgagttcaaaatattctg

SEQ ID NO: 14977 - DNA, 40 bp, Artificial Sequence
  PCR primer for ORF amplification
caggagctgcacttccatcaagagcgcaaaggagggccaa

SEQ ID NO: 14978 - DNA, 40 bp, Artificial Sequence
  PCR primer for ORF amplification
caggagctgcacttccgaggttgggaacttccagggtctg

SEQ ID NO: 14979 - DNA, 40 bp, Artificial Sequence
  PCR primer for ORF amplification
caggagctgcacttccctttttcctttttccaaagaaact

SEQ ID NO: 14980 - DNA, 40 bp, Artificial Sequence
  PCR primer for ORF amplification
caggagctgcacttccgctagatagagctgttgtagtaaa

SEQ ID NO: 14981 - DNA, 40 bp, Artificial Sequence
  PCR primer for ORF amplification
caggagctgcacttccttcttcgtcatcctctattagagt

SEQ ID NO: 14982 - DNA, 40 bp, Artificial Sequence
  PCR primer for ORF amplification
caggagctgcacttcctgatgaatttttctgggttataga

SEQ ID NO: 14983 - DNA, 40 bp, Artificial Sequence
  PCR primer for ORF amplification
caggagctgcacttcccaaagaaggcatatcgctcagatt

SEQ ID NO: 14984 - DNA, 40 bp, Artificial Sequence
  PCR primer for ORF amplification
caggagctgcacttcctagagtttcatcgaatttgtgatc

SEQ ID NO: 14985 - DNA, 40 bp, Artificial Sequence
  PCR primer for ORF amplification
caggagctgcacttcctttcttagctcgtttgggcaggcg

SEQ ID NO: 14986 - DNA, 40 bp, Artificial Sequence
  PCR primer for ORF amplification
caggagctgcacttcctatggcgaatatctgaacattgaa

SEQ ID NO: 14987 - DNA, 40 bp, Artificial Sequence
  PCR primer for ORF amplification
caggagctgcacttccgaagcgtccaaggatgttgacaac

SEQ ID NO: 14988 - DNA, 40 bp, Artificial Sequence
  PCR primer for ORF amplification
caggagctgcacttcctgcatgactattcgcgtttgagat

SEQ ID NO: 14989 - DNA, 40 bp, Artificial Sequence
  PCR primer for ORF amplification
caggagctgcacttccgcggaagttattaactactgtacc

SEQ ID NO: 14990 - DNA, 40 bp, Artificial Sequence
  PCR primer for ORF amplification
caggagctgcacttcctataccaggtcctatatttttaaa

SEQ ID NO: 14991 - DNA, 40 bp, Artificial Sequence
  PCR primer for ORF amplification
caggagctgcacttccttccccaaccaaattgaagataaa

SEQ ID NO: 14992 - DNA, 40 bp, Artificial Sequence
  PCR primer for ORF amplification
caggagctgcacttccactatacaaatcatcatcttcctc

SEQ ID NO: 14993 - DNA, 40 bp, Artificial Sequence
  PCR primer for ORF amplification
caggagctgcacttcctttttttttcattgctcttctttt

SEQ ID NO: 14994 - DNA, 40 bp, Artificial Sequence
  PCR primer for ORF amplification
caggagctgcacttcctacactaatttttccctgtttcaa

SEQ ID NO: 14995 - DNA, 40 bp, Artificial Sequence
  PCR primer for ORF amplification
caggagctgcacttcctactttcttactgcctgtgtttgt

SEQ ID NO: 14996 - DNA, 40 bp, Artificial Sequence
  PCR primer for ORF amplification
caggagctgcacttccttgtttcatttcttccgcatcctt

SEQ ID NO: 14997 - DNA, 40 bp, Artificial Sequence
  PCR primer for ORF amplification
caggagctgcacttcctgagcgatcccgttttgtgaacat

SEQ ID NO: 14998 - DNA, 40 bp, Artificial Sequence
  PCR primer for ORF amplification
caggagctgcacttccgtcttcatcaggaatgtagagatg

SEQ ID NO: 14999 - DNA, 40 bp, Artificial Sequence
  PCR primer for ORF amplification
caggagctgcacttccatttttcttgtgtttcttaagttt

SEQ ID NO: 15000 - DNA, 40 bp, Artificial Sequence
  PCR primer for ORF amplification
caggagctgcacttcctagagagacgtctatattaattaa

SEQ ID NO: 15001 - DNA, 40 bp, Artificial Sequence
  PCR primer for ORF amplification
caggagctgcacttccgtgatcaatacctatcaacatgtc

SEQ ID NO: 15002 - DNA, 40 bp, Artificial Sequence
  PCR primer for ORF amplification
caggagctgcacttcctttatataacgaccaacaacccag

SEQ ID NO: 15003 - DNA, 40 bp, Artificial Sequence
  PCR primer for ORF amplification
caggagctgcacttccttccagttccatatctgcgtcaaa

SEQ ID NO: 15004 - DNA, 40 bp, Artificial Sequence
  PCR primer for ORF amplification
caggagctgcacttcccataatgcagcaatctcgtatgcc

SEQ ID NO: 15005 - DNA, 40 bp, Artificial Sequence
  PCR primer for ORF amplification
caggagctgcacttccgcttgaagcggaagagcttgcact

SEQ ID NO: 15006 - DNA, 40 bp, Artificial Sequence
  PCR primer for ORF amplification
caggagctgcacttccatgaaataattcgtgaactaattc

SEQ ID NO: 15007 - DNA, 40 bp, Artificial Sequence
  PCR primer for ORF amplification
caggagctgcacttccctttttcttgtgatgcttctttgc

SEQ ID NO: 15008 - DNA, 40 bp, Artificial Sequence
  PCR primer for ORF amplification
caggagctgcacttcccaatttgtcgtaatattcttgcca

SEQ ID NO: 15009 - DNA, 40 bp, Artificial Sequence
  PCR primer for ORF amplification
caggagctgcacttccgtacttgtaagttgctgttgattc

SEQ ID NO: 15010 - DNA, 40 bp, Artificial Sequence
  PCR primer for ORF amplification
caggagctgcacttccttccttccactccaacagtgatgt

SEQ ID NO: 15011 - DNA, 40 bp, Artificial Sequence
  PCR primer for ORF amplification
caggagctgcacttcccttcttcaaattcttataatacat

SEQ ID NO: 15012 - DNA, 40 bp, Artificial Sequence
  PCR primer for ORF amplification
caggagctgcacttccaaagttactcaggttagggaaaat

SEQ ID NO: 15013 - DNA, 40 bp, Artificial Sequence
  PCR primer for ORF amplification
caggagctgcacttccttttttctcttgattactaattgc

SEQ ID NO: 15014 - DNA, 40 bp, Artificial Sequence
  PCR primer for ORF amplification
caggagctgcacttccactgctgtatttggagtacatatt

SEQ ID NO: 15015 - DNA, 40 bp, Artificial Sequence
  PCR primer for ORF amplification
caggagctgcacttccagcgtcttgtagatcgatatcaga

SEQ ID NO: 15016 - DNA, 40 bp, Artificial Sequence
  PCR primer for ORF amplification
caggagctgcacttccacggagcgatttgctcaataagaa

SEQ ID NO: 15017 - DNA, 40 bp, Artificial Sequence
  PCR primer for ORF amplification
caggagctgcacttccaaatctttttcctttctttttacc

SEQ ID NO: 15018 - DNA, 40 bp, Artificial Sequence
  PCR primer for ORF amplification
caggagctgcacttccgtatttagtactcttcaaagacaa

SEQ ID NO: 15019 - DNA, 40 bp, Artificial Sequence
  PCR primer for ORF amplification
caggagctgcacttcctttctttttgattatgtgccctcc

SEQ ID NO: 15020 - DNA, 40 bp, Artificial Sequence
  PCR primer for ORF amplification
caggagctgcacttcctgcagtaatctgtccatcatcatc

SEQ ID NO: 15021 - DNA, 40 bp, Artificial Sequence
  PCR primer for ORF amplification
caggagctgcacttcctactcgtattcctctatcgtcttc

SEQ ID NO: 15022 - DNA, 40 bp, Artificial Sequence
  PCR primer for ORF amplification
caggagctgcacttcccttagataggtttttaatttcttc

SEQ ID NO: 15023 - DNA, 40 bp, Artificial Sequence
  PCR primer for ORF amplification
caggagctgcacttccgttgctattatcaaaataaaaaga

SEQ ID NO: 15024 - DNA, 40 bp, Artificial Sequence
  PCR primer for ORF amplification
caggagctgcacttcccagattcgtggcagttggggcagg

SEQ ID NO: 15025 - DNA, 40 bp, Artificial Sequence
  PCR primer for ORF amplification
caggagctgcacttccaaacttcttgtagtaatgcgccca

SEQ ID NO: 15026 - DNA, 40 bp, Artificial Sequence
  PCR primer for ORF amplification
caggagctgcacttccaatcagccaggtaaccaacttctt

SEQ ID NO: 15027 - DNA, 40 bp, Artificial Sequence
  PCR primer for ORF amplification
caggagctgcacttcctctgaaattattgaggattgtacc

SEQ ID NO: 15028 - DNA, 40 bp, Artificial Sequence
  PCR primer for ORF amplification
caggagctgcacttccaagaccggaggttgtttcaaatag

SEQ ID NO: 15029 - DNA, 40 bp, Artificial Sequence
  PCR primer for ORF amplification
caggagctgcacttcccctctcctttccttcttccttttt

SEQ ID NO: 15030 - DNA, 40 bp, Artificial Sequence
  PCR primer for ORF amplification
caggagctgcacttcctgagtttttatgcccatttttcac

SEQ ID NO: 15031 - DNA, 40 bp, Artificial Sequence
  PCR primer for ORF amplification
caggagctgcacttccatacagacgaatgttcaagaattt

SEQ ID NO: 15032 - DNA, 40 bp, Artificial Sequence
  PCR primer for ORF amplification
caggagctgcacttcccaagtaatactgtagaatttcgtt

SEQ ID NO: 15033 - DNA, 40 bp, Artificial Sequence
  PCR primer for ORF amplification
caggagctgcacttcctccttttcttcttttgaacgtaaa

SEQ ID NO: 15034 - DNA, 40 bp, Artificial Sequence
  PCR primer for ORF amplification
caggagctgcacttcctttactaaccttggtatgtaagtg

SEQ ID NO: 15035 - DNA, 40 bp, Artificial Sequence
  PCR primer for ORF amplification
caggagctgcacttccatcgatgtctaaatttatttcttc

SEQ ID NO: 15036 - DNA, 40 bp, Artificial Sequence
  PCR primer for ORF amplification
caggagctgcacttccttgatcatactcatgctcacgcaa

SEQ ID NO: 15037 - DNA, 40 bp, Artificial Sequence
  PCR primer for ORF amplification
caggagctgcacttccagtacttgcattcatttggtcaac

SEQ ID NO: 15038 - DNA, 40 bp, Artificial Sequence
  PCR primer for ORF amplification
caggagctgcacttccattgtaacggctatatctactggg

SEQ ID NO: 15039 - DNA, 40 bp, Artificial Sequence
  PCR primer for ORF amplification
caggagctgcacttccgatttttgctaacatatccgtaac

SEQ ID NO: 15040 - DNA, 40 bp, Artificial Sequence
  PCR primer for ORF amplification
caggagctgcacttccttctaagatgtggtcttcggtatc

SEQ ID NO: 15041 - DNA, 40 bp, Artificial Sequence
  PCR primer for ORF amplification
caggagctgcacttccaacgtcccatttagaaaaatcggg

SEQ ID NO: 15042 - DNA, 40 bp, Artificial Sequence
  PCR primer for ORF amplification
caggagctgcacttccaatatctagttctatttcatctgg

SEQ ID NO: 15043 - DNA, 40 bp, Artificial Sequence
  PCR primer for ORF amplification
caggagctgcacttccgtcgtagcggctatatctactagg

SEQ ID NO: 15044 - DNA, 40 bp, Artificial Sequence
  PCR primer for ORF amplification
caggagctgcacttccgcaagcatcgaaaattgatccaga

SEQ ID NO: 15045 - DNA, 40 bp, Artificial Sequence
  PCR primer for ORF amplification
caggagctgcacttccctgtgttctatcaatcttcatatt

SEQ ID NO: 15046 - DNA, 40 bp, Artificial Sequence
  PCR primer for ORF amplification
caggagctgcacttccgcgtgaattcaggctgcgcattga

SEQ ID NO: 15047 - DNA, 40 bp, Artificial Sequence
  PCR primer for ORF amplification
caggagctgcacttcctgctttcgttttcctttttttgct

SEQ ID NO: 15048 - DNA, 40 bp, Artificial Sequence
  PCR primer for ORF amplification
caggagctgcacttcctaaggataattgacgcttctgttg

SEQ ID NO: 15049 - DNA, 40 bp, Artificial Sequence
  PCR primer for ORF amplification
caggagctgcacttcctgaggtactgacactgcgaccgcc

SEQ ID NO: 15050 - DNA, 40 bp, Artificial Sequence
  PCR primer for ORF amplification
caggagctgcacttccatcttcgaattcatcttcgtcgaa

SEQ ID NO: 15051 - DNA, 40 bp, Artificial Sequence
  PCR primer for ORF amplification
caggagctgcacttccgttgttgataatactgatctttgc

SEQ ID NO: 15052 - DNA, 40 bp, Artificial Sequence
  PCR primer for ORF amplification
caggagctgcacttccgacaccaataattttattttcagg

SEQ ID NO: 15053 - DNA, 40 bp, Artificial Sequence
  PCR primer for ORF amplification
caggagctgcacttccaaaaaatgatacgaaatccacagg

SEQ ID NO: 15054 - DNA, 40 bp, Artificial Sequence
  PCR primer for ORF amplification
caggagctgcacttcctttctttatcgagttgatttgttt

SEQ ID NO: 15055 - DNA, 40 bp, Artificial Sequence
  PCR primer for ORF amplification
caggagctgcacttccacgtaattttcggtagtagtgcaa

SEQ ID NO: 15056 - DNA, 40 bp, Artificial Sequence
  PCR primer for ORF amplification
caggagctgcacttcccatgttaagttcttgttcctccca

SEQ ID NO: 15057 - DNA, 40 bp, Artificial Sequence
  PCR primer for ORF amplification
caggagctgcacttccgattttcatacttcttcttttgaa

SEQ ID NO: 15058 - DNA, 40 bp, Artificial Sequence
  PCR primer for ORF amplification
tggaagtggttcaggaatggcaacgttggattttaccact

SEQ ID NO: 15059 - DNA, 40 bp, Artificial Sequence
  PCR primer for ORF amplification
tggaagtggttcaggaatgataataatatttatagaattg

SEQ ID NO: 15060 - DNA, 40 bp, Artificial Sequence
  PCR primer for ORF amplification
tggaagtggttcaggaatgtgggtagtactttcaaaagaa

SEQ ID NO: 15061 - DNA, 40 bp, Artificial Sequence
  PCR primer for ORF amplification
tggaagtggttcaggaatgttctcccacttcgaagtctcg

SEQ ID NO: 15062 - DNA, 40 bp, Artificial Sequence
  PCR primer for ORF amplification
tggaagtggttcaggaatgaccgaaagaaagctattgcag

SEQ ID NO: 15063 - DNA, 40 bp, Artificial Sequence
  PCR primer for ORF amplification
tggaagtggttcaggaatgagaagtttggtgtttgtccaa

SEQ ID NO: 15064 - DNA, 40 bp, Artificial Sequence
  PCR primer for ORF amplification
tggaagtggttcaggaatgatctctgatgaacagctgaac

SEQ ID NO: 15065 - DNA, 40 bp, Artificial Sequence
  PCR primer for ORF amplification
tggaagtggttcaggaatgcaaccatctaccgctaccgcc

SEQ ID NO: 15066 - DNA, 40 bp, Artificial Sequence
  PCR primer for ORF amplification
tggaagtggttcaggaatgctaatcttcataattcattat

SEQ ID NO: 15067 - DNA, 40 bp, Artificial Sequence
  PCR primer for ORF amplification
tggaagtggttcaggaatggtacacttcatttttatcgcc

SEQ ID NO: 15068 - DNA, 40 bp, Artificial Sequence
  PCR primer for ORF amplification
tggaagtggttcaggaatgcaagatttagagatttttttg

SEQ ID NO: 15069 - DNA, 40 bp, Artificial Sequence
  PCR primer for ORF amplification
tggaagtggttcaggaatgcaatggaacgctttttccttt

SEQ ID NO: 15070 - DNA, 40 bp, Artificial Sequence
  PCR primer for ORF amplification
tggaagtggttcaggaatgtccctacggccttgtctaaca

SEQ ID NO: 15071 - DNA, 40 bp, Artificial Sequence
  PCR primer for ORF amplification
tggaagtggttcaggaatgaatgtaatatttaaattgtat

SEQ ID NO: 15072 - DNA, 40 bp, Artificial Sequence
  PCR primer for ORF amplification
tggaagtggttcaggaatgcaaccgatcaccactgcttcc

SEQ ID NO: 15073 - DNA, 40 bp, Artificial Sequence
  PCR primer for ORF amplification
tggaagtggttcaggaatgaaagtgctagatgattggttt

SEQ ID NO: 15074 - DNA, 40 bp, Artificial Sequence
  PCR primer for ORF amplification
tggaagtggttcaggaatgagtcgttctattttttttttc

SEQ ID NO: 15075 - DNA, 40 bp, Artificial Sequence
  PCR primer for ORF amplification
tggaagtggttcaggaatgcacctaagaagcagatggtgg

SEQ ID NO: 15076 - DNA, 40 bp, Artificial Sequence
  PCR primer for ORF amplification
tggaagtggttcaggaatgccatttccgtcgatattacat

SEQ ID NO: 15077 - DNA, 40 bp, Artificial Sequence
  PCR primer for ORF amplification
tggaagtggttcaggaatgacagcaaagacgaaacaaagc

SEQ ID NO: 15078 - DNA, 40 bp, Artificial Sequence
  PCR primer for ORF amplification
tggaagtggttcaggaatgacttgcggtatagaaaatagt

SEQ ID NO: 15079 - DNA, 40 bp, Artificial Sequence
  PCR primer for ORF amplification
tggaagtggttcaggaatgactttaccaggtggtgttatt

SEQ ID NO: 15080 - DNA, 40 bp, Artificial Sequence
  PCR primer for ORF amplification
tggaagtggttcaggaatgttgactggtattgccccagac

SEQ ID NO: 15081 - DNA, 40 bp, Artificial Sequence
  PCR primer for ORF amplification
tggaagtggttcaggaatgtattcgtgcgcgaaaaaaaaa

SEQ ID NO: 15082 - DNA, 40 bp, Artificial Sequence
  PCR primer for ORF amplification
tggaagtggttcaggaatgtacaatcagataataaacact

SEQ ID NO: 15083 - DNA, 40 bp, Artificial Sequence
  PCR primer for ORF amplification
tggaagtggttcaggaatgttgatgagcacgttaccaggt

SEQ ID NO: 15084 - DNA, 40 bp, Artificial Sequence
  PCR primer for ORF amplification
tggaagtggttcaggaatgaagataaaaatttccatcgaa

SEQ ID NO: 15085 - DNA, 40 bp, Artificial Sequence
  PCR primer for ORF amplification
tggaagtggttcaggaatgcatgacatctgggtaatcacc

SEQ ID NO: 15086 - DNA, 40 bp, Artificial Sequence
  PCR primer for ORF amplification
tggaagtggttcaggaatgttttatggaagcttcaataaa

SEQ ID NO: 15087 - DNA, 40 bp, Artificial Sequence
  PCR primer for ORF amplification
tggaagtggttcaggaatgaaaatgaactatcatctatca

SEQ ID NO: 15088 - DNA, 40 bp, Artificial Sequence
  PCR primer for ORF amplification
tggaagtggttcaggaatgcctagtgattatacttcccat

SEQ ID NO: 15089 - DNA, 40 bp, Artificial Sequence
  PCR primer for ORF amplification
tggaagtggttcaggaatgtgtaaactcatgtggtgcact

SEQ ID NO: 15090 - DNA, 40 bp, Artificial Sequence
  PCR primer for ORF amplification
tggaagtggttcaggaatgttaacgacacaaaagtgtgaa

SEQ ID NO: 15091 - DNA, 40 bp, Artificial Sequence
  PCR primer for ORF amplification
tggaagtggttcaggaatggcacacaaatgtgcaagtgcc

SEQ ID NO: 15092 - DNA, 40 bp, Artificial Sequence
  PCR primer for ORF amplification
tggaagtggttcaggaatgcaagttggttttgtttctcag

SEQ ID NO: 15093 - DNA, 40 bp, Artificial Sequence
  PCR primer for ORF amplification
tggaagtggttcaggaatgccacaattagttccattttat

SEQ ID NO: 15094 - DNA, 40 bp, Artificial Sequence
  PCR primer for ORF amplification
tggaagtggttcaggaatgtcttacacacgagtagatcat

SEQ ID NO: 15095 - DNA, 40 bp, Artificial Sequence
  PCR primer for ORF amplification
tggaagtggttcaggaatgaaattactatttctgaatatt

SEQ ID NO: 15096 - DNA, 40 bp, Artificial Sequence
  PCR primer for ORF amplification
tggaagtggttcaggaatgaagttatttattcttgattat

SEQ ID NO: 15097 - DNA, 40 bp, Artificial Sequence
  PCR primer for ORF amplification
tggaagtggttcaggaatgataaactacgttaacattaca

SEQ ID NO: 15098 - DNA, 40 bp, Artificial Sequence
  PCR primer for ORF amplification
tggaagtggttcaggaatgatacaaaaaccgattttatta

SEQ ID NO: 15099 - DNA, 40 bp, Artificial Sequence
  PCR primer for ORF amplification
tggaagtggttcaggaatgatgagaatgtctctaaaacaa

SEQ ID NO: 15100 - DNA, 40 bp, Artificial Sequence
  PCR primer for ORF amplification
tggaagtggttcaggaatgtcccgtgtctatatatatcca

SEQ ID NO: 15101 - DNA, 40 bp, Artificial Sequence
  PCR primer for ORF amplification
tggaagtggttcaggaatgtggagacgtcggcgcgagccc

SEQ ID NO: 15102 - DNA, 40 bp, Artificial Sequence
  PCR primer for ORF amplification
tggaagtggttcaggaatgaaacagatgatgattgaagca

SEQ ID NO: 15103 - DNA, 40 bp, Artificial Sequence
  PCR primer for ORF amplification
tggaagtggttcaggaatgtctaacacctttgttgcagtc

SEQ ID NO: 15104 - DNA, 40 bp, Artificial Sequence
  PCR primer for ORF amplification
tggaagtggttcaggaatgtttggtctacctcaacaggaa

SEQ ID NO: 15105 - DNA, 40 bp, Artificial Sequence
  PCR primer for ORF amplification
tggaagtggttcaggaatgacattccatcttgggtggaca

SEQ ID NO: 15106 - DNA, 40 bp, Artificial Sequence
  PCR primer for ORF amplification
tggaagtggttcaggaatgaggcatcatcaaaatatgcat

SEQ ID NO: 15107 - DNA, 40 bp, Artificial Sequence
  PCR primer for ORF amplification
tggaagtggttcaggaatgcacggcgcttgcctcagcggt

SEQ ID NO: 15108 - DNA, 40 bp, Artificial Sequence
  PCR primer for ORF amplification
tggaagtggttcaggaatgacagttctaatcaagttgggt

SEQ ID NO: 15109 - DNA, 40 bp, Artificial Sequence
  PCR primer for ORF amplification
tggaagtggttcaggaatgattccctttcctgcacaacac

SEQ ID NO: 15110 - DNA, 40 bp, Artificial Sequence
  PCR primer for ORF amplification
tggaagtggttcaggaatgattttctttttcaaccagatc

SEQ ID NO: 15111 - DNA, 40 bp, Artificial Sequence
  PCR primer for ORF amplification
tggaagtggttcaggaatgattctcgctttgggcgacttc

SEQ ID NO: 15112 - DNA, 40 bp, Artificial Sequence
  PCR primer for ORF amplification
tggaagtggttcaggaatgcatatattaacgcgatcgagt

SEQ ID NO: 15113 - DNA, 40 bp, Artificial Sequence
  PCR primer for ORF amplification
tggaagtggttcaggaatgcgtttgtctctctattcatgt

SEQ ID NO: 15114 - DNA, 40 bp, Artificial Sequence
  PCR primer for ORF amplification
tggaagtggttcaggaatggggttcctccctgagtgtaat

SEQ ID NO: 15115 - DNA, 40 bp, Artificial Sequence
  PCR primer for ORF amplification
tggaagtggttcaggaatgagactacataaaacatttatc

SEQ ID NO: 15116 - DNA, 40 bp, Artificial Sequence
  PCR primer for ORF amplification
tggaagtggttcaggaatgatagttgatttctattccaac

SEQ ID NO: 15117 - DNA, 40 bp, Artificial Sequence
  PCR primer for ORF amplification
tggaagtggttcaggaatgatgtgcgtctgtatcccaaaa

SEQ ID NO: 15118 - DNA, 40 bp, Artificial Sequence
  PCR primer for ORF amplification
tggaagtggttcaggaatgcttttgtgcttccatatgtgt

SEQ ID NO: 15119 - DNA, 40 bp, Artificial Sequence
  PCR primer for ORF amplification
tggaagtggttcaggaatggtgcggctttcgtatctgcgt

SEQ ID NO: 15120 - DNA, 40 bp, Artificial Sequence
  PCR primer for ORF amplification
tggaagtggttcaggaatggtcaaattaacttcaatcgct

SEQ ID NO: 15121 - DNA, 40 bp, Artificial Sequence
  PCR primer for ORF amplification
tggaagtggttcaggaatgatcgtaaataatacacatata

SEQ ID NO: 15122 - DNA, 40 bp, Artificial Sequence
  PCR primer for ORF amplification
tggaagtggttcaggaatggattctgccaagatcattaac

SEQ ID NO: 15123 - DNA, 40 bp, Artificial Sequence
  PCR primer for ORF amplification
tggaagtggttcaggaatgttcaatgtagcattaccatca

SEQ ID NO: 15124 - DNA, 40 bp, Artificial Sequence; identical to SEQ ID NO: 15070
  PCR primer for ORF amplification

SEQ ID NO: 15125 - DNA, 40 bp, Artificial Sequence
  PCR primer for ORF amplification
tggaagtggttcaggaatgaaaagggacctaattggtccg

SEQ ID NO: 15126 - DNA, 40 bp, Artificial Sequence
  PCR primer for ORF amplification
tggaagtggttcaggaatggctcacgaaaacgtctggttc

SEQ ID NO: 15127 - DNA, 40 bp, Artificial Sequence
  PCR primer for ORF amplification
tggaagtggttcaggaatggctcacgaaaacgtttggttc

SEQ ID NO: 15128 - DNA, 40 bp, Artificial Sequence
  PCR primer for ORF amplification
tggaagtggttcaggaatgtttttacgtttttataatcga

SEQ ID NO: 15129 - DNA, 40 bp, Artificial Sequence
  PCR primer for ORF amplification
tggaagtggttcaggaatgaatgtgtttatgccaataagg

SEQ ID NO: 15130 - DNA, 40 bp, Artificial Sequence
  PCR primer for ORF amplification
tggaagtggttcaggaatgtataaatgtgtcccgagttat

SEQ ID NO: 15131 - DNA, 40 bp, Artificial Sequence
  PCR primer for ORF amplification
tggaagtggttcaggaatgacacaattgagtcaatccaac

SEQ ID NO: 15132 - DNA, 40 bp, Artificial Sequence
  PCR primer for ORF amplification
tggaagtggttcaggaatgcatttgatgtacactttgggc

SEQ ID NO: 15133 - DNA, 40 bp, Artificial Sequence
  PCR primer for ORF amplification
tggaagtggttcaggaatggaatctatatttctacatgct

SEQ ID NO: 15134 - DNA, 40 bp, Artificial Sequence
  PCR primer for ORF amplification
tggaagtggttcaggaatgaagttatctcaagttgttgtt

SEQ ID NO: 15135 - DNA, 40 bp, Artificial Sequence
  PCR primer for ORF amplification
tggaagtggttcaggaatgactattgctccaattactggt

SEQ ID NO: 15136 - DNA, 40 bp, Artificial Sequence
  PCR primer for ORF amplification
tggaagtggttcaggaatggctaagtctaagaaccatacc

SEQ ID NO: 15137 - DNA, 40 bp, Artificial Sequence
  PCR primer for ORF amplification
tggaagtggttcaggaatgggcttttttaacaataatccg

SEQ ID NO: 15138 - DNA, 40 bp, Artificial Sequence
  PCR primer for ORF amplification
tggaagtggttcaggaatgttgaaaagattccctacccct

SEQ ID NO: 15139 - DNA, 40 bp, Artificial Sequence
  PCR primer for ORF amplification
tggaagtggttcaggaatgagtttcctaccatcttttatc

SEQ ID NO: 15140 - DNA, 40 bp, Artificial Sequence
  PCR primer for ORF amplification
tggaagtggttcaggaatggctaataaagttattcaacta

SEQ ID NO: 15141 - DNA, 40 bp, Artificial Sequence
  PCR primer for ORF amplification
tggaagtggttcaggaatgttcgatagttctatcgaacga

SEQ ID NO: 15142 - DNA, 40 bp, Artificial Sequence
  PCR primer for ORF amplification
tggaagtggttcaggaatgtttgctaagctttatcgcggt

SEQ ID NO: 15143 - DNA, 40 bp, Artificial Sequence
  PCR primer for ORF amplification
tggaagtggttcaggaatgttcagcgaattaattaacttc

SEQ ID NO: 15144 - DNA, 40 bp, Artificial Sequence
  PCR primer for ORF amplification
tggaagtggttcaggaatgaaagtatcacaagttttcatt

SEQ ID NO: 15145 - DNA, 40 bp, Artificial Sequence
  PCR primer for ORF amplification
tggaagtggttcaggaatgcagtccatgatctgctcatct

SEQ ID NO: 15146 - DNA, 40 bp, Artificial Sequence
  PCR primer for ORF amplification
tggaagtggttcaggaatggacggtatgtttgctatgcca

SEQ ID NO: 15147 - DNA, 40 bp, Artificial Sequence
  PCR primer for ORF amplification
tggaagtggttcaggaatgacacttgcctattatggacag

SEQ ID NO: 15148 - DNA, 40 bp, Artificial Sequence
  PCR primer for ORF amplification
tggaagtggttcaggaatggacactgaagagaaaaaaaag

SEQ ID NO: 15149 - DNA, 40 bp, Artificial Sequence
  PCR primer for ORF amplification
tggaagtggttcaggaatggtttgtattcacactgaaaat

SEQ ID NO: 15150 - DNA, 40 bp, Artificial Sequence
  PCR primer for ORF amplification
tggaagtggttcaggaatgtctgcctggaggaaagctggt

SEQ ID NO: 15151 - DNA, 40 bp, Artificial Sequence
  PCR primer for ORF amplification
tggaagtggttcaggaatgtgtattattgtaaaatactca

SEQ ID NO: 15152 - DNA, 40 bp, Artificial Sequence
  PCR primer for ORF amplification
tggaagtggttcaggaatgaaaatgtggggaccctcccaa

SEQ ID NO: 15153 - DNA, 40 bp, Artificial Sequence
  PCR primer for ORF amplification
tggaagtggttcaggaatgatgtgtattataaattctgag

SEQ ID NO: 15154 - DNA, 40 bp, Artificial Sequence
  PCR primer for ORF amplification
tggaagtggttcaggaatgccatactcaccttcacttata

SEQ ID NO: 15155 - DNA, 40 bp, Artificial Sequence
  PCR primer for ORF amplification
tggaagtggttcaggaatggtttgtcgttttgttcatcat

SEQ ID NO: 15156 - DNA, 40 bp, Artificial Sequence
  PCR primer for ORF amplification
tggaagtggttcaggaatgaagattttcacgctgtatacc

SEQ ID NO: 15157 - DNA, 40 bp, Artificial Sequence
  PCR primer for ORF amplification
tggaagtggttcaggaatgaattgtttatgtttatgttct

SEQ ID NO: 15158 - DNA, 40 bp, Artificial Sequence
  PCR primer for ORF amplification
tggaagtggttcaggaatgatctcagtttgtttcgttttt

SEQ ID NO: 15159 - DNA, 40 bp, Artificial Sequence
  PCR primer for ORF amplification
tggaagtggttcaggaatgattttagtacatacagggaac

SEQ ID NO: 15160 - DNA, 40 bp, Artificial Sequence
  PCR primer for ORF amplification
tggaagtggttcaggaatgtctagtcgccaaggtggtaag

SEQ ID NO: 15161 - DNA, 40 bp, Artificial Sequence
  PCR primer for ORF amplification
tggaagtggttcaggaatggccgtacagacaccaagacaa

SEQ ID NO: 15162 - DNA, 40 bp, Artificial Sequence
  PCR primer for ORF amplification
tggaagtggttcaggaatgagaaacgaattataccagtta

SEQ ID NO: 15163 - DNA, 40 bp, Artificial Sequence
  PCR primer for ORF amplification
tggaagtggttcaggaatgatactatccaaacatgtaaat

SEQ ID NO: 15164 - DNA, 40 bp, Artificial Sequence
  PCR primer for ORF amplification
tggaagtggttcaggaatgcaattcaagaccatcgtcgct

SEQ ID NO: 15165 - DNA, 40 bp, Artificial Sequence
  PCR primer for ORF amplification
tggaagtggttcaggaatgcgccgcctatatcgtcatctt

SEQ ID NO: 15166 - DNA, 40 bp, Artificial Sequence
  PCR primer for ORF amplification
tggaagtggttcaggaatgcggcgtgcattgttcatagcg

SEQ ID NO: 15167 - DNA, 40 bp, Artificial Sequence
  PCR primer for ORF amplification
tggaagtggttcaggaatgttcttcagccaagttttgaga

SEQ ID NO: 15168 - DNA, 40 bp, Artificial Sequence
  PCR primer for ORF amplification
tggaagtggttcaggaatgaacaagagatataaattatac

SEQ ID NO: 15169 - DNA, 40 bp, Artificial Sequence
  PCR primer for ORF amplification
tggaagtggttcaggaatgccttatcactatttatttttg

SEQ ID NO: 15170 - DNA, 40 bp, Artificial Sequence
  PCR primer for ORF amplification
tggaagtggttcaggaatgctggccatgaaatcattttca

SEQ ID NO: 15171 - DNA, 40 bp, Artificial Sequence
  PCR primer for ORF amplification
tggaagtggttcaggaatggataacaaaaccccagtcact

SEQ ID NO: 15172 - DNA, 40 bp, Artificial Sequence
  PCR primer for ORF amplification
tggaagtggttcaggaatggattctaagaccccagtcacc

SEQ ID NO: 15173 - DNA, 40 bp, Artificial Sequence
  PCR primer for ORF amplification
tggaagtggttcaggaatggtcgcctttttagaactaact

SEQ ID NO: 15174 - DNA, 40 bp, Artificial Sequence
  PCR primer for ORF amplification
tggaagtggttcaggaatggttgttggcagcgaatttaac

SEQ ID NO: 15175 - DNA, 40 bp, Artificial Sequence
  PCR primer for ORF amplification
tggaagtggttcaggaatgaatacagaccaacaaaaagtg

SEQ ID NO: 15176 - DNA, 40 bp, Artificial Sequence
  PCR primer for ORF amplification
tggaagtggttcaggaatgaccatggaccaaggccttaac

SEQ ID NO: 15177 - DNA, 40 bp, Artificial Sequence
  PCR primer for ORF amplification
tggaagtggttcaggaatgagaccacgtgaccaaggcttt

SEQ ID NO: 15178 - DNA, 40 bp, Artificial Sequence
  PCR primer for ORF amplification
tggaagtggttcaggaatgagagcagtcactagaaacaaa

SEQ ID NO: 15179 - DNA, 40 bp, Artificial Sequence
  PCR primer for ORF amplification
tggaagtggttcaggaatgcatttgtgccagaatggacac

SEQ ID NO: 15180 - DNA, 40 bp, Artificial Sequence
  PCR primer for ORF amplification
tggaagtggttcaggaatggcaaaatcggttttcaatttc

SEQ ID NO: 15181 - DNA, 40 bp, Artificial Sequence
  PCR primer for ORF amplification
tggaagtggttcaggaatggctagaggtaatcaaagagac

SEQ ID NO: 15182 - DNA, 40 bp, Artificial Sequence
  PCR primer for ORF amplification
tggaagtggttcaggaatgggtgctgcttatcatttcatg

SEQ ID NO: 15183 - DNA, 40 bp, Artificial Sequence
  PCR primer for ORF amplification
tggaagtggttcaggaatgaacgctaacaaacaaaggcag

SEQ ID NO: 15184 - DNA, 40 bp, Artificial Sequence
  PCR primer for ORF amplification
tggaagtggttcaggaatgactcgtgatacacccgaagat

SEQ ID NO: 15185 - DNA, 40 bp, Artificial Sequence
  PCR primer for ORF amplification
tggaagtggttcaggaatgactgaaactgacaagaaacaa

SEQ ID NO: 15186 - DNA, 40 bp, Artificial Sequence
  PCR primer for ORF amplification
tggaagtggttcaggaatgactgtaaaaatatgtgactgt

SEQ ID NO: 15187 - DNA, 40 bp, Artificial Sequence
  PCR primer for ORF amplification
tggaagtggttcaggaatgctggttcccatgcataactca

SEQ ID NO: 15188 - DNA, 40 bp, Artificial Sequence
  PCR primer for ORF amplification
tggaagtggttcaggaatgtgttgtttcgataccctccat

SEQ ID NO: 15189 - DNA, 40 bp, Artificial Sequence
  PCR primer for ORF amplification
tggaagtggttcaggaatgaagttccaatatgcgttggcc

SEQ ID NO: 15190 - DNA, 40 bp, Artificial Sequence
  PCR primer for ORF amplification
tggaagtggttcaggaatgaaatcactccatgatagttta

SEQ ID NO: 15191 - DNA, 40 bp, Artificial Sequence
  PCR primer for ORF amplification
tggaagtggttcaggaatgattgtcccagtcagatgtttc

SEQ ID NO: 15192 - DNA, 40 bp, Artificial Sequence
  PCR primer for ORF amplification
tggaagtggttcaggaatggtaaaagtgaaatctaagaat

SEQ ID NO: 15193 - DNA, 40 bp, Artificial Sequence
  PCR primer for ORF amplification
tggaagtggttcaggaatgtattcaaagatcttgctatac

SEQ ID NO: 15194 - DNA, 40 bp, Artificial Sequence
  PCR primer for ORF amplification
tggaagtggttcaggaatgtcattctctgtcagctgcaag

SEQ ID NO: 15195 - DNA, 40 bp, Artificial Sequence
  PCR primer for ORF amplification
tggaagtggttcaggaatgtccaaatacgcttggtatacc

SEQ ID NO: 15196 - DNA, 40 bp, Artificial Sequence
  PCR primer for ORF amplification
tggaagtggttcaggaatgtctcgcgaagggttccagatt

SEQ ID NO: 15197 - DNA, 40 bp, Artificial Sequence
  PCR primer for ORF amplification
tggaagtggttcaggaatgcatcgtaaaaaaagaaaaaaa

SEQ ID NO: 15198 - DNA, 40 bp, Artificial Sequence
  PCR primer for ORF amplification
tggaagtggttcaggaatgtcaagacacaagtacaagtta

SEQ ID NO: 15199 - DNA, 40 bp, Artificial Sequence
  PCR primer for ORF amplification
tggaagtggttcaggaatgagcaagcataagcatgaatgg

SEQ ID NO: 15200 - DNA, 40 bp, Artificial Sequence
  PCR primer for ORF amplification
tggaagtggttcaggaatggagaaccctcatgaacaagtg

SEQ ID NO: 15201 - DNA, 40 bp, Artificial Sequence
  PCR primer for ORF amplification
tggaagtggttcaggaatggctagagcaagaaagggtgca

SEQ ID NO: 15202 - DNA, 40 bp, Artificial Sequence
  PCR primer for ORF amplification
tggaagtggttcaggaatgtctgataagcccgactcccaa

SEQ ID NO: 15203 - DNA, 40 bp, Artificial Sequence
  PCR primer for ORF amplification
tggaagtggttcaggaatgtctgcattatttaattttcgt

SEQ ID NO: 15204 - DNA, 40 bp, Artificial Sequence
  PCR primer for ORF amplification
tggaagtggttcaggaatgagatctaatattttgaaatta

SEQ ID NO: 15205 - DNA, 40 bp, Artificial Sequence
  PCR primer for ORF amplification
tggaagtggttcaggaatgattgaggtagttgtgaatgac

SEQ ID NO: 15206 - DNA, 40 bp, Artificial Sequence
  PCR primer for ORF amplification
tggaagtggttcaggaatggaactttttataccttgccca

SEQ ID NO: 15207 - DNA, 40 bp, Artificial Sequence
  PCR primer for ORF amplification
tggaagtggttcaggaatggcagagataaaacattatcaa

SEQ ID NO: 15208 - DNA, 40 bp, Artificial Sequence
  PCR primer for ORF amplification
tggaagtggttcaggaatgttgctatatttatatatttta

SEQ ID NO: 15209 - DNA, 40 bp, Artificial Sequence
  PCR primer for ORF amplification
tggaagtggttcaggaatgaataaatatctatttgaccat

SEQ ID NO: 15210 - DNA, 40 bp, Artificial Sequence
  PCR primer for ORF amplification
tggaagtggttcaggaatgatcgcccaaagtaccagatta

SEQ ID NO: 15211 - DNA, 40 bp, Artificial Sequence
  PCR primer for ORF amplification
tggaagtggttcaggaatggcgcctccaaccaccatccgc

SEQ ID NO: 15212 - DNA, 40 bp, Artificial Sequence
  PCR primer for ORF amplification
tggaagtggttcaggaatgtggagatcttatcttgttttt

SEQ ID NO: 15213 - DNA, 40 bp, Artificial Sequence
  PCR primer for ORF amplification
tggaagtggttcaggaatgaaccgttttgtaattatttgc

SEQ ID NO: 15214 - DNA, 40 bp, Artificial Sequence
  PCR primer for ORF amplification
tggaagtggttcaggaatgaatccacgctacaggtttata

SEQ ID NO: 15215 - DNA, 40 bp, Artificial Sequence
  PCR primer for ORF amplification
tggaagtggttcaggaatgacaaagaatttcatcgtcact

SEQ ID NO: 15216 - DNA, 40 bp, Artificial Sequence
  PCR primer for ORF amplification
tggaagtggttcaggaatgagccaacaacaaggttactac

SEQ ID NO: 15217 - DNA, 40 bp, Artificial Sequence
  PCR primer for ORF amplification
tggaagtggttcaggaatgccaattataggggtgccgagg

SEQ ID NO: 15218 - DNA, 40 bp, Artificial Sequence
  PCR primer for ORF amplification
tggaagtggttcaggaatggaagcggaaaaacaatctgat

SEQ ID NO: 15219 - DNA, 40 bp, Artificial Sequence
  PCR primer for ORF amplification
tggaagtggttcaggaatgagtactgaaaaactggaagct

SEQ ID NO: 15220 - DNA, 40 bp, Artificial Sequence
  PCR primer for ORF amplification
tggaagtggttcaggaatgatctttgaatgtacatccttt

SEQ ID NO: 15221 - DNA, 40 bp, Artificial Sequence
  PCR primer for ORF amplification
tggaagtggttcaggaatgcaattagtattagcagctaaa

SEQ ID NO: 15222 - DNA, 40 bp, Artificial Sequence
  PCR primer for ORF amplification
tggaagtggttcaggaatggagatgctcttgtttctgaac

SEQ ID NO: 15223 - DNA, 40 bp, Artificial Sequence
  PCR primer for ORF amplification
tggaagtggttcaggaatgctggcgaaaacgggcgatgta

SEQ ID NO: 15224 - DNA, 40 bp, Artificial Sequence
  PCR primer for ORF amplification
tggaagtggttcaggaatggcatttgaaagacaaggaaag

SEQ ID NO: 15225 - DNA, 40 bp, Artificial Sequence
  PCR primer for ORF amplification
tggaagtggttcaggaatggctgtagatgttcctcgtgcg

SEQ ID NO: 15226 - DNA, 40 bp, Artificial Sequence
  PCR primer for ORF amplification
tggaagtggttcaggaatggtttctacccctgaactgaag

SEQ ID NO: 15227 - DNA, 40 bp, Artificial Sequence
  PCR primer for ORF amplification
tggaagtggttcaggaatgatgataataatatttatagaa

SEQ ID NO: 15228 - DNA, 40 bp, Artificial Sequence
  PCR primer for ORF amplification
tggaagtggttcaggaatgagcactgccttcagaaaaata

SEQ ID NO: 15229 - DNA, 40 bp, Artificial Sequence
  PCR primer for ORF amplification
tggaagtggttcaggaatgcaggcaaaccattccgtcagt

SEQ ID NO: 15230 - DNA, 40 bp, Artificial Sequence
  PCR primer for ORF amplification
tggaagtggttcaggaatggctagagaaatcaccgacatc

SEQ ID NO: 15231 - DNA, 40 bp, Artificial Sequence
  PCR primer for ORF amplification
tggaagtggttcaggaatgtcacagaacaacacaatcagc

SEQ ID NO: 15232 - DNA, 40 bp, Artificial Sequence
  PCR primer for ORF amplification
tggaagtggttcaggaatgttgtgccaacagatgattaga

SEQ ID NO: 15233 - DNA, 40 bp, Artificial Sequence
  PCR primer for ORF amplification
tggaagtggttcaggaatgaaaatgaacccttgtactgtt

SEQ ID NO: 15234 - DNA, 40 bp, Artificial Sequence
  PCR primer for ORF amplification
tggaagtggttcaggaatgcaaatcaaaaacattgtcgct

SEQ ID NO: 15235 - DNA, 40 bp, Artificial Sequence
  PCR primer for ORF amplification
tggaagtggttcaggaatgcacgcccgcgactggttttta

SEQ ID NO: 15236 - DNA, 40 bp, Artificial Sequence
  PCR primer for ORF amplification
tggaagtggttcaggaatgcctaagagattaagtgggtta

SEQ ID NO: 15237 - DNA, 40 bp, Artificial Sequence
  PCR primer for ORF amplification
tggaagtggttcaggaatgtctaacatgatgaataagttc

SEQ ID NO: 15238 - DNA, 40 bp, Artificial Sequence
  PCR primer for ORF amplification
tggaagtggttcaggaatgaacacacaagaactatgtaag

SEQ ID NO: 15239 - DNA, 40 bp, Artificial Sequence
  PCR primer for ORF amplification
tggaagtggttcaggaatgacacaacataaaagctcgatg

SEQ ID NO: 15240 - DNA, 40 bp, Artificial Sequence
  PCR primer for ORF amplification
tggaagtggttcaggaatggatagcggaaagagtgatata

SEQ ID NO: 15241 - DNA, 40 bp, Artificial Sequence
  PCR primer for ORF amplification
tggaagtggttcaggaatggctagagctagtgaaaaaggt

SEQ ID NO: 15242 - DNA, 40 bp, Artificial Sequence
  PCR primer for ORF amplification
tggaagtggttcaggaatgtctaataaagagataacttgt

SEQ ID NO: 15243 - DNA, 40 bp, Artificial Sequence
  PCR primer for ORF amplification
tggaagtggttcaggaatgttatctaaagaagcgttaata

SEQ ID NO: 15244 - DNA, 40 bp, Artificial Sequence
  PCR primer for ORF amplification
tggaagtggttcaggaatgtcaacatatgacgaaatcgaa

SEQ ID NO: 15245 - DNA, 40 bp, Artificial Sequence
  PCR primer for ORF amplification
tggaagtggttcaggaatgtcaagcccaactcctccaggt

SEQ ID NO: 15246 - DNA, 40 bp, Artificial Sequence
  PCR primer for ORF amplification
tggaagtggttcaggaatggctgatcaagaaaactctcca

SEQ ID NO: 15247 - DNA, 40 bp, Artificial Sequence
  PCR primer for ORF amplification
tggaagtggttcaggaatgacgagaacaaacaagtggacc

SEQ ID NO: 15248 - DNA, 40 bp, Artificial Sequence
  PCR primer for ORF amplification
tggaagtggttcaggaatgcacggcacttgcctcagcggt

SEQ ID NO: 15249 - DNA, 40 bp, Artificial Sequence
  PCR primer for ORF amplification
tggaagtggttcaggaatggacgatttccttgaacatttg

SEQ ID NO: 15250 - DNA, 40 bp, Artificial Sequence
  PCR primer for ORF amplification
tggaagtggttcaggaatggccagcagtacttccacttcc

SEQ ID NO: 15251 - DNA, 40 bp, Artificial Sequence; identical to SEQ ID NO: 15111
  PCR primer for ORF amplification

SEQ ID NO: 15252 - DNA, 40 bp, Artificial Sequence
  PCR primer for ORF amplification
tggaagtggttcaggaatgcctcaaaaaccacttaaagtt

SEQ ID NO: 15253 - DNA, 40 bp, Artificial Sequence
  PCR primer for ORF amplification
tggaagtggttcaggaatggttttgaatccgtccaagtac

SEQ ID NO: 15254 - DNA, 40 bp, Artificial Sequence
  PCR primer for ORF amplification
tggaagtggttcaggaatgtcagcggagaacattagtact

SEQ ID NO: 15255 - DNA, 40 bp, Artificial Sequence
  PCR primer for ORF amplification
tggaagtggttcaggaatgtcatctgctctatacaaacaa

SEQ ID NO: 15256 - DNA, 40 bp, Artificial Sequence
  PCR primer for ORF amplification
tggaagtggttcaggaatgttaccacgttcagcattagca

SEQ ID NO: 15257 - DNA, 40 bp, Artificial Sequence
  PCR primer for ORF amplification
tggaagtggttcaggaatgttccttcctataatttttcac

SEQ ID NO: 15258 - DNA, 40 bp, Artificial Sequence
  PCR primer for ORF amplification
tggaagtggttcaggaatgaccagaactagcaaatggaca

SEQ ID NO: 15259 - DNA, 40 bp, Artificial Sequence
  PCR primer for ORF amplification
tggaagtggttcaggaatgagcgagagcagtgatatcagc

SEQ ID NO: 15260 - DNA, 40 bp, Artificial Sequence
  PCR primer for ORF amplification
tggaagtggttcaggaatgcctccaagaagtatagaagaa

SEQ ID NO: 15261 - DNA, 40 bp, Artificial Sequence
  PCR primer for ORF amplification
tggaagtggttcaggaatggggaatataatgtcagctagt

SEQ ID NO: 15262 - DNA, 40 bp, Artificial Sequence
  PCR primer for ORF amplification
tggaagtggttcaggaatggtgttttacaaagtcacgttg

SEQ ID NO: 15263 - DNA, 40 bp, Artificial Sequence
  PCR primer for ORF amplification
tggaagtggttcaggaatgtccggaaaagcttctacagag

SEQ ID NO: 15264 - DNA, 40 bp, Artificial Sequence
  PCR primer for ORF amplification
tggaagtggttcaggaatgttaaaccgttgcatttcccgt

SEQ ID NO: 15265 - DNA, 40 bp, Artificial Sequence
  PCR primer for ORF amplification
tggaagtggttcaggaatgcagttacttcgctgtttttca

SEQ ID NO: 15266 - DNA, 40 bp, Artificial Sequence
  PCR primer for ORF amplification
tggaagtggttcaggaatgcatccattagtcgatgaattg

SEQ ID NO: 15267 - DNA, 40 bp, Artificial Sequence
  PCR primer for ORF amplification
tggaagtggttcaggaatggacgcattgaactccaaagaa

SEQ ID NO: 15268 - DNA, 40 bp, Artificial Sequence
  PCR primer for ORF amplification
tggaagtggttcaggaatggcagatagcgaggatacctct

SEQ ID NO: 15269 - DNA, 40 bp, Artificial Sequence
  PCR primer for ORF amplification
tggaagtggttcaggaatggtcgctagccgcgctcgggaa

SEQ ID NO: 15270 - DNA, 40 bp, Artificial Sequence
  PCR primer for ORF amplification
tggaagtggttcaggaatggtttcccaattattcgaagaa

SEQ ID NO: 15271 - DNA, 40 bp, Artificial Sequence
  PCR primer for ORF amplification
tggaagtggttcaggaatgtcactaagaaacatatcaatg

SEQ ID NO: 15272 - DNA, 40 bp, Artificial Sequence
  PCR primer for ORF amplification
tggaagtggttcaggaatgtcttctctatcaacgtctgat

SEQ ID NO: 15273 - DNA, 40 bp, Artificial Sequence
  PCR primer for ORF amplification
tggaagtggttcaggaatggacatcttgaaactgtcagat

SEQ ID NO: 15274 - DNA, 40 bp, Artificial Sequence
  PCR primer for ORF amplification
tggaagtggttcaggaatggcagcttcagttccaccagga

SEQ ID NO: 15275 - DNA, 40 bp, Artificial Sequence
  PCR primer for ORF amplification
tggaagtggttcaggaatgtgtgtgtgtgcgatacccttt

SEQ ID NO: 15276 - DNA, 40 bp, Artificial Sequence
  PCR primer for ORF amplification
tggaagtggttcaggaatgagtacggacgttgctgctgca

SEQ ID NO: 15277 - DNA, 40 bp, Artificial Sequence
  PCR primer for ORF amplification
tggaagtggttcaggaatggagacacctttggatttattg

SEQ ID NO: 15278 - DNA, 40 bp, Artificial Sequence
  PCR primer for ORF amplification
tggaagtggttcaggaatggatacggaagcattggccaat

SEQ ID NO: 15279 - DNA, 40 bp, Artificial Sequence
  PCR primer for ORF amplification
tggaagtggttcaggaatgaatgacgatgaagatagagcc

SEQ ID NO: 15280 - DNA, 40 bp, Artificial Sequence
  PCR primer for ORF amplification
tggaagtggttcaggaatgcaatactgtgaactcgattta

SEQ ID NO: 15281 - DNA, 40 bp, Artificial Sequence
  PCR primer for ORF amplification
tggaagtggttcaggaatgggtgctgcatacaaagtattt

SEQ ID NO: 15282 - DNA, 40 bp, Artificial Sequence
  PCR primer for ORF amplification
tggaagtggttcaggaatgcaaccggcagctagactttta

SEQ ID NO: 15283 - DNA, 40 bp, Artificial Sequence
  PCR primer for ORF amplification
tggaagtggttcaggaatgcaattctctactgtcgcttcc

SEQ ID NO: 15284 - DNA, 40 bp, Artificial Sequence
  PCR primer for ORF amplification
tggaagtggttcaggaatgggtaaaagattttcagaatcc

SEQ ID NO: 15285 - DNA, 40 bp, Artificial Sequence
  PCR primer for ORF amplification
tggaagtggttcaggaatgtctggatacttcaaccatctt

SEQ ID NO: 15286 - DNA, 40 bp, Artificial Sequence
  PCR primer for ORF amplification
tggaagtggttcaggaatgagtctaccggagattttgcct

SEQ ID NO: 15287 - DNA, 40 bp, Artificial Sequence
  PCR primer for ORF amplification
tggaagtggttcaggaatgcataatactggcaagagatac

SEQ ID NO: 15288 - DNA, 40 bp, Artificial Sequence
  PCR primer for ORF amplification
tggaagtggttcaggaatggtcaccccaagagaacctaag

SEQ ID NO: 15289 - DNA, 40 bp, Artificial Sequence
  PCR primer for ORF amplification
tggaagtggttcaggaatgtctttcttaggtttcggtggt

SEQ ID NO: 15290 - DNA, 40 bp, Artificial Sequence
  PCR primer for ORF amplification
tggaagtggttcaggaatgttgagaaccacttttttgcgc

SEQ ID NO: 15291 - DNA, 40 bp, Artificial Sequence
  PCR primer for ORF amplification
tggaagtggttcaggaatgtttttacagactctccgccta

SEQ ID NO: 15292 - DNA, 40 bp, Artificial Sequence
  PCR primer for ORF amplification
tggaagtggttcaggaatgacattagtaagtacccaaatg

SEQ ID NO: 15293 - DNA, 40 bp, Artificial Sequence
  PCR primer for ORF amplification
tggaagtggttcaggaatgaatccttttgcatcgctagaa

SEQ ID NO: 15294 - DNA, 40 bp, Artificial Sequence
  PCR primer for ORF amplification
tggaagtggttcaggaatgatggctagtacatccaatgat

SEQ ID NO: 15295 - DNA, 40 bp, Artificial Sequence
  PCR primer for ORF amplification
tggaagtggttcaggaatgcctggatttacagctccaaca

SEQ ID NO: 15296 - DNA, 40 bp, Artificial Sequence
  PCR primer for ORF amplification
tggaagtggttcaggaatggaacacaatctttcaccttta

SEQ ID NO: 15297 - DNA, 40 bp, Artificial Sequence
  PCR primer for ORF amplification
tggaagtggttcaggaatggaccgatctttgcaagtatat

SEQ ID NO: 15298 - DNA, 40 bp, Artificial Sequence
  PCR primer for ORF amplification
tggaagtggttcaggaatgggtcctccaagcggtaaaact

SEQ ID NO: 15299 - DNA, 40 bp, Artificial Sequence
  PCR primer for ORF amplification
tggaagtggttcaggaatgtcattcatacctattgtatgt

SEQ ID NO: 15300 - DNA, 40 bp, Artificial Sequence
  PCR primer for ORF amplification
tggaagtggttcaggaatgtcgaacaaagttaaaaccaag

SEQ ID NO: 15301 - DNA, 40 bp, Artificial Sequence
  PCR primer for ORF amplification
tggaagtggttcaggaatgtctgagatattacaagatgta

SEQ ID NO: 15302 - DNA, 40 bp, Artificial Sequence
  PCR primer for ORF amplification
tggaagtggttcaggaatgaagttagattcaggaatatac

SEQ ID NO: 15303 - DNA, 40 bp, Artificial Sequence
  PCR primer for ORF amplification
tggaagtggttcaggaatgtccggaaaaccaccagtttat

SEQ ID NO: 15304 - DNA, 40 bp, Artificial Sequence
  PCR primer for ORF amplification
tggaagtggttcaggaatgataccggctctcactcccgaa

SEQ ID NO: 15305 - DNA, 40 bp, Artificial Sequence
  PCR primer for ORF amplification
tggaagtggttcaggaatgtatatcaattttactagtttt

SEQ ID NO: 15306 - DNA, 40 bp, Artificial Sequence
  PCR primer for ORF amplification
tggaagtggttcaggaatgtcgacagttaatgttttgaga

SEQ ID NO: 15307 - DNA, 40 bp, Artificial Sequence
  PCR primer for ORF amplification
tggaagtggttcaggaatgtgccctcgcacagttttgctc

SEQ ID NO: 15308 - DNA, 40 bp, Artificial Sequence
  PCR primer for ORF amplification
tggaagtggttcaggaatggaggaccacacccttgtggcc

SEQ ID NO: 15309 - DNA, 40 bp, Artificial Sequence
  PCR primer for ORF amplification
tggaagtggttcaggaatgtccgaacaagcacaaacacaa

SEQ ID NO: 15310 - DNA, 40 bp, Artificial Sequence
  PCR primer for ORF amplification
tggaagtggttcaggaatgtctaatccatgccagaaggag

SEQ ID NO: 15311 - DNA, 40 bp, Artificial Sequence
  PCR primer for ORF amplification
tggaagtggttcaggaatgaagtcaagtattccaatcacc

SEQ ID NO: 15312 - DNA, 40 bp, Artificial Sequence
  PCR primer for ORF amplification
tggaagtggttcaggaatggcagttagtaataataataat

SEQ ID NO: 15313 - DNA, 40 bp, Artificial Sequence
  PCR primer for ORF amplification
tggaagtggttcaggaatggcggtaagtatcctatcatat

SEQ ID NO: 15314 - DNA, 40 bp, Artificial Sequence
  PCR primer for ORF amplification
tggaagtggttcaggaatgtcagggaacccaggaagctcg

SEQ ID NO: 15315 - DNA, 40 bp, Artificial Sequence
  PCR primer for ORF amplification
tggaagtggttcaggaatgttgattgatttttgctgtagt

SEQ ID NO: 15316 - DNA, 40 bp, Artificial Sequence
  PCR primer for ORF amplification
tggaagtggttcaggaatgaagactgtctattacaaagaa

SEQ ID NO: 15317 - DNA, 40 bp, Artificial Sequence
  PCR primer for ORF amplification
tggaagtggttcaggaatgaccgaagaaactattactata

SEQ ID NO: 15318 - DNA, 40 bp, Artificial Sequence
  PCR primer for ORF amplification
tggaagtggttcaggaatggcccatctctcactaaatcag

SEQ ID NO: 15319 - DNA, 40 bp, Artificial Sequence
  PCR primer for ORF amplification
tggaagtggttcaggaatggccgcaactaaagaagcaaag

SEQ ID NO: 15320 - DNA, 40 bp, Artificial Sequence
  PCR primer for ORF amplification
tggaagtggttcaggaatggtaaacgtgaaagtggagttt

SEQ ID NO: 15321 - DNA, 40 bp, Artificial Sequence
  PCR primer for ORF amplification
tggaagtggttcaggaatgtataaaataactactatatat

SEQ ID NO: 15322 - DNA, 40 bp, Artificial Sequence
  PCR primer for ORF amplification
tggaagtggttcaggaatgtctcaagatttcgttacgtta

SEQ ID NO: 15323 - DNA, 40 bp, Artificial Sequence
  PCR primer for ORF amplification
tggaagtggttcaggaatgttgggaatgataaggtgggta

SEQ ID NO: 15324 - DNA, 40 bp, Artificial Sequence
  PCR primer for ORF amplification
tggaagtggttcaggaatgaaaacattcttcttgattgag

SEQ ID NO: 15325 - DNA, 40 bp, Artificial Sequence
  PCR primer for ORF amplification
tggaagtggttcaggaatgacagataacacaacttccagc

SEQ ID NO: 15326 - DNA, 40 bp, Artificial Sequence
  PCR primer for ORF amplification
tggaagtggttcaggaatgagaggcgaaacaggcgtaagc

SEQ ID NO: 15327 - DNA, 40 bp, Artificial Sequence
  PCR primer for ORF amplification
tggaagtggttcaggaatgagcaatactaagcataccact

SEQ ID NO: 15328 - DNA, 40 bp, Artificial Sequence
  PCR primer for ORF amplification
tggaagtggttcaggaatggttcagtacgctccctttcta

SEQ ID NO: 15329 - DNA, 40 bp, Artificial Sequence
  PCR primer for ORF amplification
tggaagtggttcaggaatgaacaataatgttgaagaactc

SEQ ID NO: 15330 - DNA, 40 bp, Artificial Sequence
  PCR primer for ORF amplification
tggaagtggttcaggaatgaagaacgcagcattgtgtgag

SEQ ID NO: 15331 - DNA, 40 bp, Artificial Sequence
  PCR primer for ORF amplification
tggaagtggttcaggaatgactatgaatggaataccagtg

SEQ ID NO: 15332 - DNA, 40 bp, Artificial Sequence
  PCR primer for ORF amplification
tggaagtggttcaggaatgatttttaaacgtgcagtatct

SEQ ID NO: 15333 - DNA, 40 bp, Artificial Sequence
  PCR primer for ORF amplification
tggaagtggttcaggaatgcaatcgatcagtaattgtccc

SEQ ID NO: 15334 - DNA, 40 bp, Artificial Sequence
  PCR primer for ORF amplification
tggaagtggttcaggaatgctaaaggtggaaaagttcaaa

SEQ ID NO: 15335 - DNA, 40 bp, Artificial Sequence
  PCR primer for ORF amplification
tggaagtggttcaggaatgtcggactcagaagtcaatcaa

SEQ ID NO: 15336 - DNA, 40 bp, Artificial Sequence
  PCR primer for ORF amplification
tggaagtggttcaggaatgattgttaaagtgaagacactg

SEQ ID NO: 15337 - DNA, 40 bp, Artificial Sequence
  PCR primer for ORF amplification
tggaagtggttcaggaatgcgtactttcactgactttgtt

SEQ ID NO: 15338 - DNA, 40 bp, Artificial Sequence; identical to SEQ ID NO: 15337
  PCR primer for ORF amplification

SEQ ID NO: 15339 - DNA, 40 bp, Artificial Sequence
  PCR primer for ORF amplification
tggaagtggttcaggaatgaaattctctactctctccacc

SEQ ID NO: 15340 - DNA, 40 bp, Artificial Sequence
  PCR primer for ORF amplification
tggaagtggttcaggaatggcaggggatagtataagcgct

SEQ ID NO: 15341 - DNA, 40 bp, Artificial Sequence
  PCR primer for ORF amplification
tggaagtggttcaggaatggtggcagttcataaggtcagg

SEQ ID NO: 15342 - DNA, 40 bp, Artificial Sequence
  PCR primer for ORF amplification
tggaagtggttcaggaatgtctagtgaaagagcctgtatg

SEQ ID NO: 15343 - DNA, 40 bp, Artificial Sequence
  PCR primer for ORF amplification
tggaagtggttcaggaatgtccggtagaggtaaaggtggt

SEQ ID NO: 15344 - DNA, 40 bp, Artificial Sequence; identical to SEQ ID NO: 15343
  PCR primer for ORF amplification

SEQ ID NO: 15345 - DNA, 40 bp, Artificial Sequence
  PCR primer for ORF amplification
tggaagtggttcaggaatgaattcaagtctgaatgccaat

SEQ ID NO: 15346 - DNA, 40 bp, Artificial Sequence
  PCR primer for ORF amplification
tggaagtggttcaggaatggttactcaattcaaaactgcc

SEQ ID NO: 15347 - DNA, 40 bp, Artificial Sequence
  PCR primer for ORF amplification
tggaagtggttcaggaatgcaaaattcccaagactacttt

SEQ ID NO: 15348 - DNA, 40 bp, Artificial Sequence
  PCR primer for ORF amplification
tggaagtggttcaggaatgcccaagatcttttgtttagcg

SEQ ID NO: 15349 - DNA, 40 bp, Artificial Sequence
  PCR primer for ORF amplification
tggaagtggttcaggaatggaagatacctcgaggtgcatc

SEQ ID NO: 15350 - DNA, 40 bp, Artificial Sequence
  PCR primer for ORF amplification
tggaagtggttcaggaatggacattgacatgaactatccc

SEQ ID NO: 15351 - DNA, 40 bp, Artificial Sequence
  PCR primer for ORF amplification
tggaagtggttcaggaatgggcttattttcatttgatggt

SEQ ID NO: 15352 - DNA, 40 bp, Artificial Sequence
  PCR primer for ORF amplification
tggaagtggttcaggaatggtcactcaattaaaatccgct

SEQ ID NO: 15353 - DNA, 40 bp, Artificial Sequence
  PCR primer for ORF amplification
tggaagtggttcaggaatgttaaggagggaaacttcaaca

SEQ ID NO: 15354 - DNA, 40 bp, Artificial Sequence
  PCR primer for ORF amplification
tggaagtggttcaggaatgatggacttgggcgacaaaata

SEQ ID NO: 15355 - DNA, 40 bp, Artificial Sequence
  PCR primer for ORF amplification
tggaagtggttcaggaatgcaagttctcatcggaacgaaa

SEQ ID NO: 15356 - DNA, 40 bp, Artificial Sequence
  PCR primer for ORF amplification
tggaagtggttcaggaatgccactatttgcaaggctctgc

SEQ ID NO: 15357 - DNA, 40 bp, Artificial Sequence
  PCR primer for ORF amplification
tggaagtggttcaggaatggaacatccagcatatacattg

SEQ ID NO: 15358 - DNA, 40 bp, Artificial Sequence
  PCR primer for ORF amplification
tggaagtggttcaggaatgggtctatcatctatctttggc

SEQ ID NO: 15359 - DNA, 40 bp, Artificial Sequence
  PCR primer for ORF amplification
tggaagtggttcaggaatgtccaagagtaatacttatagg

SEQ ID NO: 15360 - DNA, 40 bp, Artificial Sequence
  PCR primer for ORF amplification
tggaagtggttcaggaatgttggcgcgcagtttgggttac

SEQ ID NO: 15361 - DNA, 40 bp, Artificial Sequence
  PCR primer for ORF amplification
tggaagtggttcaggaatgaagtacttagctgcttaccta

SEQ ID NO: 15362 - DNA, 40 bp, Artificial Sequence
  PCR primer for ORF amplification
tggaagtggttcaggaatggcacccacacaattggatata

SEQ ID NO: 15363 - DNA, 40 bp, Artificial Sequence
  PCR primer for ORF amplification
tggaagtggttcaggaatggccaaatcattacgtgctagc

SEQ ID NO: 15364 - DNA, 40 bp, Artificial Sequence
  PCR primer for ORF amplification
tggaagtggttcaggaatgtccacccttttgaagtctgct

SEQ ID NO: 15365 - DNA, 40 bp, Artificial Sequence
  PCR primer for ORF amplification
tggaagtggttcaggaatgtcgaaattgggtccgttagca

SEQ ID NO: 15366 - DNA, 40 bp, Artificial Sequence
  PCR primer for ORF amplification
tggaagtggttcaggaatgtctactgaatccgctttgtct

SEQ ID NO: 15367 - DNA, 40 bp, Artificial Sequence
  PCR primer for ORF amplification
tggaagtggttcaggaatgagtagggctagcaagataacg

SEQ ID NO: 15368 - DNA, 40 bp, Artificial Sequence
  PCR primer for ORF amplification
tggaagtggttcaggaatggtaaacttagctaacgtttta

SEQ ID NO: 15369 - DNA, 40 bp, Artificial Sequence
  PCR primer for ORF amplification
tggaagtggttcaggaatgtcccgccatcagtttgatcta

SEQ ID NO: 15370 - DNA, 40 bp, Artificial Sequence
  PCR primer for ORF amplification
tggaagtggttcaggaatgcctccaaagcaacaattatct

SEQ ID NO: 15371 - DNA, 40 bp, Artificial Sequence
  PCR primer for ORF amplification
tggaagtggttcaggaatgcctccaaagcaacaattgtct

SEQ ID NO: 15372 - DNA, 40 bp, Artificial Sequence
  PCR primer for ORF amplification
tggaagtggttcaggaatgaatactaataagatagcacaa

SEQ ID NO: 15373 - DNA, 40 bp, Artificial Sequence
  PCR primer for ORF amplification
tggaagtggttcaggaatgagctcaaatgaagaggtattt

SEQ ID NO: 15374 - DNA, 40 bp, Artificial Sequence
  PCR primer for ORF amplification
tggaagtggttcaggaatggatatgcttcataataaatgt

SEQ ID NO: 15375 - DNA, 40 bp, Artificial Sequence
  PCR primer for ORF amplification
tggaagtggttcaggaatggtagctagttgtaaagatcag

SEQ ID NO: 15376 - DNA, 40 bp, Artificial Sequence
  PCR primer for ORF amplification
tggaagtggttcaggaatgtccattgagaatctgaaatca

SEQ ID NO: 15377 - DNA, 40 bp, Artificial Sequence
  PCR primer for ORF amplification
tggaagtggttcaggaatgactgaattcaaggccggttct

SEQ ID NO: 15378 - DNA, 40 bp, Artificial Sequence
  PCR primer for ORF amplification
tggaagtggttcaggaatgtcacagatagcacaagaaatg

SEQ ID NO: 15379 - DNA, 40 bp, Artificial Sequence
  PCR primer for ORF amplification
tggaagtggttcaggaatgtcagccaccttgaaagactac

SEQ ID NO: 15380 - DNA, 40 bp, Artificial Sequence
  PCR primer for ORF amplification
tggaagtggttcaggaatgtcgttctttttaaatagtcta

SEQ ID NO: 15381 - DNA, 40 bp, Artificial Sequence
  PCR primer for ORF amplification
tggaagtggttcaggaatgtctgacgcaggtagaaaagga

SEQ ID NO: 15382 - DNA, 40 bp, Artificial Sequence
  PCR primer for ORF amplification
tggaagtggttcaggaatgtctgcctttgttactaaagct

SEQ ID NO: 15383 - DNA, 40 bp, Artificial Sequence
  PCR primer for ORF amplification
tggaagtggttcaggaatgaaatacttagctgcttactta

SEQ ID NO: 15384 - DNA, 40 bp, Artificial Sequence
  PCR primer for ORF amplification
tggaagtggttcaggaatgaacgtaccaaaggcgagactc

SEQ ID NO: 15385 - DNA, 40 bp, Artificial Sequence
  PCR primer for ORF amplification
tggaagtggttcaggaatgacatcagttcaaaactctcca

SEQ ID NO: 15386 - DNA, 40 bp, Artificial Sequence
  PCR primer for ORF amplification
tggaagtggttcaggaatgaccaaagatgccgtgaatcta

SEQ ID NO: 15387 - DNA, 40 bp, Artificial Sequence
  PCR primer for ORF amplification
tggaagtggttcaggaatgctttcgttttgtccttcgtgt

SEQ ID NO: 15388 - DNA, 40 bp, Artificial Sequence
  PCR primer for ORF amplification
tggaagtggttcaggaatggtatctcaagaaactatcaag

SEQ ID NO: 15389 - DNA, 40 bp, Artificial Sequence
  PCR primer for ORF amplification
tggaagtggttcaggaatgttcaagagagcaatgagcaca

SEQ ID NO: 15390 - DNA, 40 bp, Artificial Sequence
  PCR primer for ORF amplification
tggaagtggttcaggaatgtttatcttagtatccgttgta

SEQ ID NO: 15391 - DNA, 40 bp, Artificial Sequence
  PCR primer for ORF amplification
tggaagtggttcaggaatgagccaatttgaaaagcagaag

SEQ ID NO: 15392 - DNA, 40 bp, Artificial Sequence
  PCR primer for ORF amplification
tggaagtggttcaggaatgctaggaagggcattgcgacct

SEQ ID NO: 15393 - DNA, 40 bp, Artificial Sequence
  PCR primer for ORF amplification
tggaagtggttcaggaatggagcaaaacaaagatccgcag

SEQ ID NO: 15394 - DNA, 40 bp, Artificial Sequence
  PCR primer for ORF amplification
tggaagtggttcaggaatggccctgtggggtagaagtgcc

SEQ ID NO: 15395 - DNA, 40 bp, Artificial Sequence
  PCR primer for ORF amplification
tggaagtggttcaggaatgggtctatttaataacttcaag

SEQ ID NO: 15396 - DNA, 40 bp, Artificial Sequence
  PCR primer for ORF amplification
tggaagtggttcaggaatggttgaaccagcaaggaaaaag

SEQ ID NO: 15397 - DNA, 40 bp, Artificial Sequence
  PCR primer for ORF amplification
tggaagtggttcaggaatgtctactgtaaccaaatacttt

SEQ ID NO: 15398 - DNA, 40 bp, Artificial Sequence
  PCR primer for ORF amplification
tggaagtggttcaggaatggattggctgaaaaatacaaca

SEQ ID NO: 15399 - DNA, 40 bp, Artificial Sequence
  PCR primer for ORF amplification
tggaagtggttcaggaatgtatctcagtgcccagcttatg

SEQ ID NO: 15400 - DNA, 40 bp, Artificial Sequence
  PCR primer for ORF amplification
tggaagtggttcaggaatgacaagcaaacgggaaaagtca

SEQ ID NO: 15401 - DNA, 40 bp, Artificial Sequence
  PCR primer for ORF amplification
tggaagtggttcaggaatgacagaggttgtgggattctgg

SEQ ID NO: 15402 - DNA, 40 bp, Artificial Sequence
  PCR primer for ORF amplification
tggaagtggttcaggaatgactgatgagctgaaaagttat

SEQ ID NO: 15403 - DNA, 40 bp, Artificial Sequence
  PCR primer for ORF amplification
tggaagtggttcaggaatgcctcctcttccacaaaattat

SEQ ID NO: 15404 - DNA, 40 bp, Artificial Sequence
  PCR primer for ORF amplification
tggaagtggttcaggaatggctaaagaaagtacgggattc

SEQ ID NO: 15405 - DNA, 40 bp, Artificial Sequence
  PCR primer for ORF amplification
tggaagtggttcaggaatgggagaacaaaacaaattgtac

SEQ ID NO: 15406 - DNA, 40 bp, Artificial Sequence
  PCR primer for ORF amplification
tggaagtggttcaggaatgggcaagtgtagcatgaaaaag

SEQ ID NO: 15407 - DNA, 40 bp, Artificial Sequence
  PCR primer for ORF amplification
tggaagtggttcaggaatgtctgaaattcaaaacaaagct

SEQ ID NO: 15408 - DNA, 40 bp, Artificial Sequence; identical to SEQ ID NO: 15189
  PCR primer for ORF amplification

SEQ ID NO: 15409 - DNA, 40 bp, Artificial Sequence
  PCR primer for ORF amplification
tggaagtggttcaggaatgaaggccagttacttagttttg

SEQ ID NO: 15410 - DNA, 40 bp, Artificial Sequence
  PCR primer for ORF amplification
tggaagtggttcaggaatgagcgcgagtgacaaaacaaag

SEQ ID NO: 15411 - DNA, 40 bp, Artificial Sequence
  PCR primer for ORF amplification
tggaagtggttcaggaatgctttttgaagtatttggtgaa

SEQ ID NO: 15412 - DNA, 40 bp, Artificial Sequence
  PCR primer for ORF amplification
tggaagtggttcaggaatgggcttatcgcgctggcacgac

SEQ ID NO: 15413 - DNA, 40 bp, Artificial Sequence
  PCR primer for ORF amplification
tggaagtggttcaggaatgtctgaagtaattgaaggtaac

SEQ ID NO: 15414 - DNA, 40 bp, Artificial Sequence
  PCR primer for ORF amplification
tggaagtggttcaggaatgtctgaattaggtgccaaatat

SEQ ID NO: 15415 - DNA, 40 bp, Artificial Sequence
  PCR primer for ORF amplification
tggaagtggttcaggaatgttgagagcgttccgctgttct

SEQ ID NO: 15416 - DNA, 40 bp, Artificial Sequence
  PCR primer for ORF amplification
tggaagtggttcaggaatgaaaattagcttgcataacaaa

SEQ ID NO: 15417 - DNA, 40 bp, Artificial Sequence
  PCR primer for ORF amplification
tggaagtggttcaggaatgctaagcaggatccaaaattat

SEQ ID NO: 15418 - DNA, 40 bp, Artificial Sequence
  PCR primer for ORF amplification
tggaagtggttcaggaatgggtaatttcagatttcctata

SEQ ID NO: 15419 - DNA, 40 bp, Artificial Sequence
  PCR primer for ORF amplification
tggaagtggttcaggaatgggtagtttttgggacgcattc

SEQ ID NO: 15420 - DNA, 40 bp, Artificial Sequence
  PCR primer for ORF amplification
tggaagtggttcaggaatgtcgtcatcagtgccatacgat

SEQ ID NO: 15421 - DNA, 40 bp, Artificial Sequence
  PCR primer for ORF amplification
tggaagtggttcaggaatgatcgaaactgccatttatggt

SEQ ID NO: 15422 - DNA, 40 bp, Artificial Sequence
  PCR primer for ORF amplification
tggaagtggttcaggaatgcgctgggatgttatcatctta

SEQ ID NO: 15423 - DNA, 40 bp, Artificial Sequence
  PCR primer for ORF amplification
tggaagtggttcaggaatgtcccaagaaagtagtgtttta

SEQ ID NO: 15424 - DNA, 40 bp, Artificial Sequence
  PCR primer for ORF amplification
tggaagtggttcaggaatgttactcacaccagccaagact

SEQ ID NO: 15425 - DNA, 40 bp, Artificial Sequence
  PCR primer for ORF amplification
tggaagtggttcaggaatgaagtctacatttaagtctgaa

SEQ ID NO: 15426 - DNA, 40 bp, Artificial Sequence
  PCR primer for ORF amplification
tggaagtggttcaggaatggatggatcgactatagtgttt

SEQ ID NO: 15427 - DNA, 40 bp, Artificial Sequence
  PCR primer for ORF amplification
tggaagtggttcaggaatgaagctcccacagaccatgcta

SEQ ID NO: 15428 - DNA, 40 bp, Artificial Sequence
  PCR primer for ORF amplification
tggaagtggttcaggaatgagacccgttgtatccactggt

SEQ ID NO: 15429 - DNA, 40 bp, Artificial Sequence
  PCR primer for ORF amplification
tggaagtggttcaggaatgagtaatattttggcagtgttc

SEQ ID NO: 15430 - DNA, 40 bp, Artificial Sequence
  PCR primer for ORF amplification
tggaagtggttcaggaatgcagacaatgggcggggagcac

SEQ ID NO: 15431 - DNA, 40 bp, Artificial Sequence
  PCR primer for ORF amplification
tggaagtggttcaggaatgcagcacacgcttacccggacc

SEQ ID NO: 15432 - DNA, 40 bp, Artificial Sequence
  PCR primer for ORF amplification
tggaagtggttcaggaatggctgagaaacgtactcttata

SEQ ID NO: 15433 - DNA, 40 bp, Artificial Sequence
  PCR primer for ORF amplification
tggaagtggttcaggaatgtcgttcagcggaaaaaaattt

SEQ ID NO: 15434 - DNA, 40 bp, Artificial Sequence
  PCR primer for ORF amplification
tggaagtggttcaggaatgaaaaatattgcatacgaaggt

SEQ ID NO: 15435 - DNA, 40 bp, Artificial Sequence
  PCR primer for ORF amplification
tggaagtggttcaggaatgccaaaaaagagagcttccaac

SEQ ID NO: 15436 - DNA, 40 bp, Artificial Sequence
  PCR primer for ORF amplification
tggaagtggttcaggaatgccaaagaagagagcttccaac

SEQ ID NO: 15437 - DNA, 40 bp, Artificial Sequence
  PCR primer for ORF amplification
tggaagtggttcaggaatgcgcagcatagaaaacgataga

SEQ ID NO: 15438 - DNA, 40 bp, Artificial Sequence
  PCR primer for ORF amplification
tggaagtggttcaggaatggaaaaaaaaaaaattttagac

SEQ ID NO: 15439 - DNA, 40 bp, Artificial Sequence
  PCR primer for ORF amplification
tggaagtggttcaggaatgaactatttggaaacacagtta

SEQ ID NO: 15440 - DNA, 40 bp, Artificial Sequence
  PCR primer for ORF amplification
tggaagtggttcaggaatgagaccagcacagttactgttg

SEQ ID NO: 15441 - DNA, 40 bp, Artificial Sequence
  PCR primer for ORF amplification
tggaagtggttcaggaatggtcaaactaacttcaatcgcc

SEQ ID NO: 15442 - DNA, 40 bp, Artificial Sequence
  PCR primer for ORF amplification
tggaagtggttcaggaatggtcaaactaacttcaatcgct

SEQ ID NO: 15443 - DNA, 40 bp, Artificial Sequence
  PCR primer for ORF amplification
tggaagtggttcaggaatggtcaaattaacttcaatcgcc

SEQ ID NO: 15444 - DNA, 40 bp, Artificial Sequence; identical to SEQ ID NO: 15120
  PCR primer for ORF amplification

SEQ ID NO: 15445 - DNA, 40 bp, Artificial Sequence; identical to SEQ ID NO: 15120
  PCR primer for ORF amplification

SEQ ID NO: 15446 - DNA, 40 bp, Artificial Sequence; identical to SEQ ID NO: 15120
  PCR primer for ORF amplification

SEQ ID NO: 15447 - DNA, 40 bp, Artificial Sequence
  PCR primer for ORF amplification
tggaagtggttcaggaatggtcaaattaacttcaattgcc

SEQ ID NO: 15448 - DNA, 40 bp, Artificial Sequence
  PCR primer for ORF amplification
tggaagtggttcaggaatgaaattcatttctacctttctc

SEQ ID NO: 15449 - DNA, 40 bp, Artificial Sequence
  PCR primer for ORF amplification
tggaagtggttcaggaatgaatgctccagacagattcgaa

SEQ ID NO: 15450 - DNA, 40 bp, Artificial Sequence
  PCR primer for ORF amplification
tggaagtggttcaggaatgacaggtgaaagaattgaaaag

SEQ ID NO: 15451 - DNA, 40 bp, Artificial Sequence
  PCR primer for ORF amplification
tggaagtggttcaggaatgcacaacaagattgttagaatc

SEQ ID NO: 15452 - DNA, 40 bp, Artificial Sequence
  PCR primer for ORF amplification
tggaagtggttcaggaatgcctaaagtttacagttaccaa

SEQ ID NO: 15453 - DNA, 40 bp, Artificial Sequence
  PCR primer for ORF amplification
tggaagtggttcaggaatggtgaatgaaacaggagaaagt

SEQ ID NO: 15454 - DNA, 40 bp, Artificial Sequence
  PCR primer for ORF amplification
tggaagtggttcaggaatgacctgtggtctagtacgaata

SEQ ID NO: 15455 - DNA, 40 bp, Artificial Sequence
  PCR primer for ORF amplification
tggaagtggttcaggaatgagcaaccaggcactatatgag

SEQ ID NO: 15456 - DNA, 40 bp, Artificial Sequence
  PCR primer for ORF amplification
tggaagtggttcaggaatgagcaacgaagttgacaggatg

SEQ ID NO: 15457 - DNA, 40 bp, Artificial Sequence
  PCR primer for ORF amplification
tggaagtggttcaggaatgtccactaagttgcctattgtg

SEQ ID NO: 15458 - DNA, 40 bp, Artificial Sequence
  PCR primer for ORF amplification
tggaagtggttcaggaatgtctgactttcaaaaggaaaag

SEQ ID NO: 15459 - DNA, 40 bp, Artificial Sequence
  PCR primer for ORF amplification
tggaagtggttcaggaatgtctgatattttggatgagatt

SEQ ID NO: 15460 - DNA, 40 bp, Artificial Sequence
  PCR primer for ORF amplification
tggaagtggttcaggaatgaaagtttccgataggcgtaag

SEQ ID NO: 15461 - DNA, 40 bp, Artificial Sequence; identical to SEQ ID NO: 15460
  PCR primer for ORF amplification

SEQ ID NO: 15462 - DNA, 40 bp, Artificial Sequence; identical to SEQ ID NO: 15443
  PCR primer for ORF amplification

SEQ ID NO: 15463 - DNA, 40 bp, Artificial Sequence
  PCR primer for ORF amplification
tggaagtggttcaggaatgactacgtttagattttgtcgt

SEQ ID NO: 15464 - DNA, 40 bp, Artificial Sequence
  PCR primer for ORF amplification
tggaagtggttcaggaatgcaagacaactcaagtcattcc

SEQ ID NO: 15465 - DNA, 40 bp, Artificial Sequence
  PCR primer for ORF amplification
tggaagtggttcaggaatggcagtacccgggtattacgaa

SEQ ID NO: 15466 - DNA, 40 bp, Artificial Sequence
  PCR primer for ORF amplification
tggaagtggttcaggaatggccaatttttttgttagactg

SEQ ID NO: 15467 - DNA, 40 bp, Artificial Sequence
  PCR primer for ORF amplification
tggaagtggttcaggaatggccagcgaaacaccaagagtt

SEQ ID NO: 15468 - DNA, 40 bp, Artificial Sequence
  PCR primer for ORF amplification
tggaagtggttcaggaatgggtgaaatgctagagaggcaa

SEQ ID NO: 15469 - DNA, 40 bp, Artificial Sequence
  PCR primer for ORF amplification
tggaagtggttcaggaatgttccttacattctcaatgtgt

SEQ ID NO: 15470 - DNA, 40 bp, Artificial Sequence; identical to SEQ ID NO: 15120
  PCR primer for ORF amplification

SEQ ID NO: 15471 - DNA, 40 bp, Artificial Sequence
  PCR primer for ORF amplification
tggaagtggttcaggaatgaaactaccggtagcacagtac

SEQ ID NO: 15472 - DNA, 40 bp, Artificial Sequence
  PCR primer for ORF amplification
tggaagtggttcaggaatgaacgtaactgaaaatgctcta

SEQ ID NO: 15473 - DNA, 40 bp, Artificial Sequence
  PCR primer for ORF amplification
tggaagtggttcaggaatgagcacgagaacaaaggccctg

SEQ ID NO: 15474 - DNA, 40 bp, Artificial Sequence
  PCR primer for ORF amplification
tggaagtggttcaggaatgatgggacgaaacggtattcgg

SEQ ID NO: 15475 - DNA, 40 bp, Artificial Sequence
  PCR primer for ORF amplification
tggaagtggttcaggaatgattgctacacctataagatta

SEQ ID NO: 15476 - DNA, 40 bp, Artificial Sequence
  PCR primer for ORF amplification
tggaagtggttcaggaatggatcaaaagaaggacccaagt

SEQ ID NO: 15477 - DNA, 40 bp, Artificial Sequence
  PCR primer for ORF amplification
tggaagtggttcaggaatgtcttggaggtactctatcttg

SEQ ID NO: 15478 - DNA, 40 bp, Artificial Sequence
  PCR primer for ORF amplification
tggaagtggttcaggaatggtcaaactaacttcaattgtt

SEQ ID NO: 15479 - DNA, 40 bp, Artificial Sequence; identical to SEQ ID NO: 15120
  PCR primer for ORF amplification

SEQ ID NO: 15480 - DNA, 40 bp, Artificial Sequence; identical to SEQ ID NO: 15120
  PCR primer for ORF amplification

SEQ ID NO: 15481 - DNA, 40 bp, Artificial Sequence; identical to SEQ ID NO: 15120
  PCR primer for ORF amplification

SEQ ID NO: 15482 - DNA, 40 bp, Artificial Sequence
  PCR primer for ORF amplification
tggaagtggttcaggaatggtcaaattaacttcaattgct

SEQ ID NO: 15483 - DNA, 40 bp, Artificial Sequence
  PCR primer for ORF amplification
tggaagtggttcaggaatgatcagaagggcccctaccacc

SEQ ID NO: 15484 - DNA, 40 bp, Artificial Sequence
  PCR primer for ORF amplification
tggaagtggttcaggaatgcgaccacatcattttttttgt

SEQ ID NO: 15485 - DNA, 40 bp, Artificial Sequence
  PCR primer for ORF amplification
tggaagtggttcaggaatgcgagattcccctacccacaag

SEQ ID NO: 15486 - DNA, 40 bp, Artificial Sequence
  PCR primer for ORF amplification
tggaagtggttcaggaatgttccctatcgcttccagaaga

SEQ ID NO: 15487 - DNA, 40 bp, Artificial Sequence
  PCR primer for ORF amplification
tggaagtggttcaggaatgcctagtaaagatccagagagc

SEQ ID NO: 15488 - DNA, 40 bp, Artificial Sequence
  PCR primer for ORF amplification
tggaagtggttcaggaatggttctaaccgatgccgaagaa

SEQ ID NO: 15489 - DNA, 40 bp, Artificial Sequence
  PCR primer for ORF amplification
tggaagtggttcaggaatgtctctcgactttaacactttg

SEQ ID NO: 15490 - DNA, 40 bp, Artificial Sequence
  PCR primer for ORF amplification
tggaagtggttcaggaatgtctgttgtaggatcgttaatt

SEQ ID NO: 15491 - DNA, 40 bp, Artificial Sequence
  PCR primer for ORF amplification
tggaagtggttcaggaatgtttagatccgtttgccgcatt

SEQ ID NO: 15492 - DNA, 40 bp, Artificial Sequence
  PCR primer for ORF amplification
tggaagtggttcaggaatggtacagctgagaagaacgtat

SEQ ID NO: 15493 - DNA, 40 bp, Artificial Sequence
  PCR primer for ORF amplification
tggaagtggttcaggaatggtatgttacgttctattgcgc

SEQ ID NO: 15494 - DNA, 40 bp, Artificial Sequence
  PCR primer for ORF amplification
tggaagtggttcaggaatgacaggttactttttaccacca

SEQ ID NO: 15495 - DNA, 40 bp, Artificial Sequence
  PCR primer for ORF amplification
tggaagtggttcaggaatgagtatgcagattgaaataaag

SEQ ID NO: 15496 - DNA, 40 bp, Artificial Sequence
  PCR primer for ORF amplification
tggaagtggttcaggaatggcaggtgaagcagtttcggaa

SEQ ID NO: 15497 - DNA, 40 bp, Artificial Sequence
  PCR primer for ORF amplification
tggaagtggttcaggaatgtctgccccaaacccaaaggct

SEQ ID NO: 15498 - DNA, 40 bp, Artificial Sequence
  PCR primer for ORF amplification
tggaagtggttcaggaatgtttgaatcgtttgttaatgaa

SEQ ID NO: 15499 - DNA, 40 bp, Artificial Sequence
  PCR primer for ORF amplification
tggaagtggttcaggaatgttttatctaagtgacatcgag

SEQ ID NO: 15500 - DNA, 40 bp, Artificial Sequence
  PCR primer for ORF amplification
tggaagtggttcaggaatgatcccagctccacttgatgct

SEQ ID NO: 15501 - DNA, 40 bp, Artificial Sequence
  PCR primer for ORF amplification
tggaagtggttcaggaatgatctgttatttccttgttgta

SEQ ID NO: 15502 - DNA, 40 bp, Artificial Sequence
  PCR primer for ORF amplification
tggaagtggttcaggaatgccacagtcttttacgtctatt

SEQ ID NO: 15503 - DNA, 40 bp, Artificial Sequence
  PCR primer for ORF amplification
tggaagtggttcaggaatgtcaagcactaatggaaacgca

SEQ ID NO: 15504 - DNA, 40 bp, Artificial Sequence
  PCR primer for ORF amplification
tggaagtggttcaggaatgtcactacaaagcaacagtgta

SEQ ID NO: 15505 - DNA, 40 bp, Artificial Sequence
  PCR primer for ORF amplification
tggaagtggttcaggaatgtcttcaaactatgccactcct

SEQ ID NO: 15506 - DNA, 40 bp, Artificial Sequence
  PCR primer for ORF amplification
tggaagtggttcaggaatgttgttctataagcctgtgatg

SEQ ID NO: 15507 - DNA, 40 bp, Artificial Sequence
  PCR primer for ORF amplification
tggaagtggttcaggaatgaacagtgctaccagtgagaca

SEQ ID NO: 15508 - DNA, 40 bp, Artificial Sequence
  PCR primer for ORF amplification
tggaagtggttcaggaatgatcaccccaaagggaacgcac

SEQ ID NO: 15509 - DNA, 40 bp, Artificial Sequence
  PCR primer for ORF amplification
tggaagtggttcaggaatggcaacgacagatatcatatct

SEQ ID NO: 15510 - DNA, 40 bp, Artificial Sequence
  PCR primer for ORF amplification
tggaagtggttcaggaatgtctgctaacgattactacggc

SEQ ID NO: 15511 - DNA, 40 bp, Artificial Sequence
  PCR primer for ORF amplification
tggaagtggttcaggaatgagattacttcaccatggtgaa

SEQ ID NO: 15512 - DNA, 40 bp, Artificial Sequence
  PCR primer for ORF amplification
tggaagtggttcaggaatgatatatcccttattcaggata

SEQ ID NO: 15513 - DNA, 40 bp, Artificial Sequence
  PCR primer for ORF amplification
tggaagtggttcaggaatggaactgttaccacagggacaa

SEQ ID NO: 15514 - DNA, 40 bp, Artificial Sequence
  PCR primer for ORF amplification
tggaagtggttcaggaatggtcaccacgctaactcccgtt

SEQ ID NO: 15515 - DNA, 40 bp, Artificial Sequence
  PCR primer for ORF amplification
tggaagtggttcaggaatggtcgaaggtgattttgtcgat

SEQ ID NO: 15516 - DNA, 40 bp, Artificial Sequence
  PCR primer for ORF amplification
tggaagtggttcaggaatgtctacatcatccgtacgtttt

SEQ ID NO: 15517 - DNA, 40 bp, Artificial Sequence
  PCR primer for ORF amplification
tggaagtggttcaggaatgtctgaagtagcggaaacatgg

SEQ ID NO: 15518 - DNA, 40 bp, Artificial Sequence
  PCR primer for ORF amplification
tggaagtggttcaggaatgtcttcagcaccattattacaa

SEQ ID NO: 15519 - DNA, 40 bp, Artificial Sequence
  PCR primer for ORF amplification
tggaagtggttcaggaatgtttagacagtgtgctaagaga

SEQ ID NO: 15520 - DNA, 40 bp, Artificial Sequence
  PCR primer for ORF amplification
tggaagtggttcaggaatgaccagatcttccgttttagct

SEQ ID NO: 15521 - DNA, 40 bp, Artificial Sequence
  PCR primer for ORF amplification
tggaagtggttcaggaatgataccttcccggattagccac

SEQ ID NO: 15522 - DNA, 40 bp, Artificial Sequence
  PCR primer for ORF amplification
tggaagtggttcaggaatggaagacacgatacgtccatta

SEQ ID NO: 15523 - DNA, 40 bp, Artificial Sequence
  PCR primer for ORF amplification
tggaagtggttcaggaatggcaaaagcaccaaaggcaaac

SEQ ID NO: 15524 - DNA, 40 bp, Artificial Sequence
  PCR primer for ORF amplification
tggaagtggttcaggaatggcctccttacctcacccaaag

SEQ ID NO: 15525 - DNA, 40 bp, Artificial Sequence
  PCR primer for ORF amplification
tggaagtggttcaggaatggtaagtttcataacgtctagg

SEQ ID NO: 15526 - DNA, 40 bp, Artificial Sequence
  PCR primer for ORF amplification
tggaagtggttcaggaatgtctcaaccggttcaacgcgct

SEQ ID NO: 15527 - DNA, 40 bp, Artificial Sequence
  PCR primer for ORF amplification
tggaagtggttcaggaatgagtagtttgtatgtgtcataa

SEQ ID NO: 15528 - DNA, 40 bp, Artificial Sequence
  PCR primer for ORF amplification
tggaagtggttcaggaatgagtcaaagtcgctggagtatc

SEQ ID NO: 15529 - DNA, 40 bp, Artificial Sequence
  PCR primer for ORF amplification
tggaagtggttcaggaatgcacatatcgctccctacgaga

SEQ ID NO: 15530 - DNA, 40 bp, Artificial Sequence
  PCR primer for ORF amplification
tggaagtggttcaggaatgcaggttctcaatacgaagagt

SEQ ID NO: 15531 - DNA, 40 bp, Artificial Sequence
  PCR primer for ORF amplification
tggaagtggttcaggaatgctttatgagctgatcggactt

SEQ ID NO: 15532 - DNA, 40 bp, Artificial Sequence
  PCR primer for ORF amplification
tggaagtggttcaggaatgtcagaggatctttcacctaca

SEQ ID NO: 15533 - DNA, 40 bp, Artificial Sequence
  PCR primer for ORF amplification
tggaagtggttcaggaatgtcctctgccgccgaaaagaaa

SEQ ID NO: 15534 - DNA, 40 bp, Artificial Sequence
  PCR primer for ORF amplification
tggaagtggttcaggaatgtctattgtgctacggaagagt

SEQ ID NO: 15535 - DNA, 40 bp, Artificial Sequence
  PCR primer for ORF amplification
tggaagtggttcaggaatgtctgctaaagccgaaaagaaa

SEQ ID NO: 15536 - DNA, 40 bp, Artificial Sequence
  PCR primer for ORF amplification
tggaagtggttcaggaatgtttggcccattcaaattaaca

SEQ ID NO: 15537 - DNA, 40 bp, Artificial Sequence
  PCR primer for ORF amplification
tggaagtggttcaggaatgtccggtggtaaaggtggtaaa

SEQ ID NO: 15538 - DNA, 40 bp, Artificial Sequence; identical to SEQ ID NO: 15537
  PCR primer for ORF amplification

SEQ ID NO: 15539 - DNA, 40 bp, Artificial Sequence
  PCR primer for ORF amplification
tggaagtggttcaggaatggattgcccctcaaacgttgtg

SEQ ID NO: 15540 - DNA, 40 bp, Artificial Sequence
  PCR primer for ORF amplification
tggaagtggttcaggaatggttacaattggtagttcctcc

SEQ ID NO: 15541 - DNA, 40 bp, Artificial Sequence
  PCR primer for ORF amplification
tggaagtggttcaggaatggtttttgttttccccttccca

SEQ ID NO: 15542 - DNA, 40 bp, Artificial Sequence
  PCR primer for ORF amplification
tggaagtggttcaggaatgaacaacaagctcatatatcgt

SEQ ID NO: 15543 - DNA, 40 bp, Artificial Sequence
  PCR primer for ORF amplification
tggaagtggttcaggaatgacagcaatgaaagaagacaac

SEQ ID NO: 15544 - DNA, 40 bp, Artificial Sequence
  PCR primer for ORF amplification
tggaagtggttcaggaatgcaattttctactgtcgcttct

SEQ ID NO: 15545 - DNA, 40 bp, Artificial Sequence
  PCR primer for ORF amplification
tggaagtggttcaggaatgcctagtgtagatatagatgct

SEQ ID NO: 15546 - DNA, 40 bp, Artificial Sequence
  PCR primer for ORF amplification
tggaagtggttcaggaatggacagagaccatattaatgac

SEQ ID NO: 15547 - DNA, 40 bp, Artificial Sequence
  PCR primer for ORF amplification
tggaagtggttcaggaatggacgcacaactggaatgggca

SEQ ID NO: 15548 - DNA, 40 bp, Artificial Sequence
  PCR primer for ORF amplification
tggaagtggttcaggaatggattcaatagatgaacaaatt

SEQ ID NO: 15549 - DNA, 40 bp, Artificial Sequence
  PCR primer for ORF amplification
tggaagtggttcaggaatgtcgttttggaaaacattgcag

SEQ ID NO: 15550 - DNA, 40 bp, Artificial Sequence
  PCR primer for ORF amplification
tggaagtggttcaggaatgtcaggaaaagctcatggaggt

SEQ ID NO: 15551 - DNA, 40 bp, Artificial Sequence
  PCR primer for ORF amplification
tggaagtggttcaggaatgtttggtaaagttttcgtaagc

SEQ ID NO: 15552 - DNA, 40 bp, Artificial Sequence
  PCR primer for ORF amplification
tggaagtggttcaggaatgaagttcttaaccaccaacttc

SEQ ID NO: 15553 - DNA, 40 bp, Artificial Sequence
  PCR primer for ORF amplification
tggaagtggttcaggaatgatgtttaatatttaccttttc

SEQ ID NO: 15554 - DNA, 40 bp, Artificial Sequence
  PCR primer for ORF amplification
tggaagtggttcaggaatgtcgtacaacggaatagggctc

SEQ ID NO: 15555 - DNA, 40 bp, Artificial Sequence
  PCR primer for ORF amplification
tggaagtggttcaggaatgacttatgaacaattatacgta

SEQ ID NO: 15556 - DNA, 40 bp, Artificial Sequence
  PCR primer for ORF amplification
tggaagtggttcaggaatgtcagctcaagattattacgga

SEQ ID NO: 15557 - DNA, 40 bp, Artificial Sequence
  PCR primer for ORF amplification
tggaagtggttcaggaatggccagaacaaagcaaacagca

SEQ ID NO: 15558 - DNA, 40 bp, Artificial Sequence
  PCR primer for ORF amplification
tggaagtggttcaggaatggccagaactaaacaaacagct

SEQ ID NO: 15559 - DNA, 40 bp, Artificial Sequence
  PCR primer for ORF amplification
tggaagtggttcaggaatgggagaaattttagaactaact

SEQ ID NO: 15560 - DNA, 40 bp, Artificial Sequence
  PCR primer for ORF amplification
tggaagtggttcaggaatgtcctctgtggaatcttccccc

SEQ ID NO: 15561 - DNA, 40 bp, Artificial Sequence
  PCR primer for ORF amplification
tggaagtggttcaggaatgatgaaaggttctagaagaaca

SEQ ID NO: 15562 - DNA, 40 bp, Artificial Sequence
  PCR primer for ORF amplification
tggaagtggttcaggaatggtagcatcatcgatcaatgaa

SEQ ID NO: 15563 - DNA, 40 bp, Artificial Sequence
  PCR primer for ORF amplification
tggaagtggttcaggaatggtatgttggtgtgtgtgtgtg

SEQ ID NO: 15564 - DNA, 40 bp, Artificial Sequence
  PCR primer for ORF amplification
tggaagtggttcaggaatgtcatacggcggatcggcatcc

SEQ ID NO: 15565 - DNA, 40 bp, Artificial Sequence
  PCR primer for ORF amplification
tggaagtggttcaggaatgtctaaggttgcacaacagtta

SEQ ID NO: 15566 - DNA, 40 bp, Artificial Sequence
  PCR primer for ORF amplification
tggaagtggttcaggaatgcatccacagttagaagctgaa

SEQ ID NO: 15567 - DNA, 40 bp, Artificial Sequence
  PCR primer for ORF amplification
tggaagtggttcaggaatgcttttcttctcctttttcaag

SEQ ID NO: 15568 - DNA, 40 bp, Artificial Sequence
  PCR primer for ORF amplification
tggaagtggttcaggaatgatatttctaaaatctgtcatc

SEQ ID NO: 15569 - DNA, 40 bp, Artificial Sequence
  PCR primer for ORF amplification
tggaagtggttcaggaatgatggtaacgcgcaaacactac

SEQ ID NO: 15570 - DNA, 40 bp, Artificial Sequence
  PCR primer for ORF amplification
tggaagtggttcaggaatgcaacctatcatcaagggagca

SEQ ID NO: 15571 - DNA, 40 bp, Artificial Sequence
  PCR primer for ORF amplification
tggaagtggttcaggaatggacgctactcaaccgcaatac

SEQ ID NO: 15572 - DNA, 40 bp, Artificial Sequence
  PCR primer for ORF amplification
tggaagtggttcaggaatgggattgcgttactccatatat

SEQ ID NO: 15573 - DNA, 40 bp, Artificial Sequence
  PCR primer for ORF amplification
tggaagtggttcaggaatgggtgcttggttatttatcctt

SEQ ID NO: 15574 - DNA, 40 bp, Artificial Sequence
  PCR primer for ORF amplification
tggaagtggttcaggaatgttgtgcgccatcaaaagcaca

SEQ ID NO: 15575 - DNA, 40 bp, Artificial Sequence
  PCR primer for ORF amplification
tggaagtggttcaggaatgaaaaaagaaaaaaaaactccg

SEQ ID NO: 15576 - DNA, 40 bp, Artificial Sequence
  PCR primer for ORF amplification
tggaagtggttcaggaatgctacattgcacccaggtgtgt

SEQ ID NO: 15577 - DNA, 40 bp, Artificial Sequence
  PCR primer for ORF amplification
tggaagtggttcaggaatgtggaaggccgtgatgaatgct

SEQ ID NO: 15578 - DNA, 40 bp, Artificial Sequence
  PCR primer for ORF amplification
tggaagtggttcaggaatgacagatagattaacacaattg

SEQ ID NO: 15579 - DNA, 40 bp, Artificial Sequence
  PCR primer for ORF amplification
tggaagtggttcaggaatgatggaattcaaagtgtcacca

SEQ ID NO: 15580 - DNA, 40 bp, Artificial Sequence
  PCR primer for ORF amplification
tggaagtggttcaggaatgccctctctgcgagatttatca

SEQ ID NO: 15581 - DNA, 40 bp, Artificial Sequence
  PCR primer for ORF amplification
tggaagtggttcaggaatggcactcaaaaagaatacacac

SEQ ID NO: 15582 - DNA, 40 bp, Artificial Sequence
  PCR primer for ORF amplification
tggaagtggttcaggaatggggctttgcggaagtaaaacc

SEQ ID NO: 15583 - DNA, 40 bp, Artificial Sequence
  PCR primer for ORF amplification
tggaagtggttcaggaatggttgtgaaagctattgcacga

SEQ ID NO: 15584 - DNA, 40 bp, Artificial Sequence
  PCR primer for ORF amplification
tggaagtggttcaggaatgtatacaaaagagtactactgg

SEQ ID NO: 15585 - DNA, 40 bp, Artificial Sequence
  PCR primer for ORF amplification
tggaagtggttcaggaatgtcgtatgtttgatcttaacca

SEQ ID NO: 15586 - DNA, 40 bp, Artificial Sequence
  PCR primer for ORF amplification
tggaagtggttcaggaatgtgttgctactgtgtttgttgt

SEQ ID NO: 15587 - DNA, 40 bp, Artificial Sequence
  PCR primer for ORF amplification
tggaagtggttcaggaatggaacaaaggaacaacggtatg

SEQ ID NO: 15588 - DNA, 40 bp, Artificial Sequence
  PCR primer for ORF amplification
tggaagtggttcaggaatgaacattaagactttgtgtcat

SEQ ID NO: 15589 - DNA, 40 bp, Artificial Sequence
  PCR primer for ORF amplification
tggaagtggttcaggaatgctcatcgatcaaatcgtggca

SEQ ID NO: 15590 - DNA, 40 bp, Artificial Sequence
  PCR primer for ORF amplification
tggaagtggttcaggaatgtcgaatacttgggacgatgta

SEQ ID NO: 15591 - DNA, 40 bp, Artificial Sequence
  PCR primer for ORF amplification
tggaagtggttcaggaatgtcgtttgtttccaagcttctc

SEQ ID NO: 15592 - DNA, 40 bp, Artificial Sequence
  PCR primer for ORF amplification
tggaagtggttcaggaatgaaagtaggtggcatagaagac

SEQ ID NO: 15593 - DNA, 40 bp, Artificial Sequence
  PCR primer for ORF amplification
tggaagtggttcaggaatgactgaagacatcgaacaaaaa

SEQ ID NO: 15594 - DNA, 40 bp, Artificial Sequence
  PCR primer for ORF amplification
tggaagtggttcaggaatgcggttaattttcattgcgaaa

SEQ ID NO: 15595 - DNA, 40 bp, Artificial Sequence
  PCR primer for ORF amplification
tggaagtggttcaggaatggcagatcaagtaccagttaca

SEQ ID NO: 15596 - DNA, 40 bp, Artificial Sequence
  PCR primer for ORF amplification
tggaagtggttcaggaatggcgtataatcaagaagatagt

SEQ ID NO: 15597 - DNA, 40 bp, Artificial Sequence
  PCR primer for ORF amplification
tggaagtggttcaggaatgtcaggaaccggattatcgcta

SEQ ID NO: 15598 - DNA, 40 bp, Artificial Sequence
  PCR primer for ORF amplification
tggaagtggttcaggaatgtctcaagctgttaatgccaag

SEQ ID NO: 15599 - DNA, 40 bp, Artificial Sequence
  PCR primer for ORF amplification
tggaagtggttcaggaatggctaggcatttcggtatggcc

SEQ ID NO: 15600 - DNA, 40 bp, Artificial Sequence
  PCR primer for ORF amplification
tggaagtggttcaggaatgagcaaggctacgtgttccttt

SEQ ID NO: 15601 - DNA, 40 bp, Artificial Sequence
  PCR primer for ORF amplification
tggaagtggttcaggaatggagaccaatttttccttcgac

SEQ ID NO: 15602 - DNA, 40 bp, Artificial Sequence
  PCR primer for ORF amplification
tggaagtggttcaggaatggctagtgttttgttgcctcaa

SEQ ID NO: 15603 - DNA, 40 bp, Artificial Sequence
  PCR primer for ORF amplification
tggaagtggttcaggaatgggcaaaaaccatttcttgaag

SEQ ID NO: 15604 - DNA, 40 bp, Artificial Sequence
  PCR primer for ORF amplification
tggaagtggttcaggaatggtcgttcacatcttgggtaaa

SEQ ID NO: 15605 - DNA, 40 bp, Artificial Sequence
  PCR primer for ORF amplification
tggaagtggttcaggaatgtcagttattcctccaaaattc

SEQ ID NO: 15606 - DNA, 40 bp, Artificial Sequence
  PCR primer for ORF amplification
tggaagtggttcaggaatgtctgacgttgaagaagtcgtt

SEQ ID NO: 15607 - DNA, 40 bp, Artificial Sequence; identical to SEQ ID NO: 15227
  PCR primer for ORF amplification

SEQ ID NO: 15608 - DNA, 40 bp, Artificial Sequence
  PCR primer for ORF amplification
tggaagtggttcaggaatgaataccaacgagtccgaacat

SEQ ID NO: 15609 - DNA, 40 bp, Artificial Sequence
  PCR primer for ORF amplification
tggaagtggttcaggaatgaccatattttctaggttctca

SEQ ID NO: 15610 - DNA, 40 bp, Artificial Sequence
  PCR primer for ORF amplification
tggaagtggttcaggaatgactttggcttttacgaccttc

SEQ ID NO: 15611 - DNA, 40 bp, Artificial Sequence
  PCR primer for ORF amplification
tggaagtggttcaggaatgggcaagaaagcacacggagga

SEQ ID NO: 15612 - DNA, 40 bp, Artificial Sequence
  PCR primer for ORF amplification
tggaagtggttcaggaatggtttcgaagaaaaatacggct

SEQ ID NO: 15613 - DNA, 40 bp, Artificial Sequence
  PCR primer for ORF amplification
tggaagtggttcaggaatgtcaaattctaggtattctcag

SEQ ID NO: 15614 - DNA, 40 bp, Artificial Sequence
  PCR primer for ORF amplification
tggaagtggttcaggaatggacccagagttacaagctatt

SEQ ID NO: 15615 - DNA, 40 bp, Artificial Sequence
  PCR primer for ORF amplification
tggaagtggttcaggaatggatagaaatgtatatgaagcc

SEQ ID NO: 15616 - DNA, 40 bp, Artificial Sequence
  PCR primer for ORF amplification
tggaagtggttcaggaatgggtaaaagaaagaagtcaaca

SEQ ID NO: 15617 - DNA, 40 bp, Artificial Sequence
  PCR primer for ORF amplification
tggaagtggttcaggaatgggttccgagacaaaacattct

SEQ ID NO: 15618 - DNA, 40 bp, Artificial Sequence
  PCR primer for ORF amplification
tggaagtggttcaggaatgtttttaagaaattccgttttg

SEQ ID NO: 15619 - DNA, 40 bp, Artificial Sequence
  PCR primer for ORF amplification
tggaagtggttcaggaatgaaaggctcacccatttctcaa

SEQ ID NO: 15620 - DNA, 40 bp, Artificial Sequence
  PCR primer for ORF amplification
tggaagtggttcaggaatgaagttggttaactttttaaaa

SEQ ID NO: 15621 - DNA, 40 bp, Artificial Sequence
  PCR primer for ORF amplification
tggaagtggttcaggaatgactatggatactgcgcaatta

SEQ ID NO: 15622 - DNA, 40 bp, Artificial Sequence
  PCR primer for ORF amplification
tggaagtggttcaggaatgatagatttatacaattactct

SEQ ID NO: 15623 - DNA, 40 bp, Artificial Sequence
  PCR primer for ORF amplification
tggaagtggttcaggaatgatcagttcgtgtgttactaga

SEQ ID NO: 15624 - DNA, 40 bp, Artificial Sequence
  PCR primer for ORF amplification
tggaagtggttcaggaatggcaaatactggctgtttatca

SEQ ID NO: 15625 - DNA, 40 bp, Artificial Sequence
  PCR primer for ORF amplification
tggaagtggttcaggaatggttttgcctataataattggt

SEQ ID NO: 15626 - DNA, 40 bp, Artificial Sequence
  PCR primer for ORF amplification
tggaagtggttcaggaatgtcagcatcagcttttaatttt

SEQ ID NO: 15627 - DNA, 40 bp, Artificial Sequence
  PCR primer for ORF amplification
tggaagtggttcaggaatgtctaacactctatttgatgat

SEQ ID NO: 15628 - DNA, 40 bp, Artificial Sequence
  PCR primer for ORF amplification
tggaagtggttcaggaatgtctacttttaatgcagaaacc

SEQ ID NO: 15629 - DNA, 40 bp, Artificial Sequence
  PCR primer for ORF amplification
tggaagtggttcaggaatgactgctactagcgacaaagta

SEQ ID NO: 15630 - DNA, 40 bp, Artificial Sequence
  PCR primer for ORF amplification
tggaagtggttcaggaatgataactaaatacttcagtaag

SEQ ID NO: 15631 - DNA, 40 bp, Artificial Sequence
  PCR primer for ORF amplification
tggaagtggttcaggaatgcatcagcaacactccgtatgt

SEQ ID NO: 15632 - DNA, 40 bp, Artificial Sequence
  PCR primer for ORF amplification
tggaagtggttcaggaatgctggcacaaacattcaaaaaa

SEQ ID NO: 15633 - DNA, 40 bp, Artificial Sequence
  PCR primer for ORF amplification
tggaagtggttcaggaatggcagtacagtttatactgtgc

SEQ ID NO: 15634 - DNA, 40 bp, Artificial Sequence
  PCR primer for ORF amplification
tggaagtggttcaggaatgggaattattacactatccggc

SEQ ID NO: 15635 - DNA, 40 bp, Artificial Sequence
  PCR primer for ORF amplification
tggaagtggttcaggaatgggcatgttggaactagttggt

SEQ ID NO: 15636 - DNA, 40 bp, Artificial Sequence
  PCR primer for ORF amplification
tggaagtggttcaggaatgtcctccaatcttaccgaagaa

SEQ ID NO: 15637 - DNA, 40 bp, Artificial Sequence
  PCR primer for ORF amplification
tggaagtggttcaggaatgaacaaaattcagcaaatcaac

SEQ ID NO: 15638 - DNA, 40 bp, Artificial Sequence
  PCR primer for ORF amplification
tggaagtggttcaggaatgaatatcgtcccacaagatacc

SEQ ID NO: 15639 - DNA, 40 bp, Artificial Sequence
  PCR primer for ORF amplification
tggaagtggttcaggaatgcccaaatcccgaccaaaaagg

SEQ ID NO: 15640 - DNA, 40 bp, Artificial Sequence
  PCR primer for ORF amplification
tggaagtggttcaggaatggactcgtactcaataacaaac

SEQ ID NO: 15641 - DNA, 40 bp, Artificial Sequence
  PCR primer for ORF amplification
tggaagtggttcaggaatgggcacatatacgccattaata

SEQ ID NO: 15642 - DNA, 40 bp, Artificial Sequence
  PCR primer for ORF amplification
tggaagtggttcaggaatggtttctaccgctacatttttc

SEQ ID NO: 15643 - DNA, 40 bp, Artificial Sequence
  PCR primer for ORF amplification
tggaagtggttcaggaatgtgtgaatcatcaaataagact

SEQ ID NO: 15644 - DNA, 40 bp, Artificial Sequence
  PCR primer for ORF amplification
tggaagtggttcaggaatgttagtaaagacgattagccga

SEQ ID NO: 15645 - DNA, 40 bp, Artificial Sequence
  PCR primer for ORF amplification
tggaagtggttcaggaatgttatcaagggccatattcaga

SEQ ID NO: 15646 - DNA, 40 bp, Artificial Sequence
  PCR primer for ORF amplification
tggaagtggttcaggaatgttcagcctacaagacgtaata

SEQ ID NO: 15647 - DNA, 40 bp, Artificial Sequence
  PCR primer for ORF amplification
tggaagtggttcaggaatgttgtctaacgctaagctcctt

SEQ ID NO: 15648 - DNA, 40 bp, Artificial Sequence
  PCR primer for ORF amplification
tggaagtggttcaggaatgaatctacagaacaacgtttta

SEQ ID NO: 15649 - DNA, 40 bp, Artificial Sequence
  PCR primer for ORF amplification
tggaagtggttcaggaatgaatctatacggttatttttta

SEQ ID NO: 15650 - DNA, 40 bp, Artificial Sequence
  PCR primer for ORF amplification
tggaagtggttcaggaatgcctgtagatcaagaaaaatta

SEQ ID NO: 15651 - DNA, 40 bp, Artificial Sequence
  PCR primer for ORF amplification
tggaagtggttcaggaatggctcacagggctttcatacag

SEQ ID NO: 15652 - DNA, 40 bp, Artificial Sequence
  PCR primer for ORF amplification
tggaagtggttcaggaatgtcagccaccagagccaataaa

SEQ ID NO: 15653 - DNA, 40 bp, Artificial Sequence
  PCR primer for ORF amplification
tggaagtggttcaggaatgtcgaacctctacaaaattgga

SEQ ID NO: 15654 - DNA, 40 bp, Artificial Sequence
  PCR primer for ORF amplification
tggaagtggttcaggaatgtctaacgaatctaacgacctt

SEQ ID NO: 15655 - DNA, 40 bp, Artificial Sequence
  PCR primer for ORF amplification
tggaagtggttcaggaatgttcaagcatagtacaggtatt

SEQ ID NO: 15656 - DNA, 40 bp, Artificial Sequence
  PCR primer for ORF amplification
tggaagtggttcaggaatgaaacagcgtttttctcaagta

SEQ ID NO: 15657 - DNA, 40 bp, Artificial Sequence
  PCR primer for ORF amplification
tggaagtggttcaggaatgcagtttgaagagcggttgcaa

SEQ ID NO: 15658 - DNA, 40 bp, Artificial Sequence
  PCR primer for ORF amplification
tggaagtggttcaggaatgcttttattttcttcttttttt

SEQ ID NO: 15659 - DNA, 40 bp, Artificial Sequence
  PCR primer for ORF amplification
tggaagtggttcaggaatgggcaatttcattataacagaa

SEQ ID NO: 15660 - DNA, 40 bp, Artificial Sequence
  PCR primer for ORF amplification
tggaagtggttcaggaatgtaccatcactatcacgccttc

SEQ ID NO: 15661 - DNA, 40 bp, Artificial Sequence
  PCR primer for ORF amplification
tggaagtggttcaggaatgtctcaacccactcccatcata

SEQ ID NO: 15662 - DNA, 40 bp, Artificial Sequence
  PCR primer for ORF amplification
tggaagtggttcaggaatgtctgatataaacgaaatcgaa

SEQ ID NO: 15663 - DNA, 40 bp, Artificial Sequence
  PCR primer for ORF amplification
tggaagtggttcaggaatgtgctcagcaggcggtatcaga

SEQ ID NO: 15664 - DNA, 40 bp, Artificial Sequence
  PCR primer for ORF amplification
tggaagtggttcaggaatgtttctcccaaaattcaatccc

SEQ ID NO: 15665 - DNA, 40 bp, Artificial Sequence
  PCR primer for ORF amplification
tggaagtggttcaggaatgagcgatgaaaataagagtacg

SEQ ID NO: 15666 - DNA, 40 bp, Artificial Sequence
  PCR primer for ORF amplification
tggaagtggttcaggaatgaacagatcttttcactttcta

SEQ ID NO: 15667 - DNA, 40 bp, Artificial Sequence
  PCR primer for ORF amplification
tggaagtggttcaggaatgacgaacgatattaaggagata

SEQ ID NO: 15668 - DNA, 40 bp, Artificial Sequence
  PCR primer for ORF amplification
tggaagtggttcaggaatgatatttggacctactagtgtc

SEQ ID NO: 15669 - DNA, 40 bp, Artificial Sequence
  PCR primer for ORF amplification
tggaagtggttcaggaatggagaagcccagccccaccagg

SEQ ID NO: 15670 - DNA, 40 bp, Artificial Sequence
  PCR primer for ORF amplification
tggaagtggttcaggaatgggtacagccaagcaaaatcaa

SEQ ID NO: 15671 - DNA, 40 bp, Artificial Sequence
  PCR primer for ORF amplification
tggaagtggttcaggaatgtctgactgggatacaaatact

SEQ ID NO: 15672 - DNA, 40 bp, Artificial Sequence
  PCR primer for ORF amplification
tggaagtggttcaggaatgggtggtaacgttctccccatt

SEQ ID NO: 15673 - DNA, 40 bp, Artificial Sequence; identical to SEQ ID NO: 15599
  PCR primer for ORF amplification

SEQ ID NO: 15674 - DNA, 40 bp, Artificial Sequence
  PCR primer for ORF amplification
tggaagtggttcaggaatgagcttgaggccttgcttcgta

SEQ ID NO: 15675 - DNA, 40 bp, Artificial Sequence
  PCR primer for ORF amplification
tggaagtggttcaggaatgcaaattttcgtcaagacttta

SEQ ID NO: 15676 - DNA, 40 bp, Artificial Sequence
  PCR primer for ORF amplification
tggaagtggttcaggaatgcagtaccattccgctctatat

SEQ ID NO: 15677 - DNA, 40 bp, Artificial Sequence
  PCR primer for ORF amplification
tggaagtggttcaggaatggtcgaattaactgaaattaaa

SEQ ID NO: 15678 - DNA, 40 bp, Artificial Sequence
  PCR primer for ORF amplification
tggaagtggttcaggaatgtccttcattaaaaacttgtta

SEQ ID NO: 15679 - DNA, 40 bp, Artificial Sequence
  PCR primer for ORF amplification
tggaagtggttcaggaatgtggtttcctcagatcattgct

SEQ ID NO: 15680 - DNA, 40 bp, Artificial Sequence
  PCR primer for ORF amplification
tggaagtggttcaggaatgaaattctcaactattttcgga

SEQ ID NO: 15681 - DNA, 40 bp, Artificial Sequence
  PCR primer for ORF amplification
tggaagtggttcaggaatgaactctgaacagctgctgcat

SEQ ID NO: 15682 - DNA, 40 bp, Artificial Sequence
  PCR primer for ORF amplification
tggaagtggttcaggaatgacctttttacaatttatcaat

SEQ ID NO: 15683 - DNA, 40 bp, Artificial Sequence
  PCR primer for ORF amplification
tggaagtggttcaggaatgggtaagaaaaacactaaaggt

SEQ ID NO: 15684 - DNA, 40 bp, Artificial Sequence
  PCR primer for ORF amplification
tggaagtggttcaggaatggttacgttcaactgtgaggtg

SEQ ID NO: 15685 - DNA, 40 bp, Artificial Sequence
  PCR primer for ORF amplification
tggaagtggttcaggaatggttgtcttgaatccaaataac

SEQ ID NO: 15686 - DNA, 40 bp, Artificial Sequence
  PCR primer for ORF amplification
tggaagtggttcaggaatgtctagtcaaacagaaagaact

SEQ ID NO: 15687 - DNA, 40 bp, Artificial Sequence
  PCR primer for ORF amplification
tggaagtggttcaggaatgtctcaaaaagcttgttacgtt

SEQ ID NO: 15688 - DNA, 40 bp, Artificial Sequence
  PCR primer for ORF amplification
tggaagtggttcaggaatgtctgacgaagcaaaggaaaag

SEQ ID NO: 15689 - DNA, 40 bp, Artificial Sequence
  PCR primer for ORF amplification
tggaagtggttcaggaatgttacgtaacacttttactaga

SEQ ID NO: 15690 - DNA, 40 bp, Artificial Sequence
  PCR primer for ORF amplification
tggaagtggttcaggaatgttgtcgaggtttatgtccaac

SEQ ID NO: 15691 - DNA, 40 bp, Artificial Sequence
  PCR primer for ORF amplification
tggaagtggttcaggaatgactccacttttgcaggcggaa

SEQ ID NO: 15692 - DNA, 40 bp, Artificial Sequence
  PCR primer for ORF amplification
tggaagtggttcaggaatgctaagagttatatggaagcat

SEQ ID NO: 15693 - DNA, 40 bp, Artificial Sequence
  PCR primer for ORF amplification
tggaagtggttcaggaatggaagccgattggaggagaatt

SEQ ID NO: 15694 - DNA, 40 bp, Artificial Sequence
  PCR primer for ORF amplification
tggaagtggttcaggaatggttcaagcagtcgcagtgtta

SEQ ID NO: 15695 - DNA, 40 bp, Artificial Sequence
  PCR primer for ORF amplification
tggaagtggttcaggaatgtcgtcatctactccctttgac

SEQ ID NO: 15696 - DNA, 40 bp, Artificial Sequence
  PCR primer for ORF amplification
tggaagtggttcaggaatgaaggttgaaatcgattctttt

SEQ ID NO: 15697 - DNA, 40 bp, Artificial Sequence
  PCR primer for ORF amplification
tggaagtggttcaggaatgaaggttgaagttgattccttt

SEQ ID NO: 15698 - DNA, 40 bp, Artificial Sequence
  PCR primer for ORF amplification
tggaagtggttcaggaatgaattcaactaaaaggctgaaa

SEQ ID NO: 15699 - DNA, 40 bp, Artificial Sequence
  PCR primer for ORF amplification
tggaagtggttcaggaatgaccaaagtagatttttggcca

SEQ ID NO: 15700 - DNA, 40 bp, Artificial Sequence
  PCR primer for ORF amplification
tggaagtggttcaggaatgagtggaaatcaaatggctatg

SEQ ID NO: 15701 - DNA, 40 bp, Artificial Sequence
  PCR primer for ORF amplification
tggaagtggttcaggaatgatgaggggagcgagtaagagg

SEQ ID NO: 15702 - DNA, 40 bp, Artificial Sequence
  PCR primer for ORF amplification
tggaagtggttcaggaatgcgatcgatttttctgctgcat

SEQ ID NO: 15703 - DNA, 40 bp, Artificial Sequence
  PCR primer for ORF amplification
tggaagtggttcaggaatgctttcactacgtcaatctata

SEQ ID NO: 15704 - DNA, 40 bp, Artificial Sequence
  PCR primer for ORF amplification
tggaagtggttcaggaatggatagaccaagaacattacgc

SEQ ID NO: 15705 - DNA, 40 bp, Artificial Sequence
  PCR primer for ORF amplification
tggaagtggttcaggaatgtcgttggtcaaacttgcgaat

SEQ ID NO: 15706 - DNA, 40 bp, Artificial Sequence
  PCR primer for ORF amplification
tggaagtggttcaggaatgacgcaattaaaatatttgttg

SEQ ID NO: 15707 - DNA, 40 bp, Artificial Sequence
  PCR primer for ORF amplification
tggaagtggttcaggaatgagtatgagttcaactgtaatt

SEQ ID NO: 15708 - DNA, 40 bp, Artificial Sequence
  PCR primer for ORF amplification
tggaagtggttcaggaatgagttcccggtttgcaagaagt

SEQ ID NO: 15709 - DNA, 40 bp, Artificial Sequence
  PCR primer for ORF amplification
tggaagtggttcaggaatgatggatggttccataacaagg

SEQ ID NO: 15710 - DNA, 40 bp, Artificial Sequence
  PCR primer for ORF amplification
tggaagtggttcaggaatggcacgttcaagaggatcatca

SEQ ID NO: 15711 - DNA, 40 bp, Artificial Sequence
  PCR primer for ORF amplification
tggaagtggttcaggaatggcagtagaagagggtggttgc

SEQ ID NO: 15712 - DNA, 40 bp, Artificial Sequence
  PCR primer for ORF amplification
tggaagtggttcaggaatgggtaaagacaacaaggaacat

SEQ ID NO: 15713 - DNA, 40 bp, Artificial Sequence
  PCR primer for ORF amplification
tggaagtggttcaggaatggtactgtttggactaggtaga

SEQ ID NO: 15714 - DNA, 40 bp, Artificial Sequence
  PCR primer for ORF amplification
tggaagtggttcaggaatgtccaacactagcgaagataac

SEQ ID NO: 15715 - DNA, 40 bp, Artificial Sequence
  PCR primer for ORF amplification
tggaagtggttcaggaatgttcgccagactcgctaatcct

SEQ ID NO: 15716 - DNA, 40 bp, Artificial Sequence
  PCR primer for ORF amplification
tggaagtggttcaggaatgaagagtttgttctatctcaaa

SEQ ID NO: 15717 - DNA, 40 bp, Artificial Sequence
  PCR primer for ORF amplification
tggaagtggttcaggaatgaacggcggaggcaagaatgtt

SEQ ID NO: 15718 - DNA, 40 bp, Artificial Sequence
  PCR primer for ORF amplification
tggaagtggttcaggaatgaatggaaacagcactaacaat

SEQ ID NO: 15719 - DNA, 40 bp, Artificial Sequence
  PCR primer for ORF amplification
tggaagtggttcaggaatgatagaggcgttggaaatagtt

SEQ ID NO: 15720 - DNA, 40 bp, Artificial Sequence
  PCR primer for ORF amplification
tggaagtggttcaggaatgccaattgaccaagaaaaatta

SEQ ID NO: 15721 - DNA, 40 bp, Artificial Sequence
  PCR primer for ORF amplification
tggaagtggttcaggaatgccgcgcataaagaccagaaga

SEQ ID NO: 15722 - DNA, 40 bp, Artificial Sequence
  PCR primer for ORF amplification
tggaagtggttcaggaatggacccacagacgctcattact

SEQ ID NO: 15723 - DNA, 40 bp, Artificial Sequence
  PCR primer for ORF amplification
tggaagtggttcaggaatgtcatacaaacagtattttgat

SEQ ID NO: 15724 - DNA, 40 bp, Artificial Sequence
  PCR primer for ORF amplification
tggaagtggttcaggaatgtctgacgaagaacacaccttt

SEQ ID NO: 15725 - DNA, 40 bp, Artificial Sequence
  PCR primer for ORF amplification
tggaagtggttcaggaatgtctgacgaagaacataccttt

SEQ ID NO: 15726 - DNA, 40 bp, Artificial Sequence
  PCR primer for ORF amplification
tggaagtggttcaggaatgtctgctaaacccgctactgac

SEQ ID NO: 15727 - DNA, 40 bp, Artificial Sequence
  PCR primer for ORF amplification
tggaagtggttcaggaatgatcaatggcgtatattacaat

SEQ ID NO: 15728 - DNA, 40 bp, Artificial Sequence
  PCR primer for ORF amplification
tggaagtggttcaggaatggggaaaaagacttttagagaa

SEQ ID NO: 15729 - DNA, 40 bp, Artificial Sequence
  PCR primer for ORF amplification
tggaagtggttcaggaatggtgacagggggaatggcaagc

SEQ ID NO: 15730 - DNA, 40 bp, Artificial Sequence
  PCR primer for ORF amplification
tggaagtggttcaggaatgtcacaggcagcaaaaaacgtg

SEQ ID NO: 15731 - DNA, 40 bp, Artificial Sequence
  PCR primer for ORF amplification
tggaagtggttcaggaatgtcagccgatcattcgagagat

SEQ ID NO: 15732 - DNA, 40 bp, Artificial Sequence
  PCR primer for ORF amplification
tggaagtggttcaggaatgaagtgcactttagtttccaca

SEQ ID NO: 15733 - DNA, 40 bp, Artificial Sequence
  PCR primer for ORF amplification
tggaagtggttcaggaatgagcttacccgatggattttat

SEQ ID NO: 15734 - DNA, 40 bp, Artificial Sequence
  PCR primer for ORF amplification
tggaagtggttcaggaatggggatatattcattttggatc

SEQ ID NO: 15735 - DNA, 40 bp, Artificial Sequence
  PCR primer for ORF amplification
tggaagtggttcaggaatgtcacgcatgccatctagtttc

SEQ ID NO: 15736 - DNA, 40 bp, Artificial Sequence
  PCR primer for ORF amplification
tggaagtggttcaggaatgtcgcacaacgcaatggaacat

SEQ ID NO: 15737 - DNA, 40 bp, Artificial Sequence
  PCR primer for ORF amplification
tggaagtggttcaggaatgatgcctgctaaactgcagctt

SEQ ID NO: 15738 - DNA, 40 bp, Artificial Sequence
  PCR primer for ORF amplification
tggaagtggttcaggaatgactgaattgtgtcctgtctac

SEQ ID NO: 15739 - DNA, 40 bp, Artificial Sequence
  PCR primer for ORF amplification
tggaagtggttcaggaatgagccagttagttctagactta

SEQ ID NO: 15740 - DNA, 40 bp, Artificial Sequence
  PCR primer for ORF amplification
tggaagtggttcaggaatgggtgtttatttggcagtactc

SEQ ID NO: 15741 - DNA, 40 bp, Artificial Sequence
  PCR primer for ORF amplification
tggaagtggttcaggaatgtctataccccattccgtattt

SEQ ID NO: 15742 - DNA, 40 bp, Artificial Sequence
  PCR primer for ORF amplification
tggaagtggttcaggaatgttacgttcaattattggaaag

SEQ ID NO: 15743 - DNA, 40 bp, Artificial Sequence
  PCR primer for ORF amplification
tggaagtggttcaggaatgaaagttcttgaggaaaggaat

SEQ ID NO: 15744 - DNA, 40 bp, Artificial Sequence
  PCR primer for ORF amplification
tggaagtggttcaggaatgaagatcagtcaatttggctct

SEQ ID NO: 15745 - DNA, 40 bp, Artificial Sequence
  PCR primer for ORF amplification
tggaagtggttcaggaatgaagctaggacatcgtgagcaa

SEQ ID NO: 15746 - DNA, 40 bp, Artificial Sequence
  PCR primer for ORF amplification
tggaagtggttcaggaatgacaaagaaggataagaaggaa

SEQ ID NO: 15747 - DNA, 40 bp, Artificial Sequence
  PCR primer for ORF amplification
tggaagtggttcaggaatgacaattgaaaaaccaaaaata

SEQ ID NO: 15748 - DNA, 40 bp, Artificial Sequence
  PCR primer for ORF amplification
tggaagtggttcaggaatgagtaagaacaggtcatcgcta

SEQ ID NO: 15749 - DNA, 40 bp, Artificial Sequence
  PCR primer for ORF amplification
tggaagtggttcaggaatgatcaagtatactatcgatgag

SEQ ID NO: 15750 - DNA, 40 bp, Artificial Sequence
  PCR primer for ORF amplification
tggaagtggttcaggaatgccacaagtacagtcgtggttt

SEQ ID NO: 15751 - DNA, 40 bp, Artificial Sequence
  PCR primer for ORF amplification
tggaagtggttcaggaatgctacaactgaaattcatatgg

SEQ ID NO: 15752 - DNA, 40 bp, Artificial Sequence
  PCR primer for ORF amplification
tggaagtggttcaggaatggagaagatcaaagagaaattg

SEQ ID NO: 15753 - DNA, 40 bp, Artificial Sequence
  PCR primer for ORF amplification
tggaagtggttcaggaatggatgatatttgtagtatggcg

SEQ ID NO: 15754 - DNA, 40 bp, Artificial Sequence
  PCR primer for ORF amplification
tggaagtggttcaggaatgaccacatctttttatgattta

SEQ ID NO: 15755 - DNA, 40 bp, Artificial Sequence
  PCR primer for ORF amplification
tggaagtggttcaggaatgatcgaagagaagaaggaactt

SEQ ID NO: 15756 - DNA, 40 bp, Artificial Sequence
  PCR primer for ORF amplification
tggaagtggttcaggaatgcaacaaagatcaaataggaga

SEQ ID NO: 15757 - DNA, 40 bp, Artificial Sequence
  PCR primer for ORF amplification
tggaagtggttcaggaatgcacaatatgtttccagcactc

SEQ ID NO: 15758 - DNA, 40 bp, Artificial Sequence
  PCR primer for ORF amplification
tggaagtggttcaggaatgccaagagaattcaaatccttt

SEQ ID NO: 15759 - DNA, 40 bp, Artificial Sequence
  PCR primer for ORF amplification
tggaagtggttcaggaatggtaatgagggaagaaacaata

SEQ ID NO: 15760 - DNA, 40 bp, Artificial Sequence
  PCR primer for ORF amplification
tggaagtggttcaggaatggtgatgctccattctaaaaac

SEQ ID NO: 15761 - DNA, 40 bp, Artificial Sequence
  PCR primer for ORF amplification
tggaagtggttcaggaatgtcccaagtctattttgatgtc

SEQ ID NO: 15762 - DNA, 40 bp, Artificial Sequence
  PCR primer for ORF amplification
tggaagtggttcaggaatgtcttcttcccaggtcgtcagg

SEQ ID NO: 15763 - DNA, 40 bp, Artificial Sequence
  PCR primer for ORF amplification
tggaagtggttcaggaatgtttttacgtactcaagctcgt

SEQ ID NO: 15764 - DNA, 40 bp, Artificial Sequence
  PCR primer for ORF amplification
tggaagtggttcaggaatgaatagcgcaggccgcgtccat

SEQ ID NO: 15765 - DNA, 40 bp, Artificial Sequence
  PCR primer for ORF amplification
tggaagtggttcaggaatggaccatagtgaatcgctaacg

SEQ ID NO: 15766 - DNA, 40 bp, Artificial Sequence
  PCR primer for ORF amplification
tggaagtggttcaggaatgtcagaattctataagctagca

SEQ ID NO: 15767 - DNA, 40 bp, Artificial Sequence
  PCR primer for ORF amplification
tggaagtggttcaggaatgtcgcagaagattggacacagt

SEQ ID NO: 15768 - DNA, 40 bp, Artificial Sequence
  PCR primer for ORF amplification
tggaagtggttcaggaatgaccaatgaaggaataggtata

SEQ ID NO: 15769 - DNA, 40 bp, Artificial Sequence
  PCR primer for ORF amplification
tggaagtggttcaggaatgacgaaaaaggataagaaagca

SEQ ID NO: 15770 - DNA, 40 bp, Artificial Sequence
  PCR primer for ORF amplification
tggaagtggttcaggaatggcagaacaaattagtcacaaa

SEQ ID NO: 15771 - DNA, 40 bp, Artificial Sequence
  PCR primer for ORF amplification
tggaagtggttcaggaatggtatctagtgcagttaaatgt

SEQ ID NO: 15772 - DNA, 40 bp, Artificial Sequence
  PCR primer for ORF amplification
tggaagtggttcaggaatgtcaacgcaactcgcaagtaac

SEQ ID NO: 15773 - DNA, 40 bp, Artificial Sequence
  PCR primer for ORF amplification
tggaagtggttcaggaatgcctccaaagtttgatccaaat

SEQ ID NO: 15774 - DNA, 40 bp, Artificial Sequence
  PCR primer for ORF amplification
tggaagtggttcaggaatgcctccaaagtttgatcctaat

SEQ ID NO: 15775 - DNA, 40 bp, Artificial Sequence
  PCR primer for ORF amplification
tggaagtggttcaggaatgaaagttaaaataaacgaagtg

SEQ ID NO: 15776 - DNA, 40 bp, Artificial Sequence
  PCR primer for ORF amplification
tggaagtggttcaggaatgacagatgctttggaacagagc

SEQ ID NO: 15777 - DNA, 40 bp, Artificial Sequence
  PCR primer for ORF amplification
tggaagtggttcaggaatgaccactcgaaaaacagtagat

SEQ ID NO: 15778 - DNA, 40 bp, Artificial Sequence
  PCR primer for ORF amplification
tggaagtggttcaggaatgagatttccttcaatttttact

SEQ ID NO: 15779 - DNA, 40 bp, Artificial Sequence
  PCR primer for ORF amplification
tggaagtggttcaggaatgcaattgttttccatcctctct

SEQ ID NO: 15780 - DNA, 40 bp, Artificial Sequence
  PCR primer for ORF amplification
tggaagtggttcaggaatgcttcctgttataacgagattt

SEQ ID NO: 15781 - DNA, 40 bp, Artificial Sequence
  PCR primer for ORF amplification
tggaagtggttcaggaatgtcgaaaaccgctcagaaacgt

SEQ ID NO: 15782 - DNA, 40 bp, Artificial Sequence
  PCR primer for ORF amplification
tggaagtggttcaggaatgtcaaaagtgtatgttattata

SEQ ID NO: 15783 - DNA, 40 bp, Artificial Sequence
  PCR primer for ORF amplification
tggaagtggttcaggaatgtggctcacagaggctcaaagt

SEQ ID NO: 15784 - DNA, 40 bp, Artificial Sequence
  PCR primer for ORF amplification
tggaagtggttcaggaatgagcggtagtaggggcaatagc

SEQ ID NO: 15785 - DNA, 40 bp, Artificial Sequence
  PCR primer for ORF amplification
tggaagtggttcaggaatgggtagatattcggtgaagaga

SEQ ID NO: 15786 - DNA, 40 bp, Artificial Sequence
  PCR primer for ORF amplification
tggaagtggttcaggaatgtcaagatatggcaaaaacctt

SEQ ID NO: 15787 - DNA, 40 bp, Artificial Sequence
  PCR primer for ORF amplification
tggaagtggttcaggaatgtctgcaacgtatgtacactaa

SEQ ID NO: 15788 - DNA, 40 bp, Artificial Sequence
  PCR primer for ORF amplification
tggaagtggttcaggaatgaacaacgagactagtggtaaa

SEQ ID NO: 15789 - DNA, 40 bp, Artificial Sequence
  PCR primer for ORF amplification
tggaagtggttcaggaatgaatctaagatttgaattgcag

SEQ ID NO: 15790 - DNA, 40 bp, Artificial Sequence
  PCR primer for ORF amplification
tggaagtggttcaggaatgattatttacaaggatatcttc

SEQ ID NO: 15791 - DNA, 40 bp, Artificial Sequence
  PCR primer for ORF amplification
tggaagtggttcaggaatgattccttaccaggagtggcat

SEQ ID NO: 15792 - DNA, 40 bp, Artificial Sequence
  PCR primer for ORF amplification
tggaagtggttcaggaatgcaagaattttattctttttca

SEQ ID NO: 15793 - DNA, 40 bp, Artificial Sequence
  PCR primer for ORF amplification
tggaagtggttcaggaatgcagggcgatatcagaaggaaa

SEQ ID NO: 15794 - DNA, 40 bp, Artificial Sequence
  PCR primer for ORF amplification
tggaagtggttcaggaatggctttaagtttaggacagttc

SEQ ID NO: 15795 - DNA, 40 bp, Artificial Sequence
  PCR primer for ORF amplification
tggaagtggttcaggaatgtctactattccctcagaaatc

SEQ ID NO: 15796 - DNA, 40 bp, Artificial Sequence
  PCR primer for ORF amplification
tggaagtggttcaggaatgtctaggaagctgaaaaaaacg

SEQ ID NO: 15797 - DNA, 40 bp, Artificial Sequence
  PCR primer for ORF amplification
tggaagtggttcaggaatgtctgtgaaacccattgacaac

SEQ ID NO: 15798 - DNA, 40 bp, Artificial Sequence
  PCR primer for ORF amplification
tggaagtggttcaggaatgaaagaagcatctgatagagaa

SEQ ID NO: 15799 - DNA, 40 bp, Artificial Sequence
  PCR primer for ORF amplification
tggaagtggttcaggaatgaataagtggagcaggctgtac

SEQ ID NO: 15800 - DNA, 40 bp, Artificial Sequence
  PCR primer for ORF amplification
tggaagtggttcaggaatgagttctcaaagtaatactggt

SEQ ID NO: 15801 - DNA, 40 bp, Artificial Sequence
  PCR primer for ORF amplification
tggaagtggttcaggaatggtatgtgccattacattacgt

SEQ ID NO: 15802 - DNA, 40 bp, Artificial Sequence
  PCR primer for ORF amplification
tggaagtggttcaggaatgtcatcgactaagtttttgaaa

SEQ ID NO: 15803 - DNA, 40 bp, Artificial Sequence
  PCR primer for ORF amplification
tggaagtggttcaggaatgtccaatctattaaacaagttt

SEQ ID NO: 15804 - DNA, 40 bp, Artificial Sequence
  PCR primer for ORF amplification
tggaagtggttcaggaatgtcgaatgaaaacttatctccc

SEQ ID NO: 15805 - DNA, 40 bp, Artificial Sequence
  PCR primer for ORF amplification
tggaagtggttcaggaatgactttgaataacgttgcaagg

SEQ ID NO: 15806 - DNA, 40 bp, Artificial Sequence
  PCR primer for ORF amplification
tggaagtggttcaggaatgacgccctatgcagtagcaatt

SEQ ID NO: 15807 - DNA, 40 bp, Artificial Sequence
  PCR primer for ORF amplification
tggaagtggttcaggaatgagcagtgaaattgcctactcg

SEQ ID NO: 15808 - DNA, 40 bp, Artificial Sequence
  PCR primer for ORF amplification
tggaagtggttcaggaatgatagcgtggtccctagtggct

SEQ ID NO: 15809 - DNA, 40 bp, Artificial Sequence
  PCR primer for ORF amplification
tggaagtggttcaggaatggcagttaaaggattaggcaaa

SEQ ID NO: 15810 - DNA, 40 bp, Artificial Sequence
  PCR primer for ORF amplification
tggaagtggttcaggaatgtacattcctaaacattttgag

SEQ ID NO: 15811 - DNA, 40 bp, Artificial Sequence
  PCR primer for ORF amplification
tggaagtggttcaggaatgtggagcaggaacgtcagattg

SEQ ID NO: 15812 - DNA, 40 bp, Artificial Sequence
  PCR primer for ORF amplification
tggaagtggttcaggaatgttcacaaatacacgtacaata

SEQ ID NO: 15813 - DNA, 40 bp, Artificial Sequence
  PCR primer for ORF amplification
tggaagtggttcaggaatgagtaagaatgttggtaagcta

SEQ ID NO: 15814 - DNA, 40 bp, Artificial Sequence
  PCR primer for ORF amplification
tggaagtggttcaggaatgagttcaagttcttatagggat

SEQ ID NO: 15815 - DNA, 40 bp, Artificial Sequence
  PCR primer for ORF amplification
tggaagtggttcaggaatgcagtgcgcgataactcctaga

SEQ ID NO: 15816 - DNA, 40 bp, Artificial Sequence
  PCR primer for ORF amplification
tggaagtggttcaggaatgccatctgacgtagcatcgagg

SEQ ID NO: 15817 - DNA, 40 bp, Artificial Sequence
  PCR primer for ORF amplification
tggaagtggttcaggaatggagggccgcaaaagtgaagat

SEQ ID NO: 15818 - DNA, 40 bp, Artificial Sequence
  PCR primer for ORF amplification
tggaagtggttcaggaatgggttcaaacacttccaaagtg

SEQ ID NO: 15819 - DNA, 40 bp, Artificial Sequence
  PCR primer for ORF amplification
tggaagtggttcaggaatgttacgcactactagactatgg

SEQ ID NO: 15820 - DNA, 40 bp, Artificial Sequence
  PCR primer for ORF amplification
tggaagtggttcaggaatggttcccttatttggtttattt

SEQ ID NO: 15821 - DNA, 40 bp, Artificial Sequence
  PCR primer for ORF amplification
tggaagtggttcaggaatgtcacaatcattacgtccgtat

SEQ ID NO: 15822 - DNA, 40 bp, Artificial Sequence
  PCR primer for ORF amplification
tggaagtggttcaggaatgttttttattaaagacctttcg

SEQ ID NO: 15823 - DNA, 40 bp, Artificial Sequence
  PCR primer for ORF amplification
tggaagtggttcaggaatgctgaaaattgttactcgggct

SEQ ID NO: 15824 - DNA, 40 bp, Artificial Sequence
  PCR primer for ORF amplification
tggaagtggttcaggaatggagcacgtatcaaagaggtca

SEQ ID NO: 15825 - DNA, 40 bp, Artificial Sequence
  PCR primer for ORF amplification
tggaagtggttcaggaatgtcaaaactatcgtcttatcct

SEQ ID NO: 15826 - DNA, 40 bp, Artificial Sequence
  PCR primer for ORF amplification
tggaagtggttcaggaatgtcattggtgaattcgttaaca

SEQ ID NO: 15827 - DNA, 40 bp, Artificial Sequence
  PCR primer for ORF amplification
tggaagtggttcaggaatgtccacaccagctagaagaagg

SEQ ID NO: 15828 - DNA, 40 bp, Artificial Sequence
  PCR primer for ORF amplification
tggaagtggttcaggaatgtctgcaaatagcaaggacaga

SEQ ID NO: 15829 - DNA, 40 bp, Artificial Sequence
  PCR primer for ORF amplification
tggaagtggttcaggaatgaatttcaaggagccgctagtg

SEQ ID NO: 15830 - DNA, 40 bp, Artificial Sequence
  PCR primer for ORF amplification
tggaagtggttcaggaatgacccacagcttgaaagctcta

SEQ ID NO: 15831 - DNA, 40 bp, Artificial Sequence
  PCR primer for ORF amplification
tggaagtggttcaggaatgagttttgcatcgaggaatatt

SEQ ID NO: 15832 - DNA, 40 bp, Artificial Sequence
  PCR primer for ORF amplification
tggaagtggttcaggaatgctagccctagctgataacatt

SEQ ID NO: 15833 - DNA, 40 bp, Artificial Sequence
  PCR primer for ORF amplification
tggaagtggttcaggaatggtacgtttaaaaagtagatat

SEQ ID NO: 15834 - DNA, 40 bp, Artificial Sequence
  PCR primer for ORF amplification
tggaagtggttcaggaatgtcatctaccagtgataataat

SEQ ID NO: 15835 - DNA, 40 bp, Artificial Sequence
  PCR primer for ORF amplification
tggaagtggttcaggaatgtccaacaaggcaagtgaccaa

SEQ ID NO: 15836 - DNA, 40 bp, Artificial Sequence
  PCR primer for ORF amplification
tggaagtggttcaggaatgaagattgtcttacaaaaagtc

SEQ ID NO: 15837 - DNA, 40 bp, Artificial Sequence; identical to SEQ ID NO: 15460
  PCR primer for ORF amplification

SEQ ID NO: 15838 - DNA, 40 bp, Artificial Sequence
  PCR primer for ORF amplification
tggaagtggttcaggaatgattaagcggtctctcgcaagt

SEQ ID NO: 15839 - DNA, 40 bp, Artificial Sequence
  PCR primer for ORF amplification
tggaagtggttcaggaatgattccgaggactagaacacta

SEQ ID NO: 15840 - DNA, 40 bp, Artificial Sequence
  PCR primer for ORF amplification
tggaagtggttcaggaatgcaacatttcgaaagttcagat

SEQ ID NO: 15841 - DNA, 40 bp, Artificial Sequence
  PCR primer for ORF amplification
tggaagtggttcaggaatgctatcagctgcagataattta

SEQ ID NO: 15842 - DNA, 40 bp, Artificial Sequence
  PCR primer for ORF amplification
tggaagtggttcaggaatgggcgaaggtttgctggattta

SEQ ID NO: 15843 - DNA, 40 bp, Artificial Sequence
  PCR primer for ORF amplification
tggaagtggttcaggaatgtctactaaagcccaaaaccct

SEQ ID NO: 15844 - DNA, 40 bp, Artificial Sequence
  PCR primer for ORF amplification
tggaagtggttcaggaatgtctgccaaagctcaaaaccct

SEQ ID NO: 15845 - DNA, 40 bp, Artificial Sequence
  PCR primer for ORF amplification
tggaagtggttcaggaatgtctgctatcccagaaaacgcc

SEQ ID NO: 15846 - DNA, 40 bp, Artificial Sequence
  PCR primer for ORF amplification
tggaagtggttcaggaatgtctttggccaaatccgctgct

SEQ ID NO: 15847 - DNA, 40 bp, Artificial Sequence
  PCR primer for ORF amplification
tggaagtggttcaggaatgtttacttcgaagcctgctttc

SEQ ID NO: 15848 - DNA, 40 bp, Artificial Sequence
  PCR primer for ORF amplification
tggaagtggttcaggaatgaatgaaagtgagaatagtccc

SEQ ID NO: 15849 - DNA, 40 bp, Artificial Sequence
  PCR primer for ORF amplification
tggaagtggttcaggaatgaccacatcacacagaccacag

SEQ ID NO: 15850 - DNA, 40 bp, Artificial Sequence
  PCR primer for ORF amplification
tggaagtggttcaggaatgcctcagtattttgccattatt

SEQ ID NO: 15851 - DNA, 40 bp, Artificial Sequence
  PCR primer for ORF amplification
tggaagtggttcaggaatgccttctaaaaactccatcaac

SEQ ID NO: 15852 - DNA, 40 bp, Artificial Sequence
  PCR primer for ORF amplification
tggaagtggttcaggaatgcgtaataatgtgactgaattg

SEQ ID NO: 15853 - DNA, 40 bp, Artificial Sequence
  PCR primer for ORF amplification
tggaagtggttcaggaatgcttatcaaccacttgagtaag

SEQ ID NO: 15854 - DNA, 40 bp, Artificial Sequence
  PCR primer for ORF amplification
tggaagtggttcaggaatggaatctattatcctcagcatt

SEQ ID NO: 15855 - DNA, 40 bp, Artificial Sequence
  PCR primer for ORF amplification
tggaagtggttcaggaatggacggccttagctttgttgat

SEQ ID NO: 15856 - DNA, 40 bp, Artificial Sequence
  PCR primer for ORF amplification
tggaagtggttcaggaatggatttgaaaagggattggtta

SEQ ID NO: 15857 - DNA, 40 bp, Artificial Sequence
  PCR primer for ORF amplification
tggaagtggttcaggaatggtccttttacacaaaagcaca

SEQ ID NO: 15858 - DNA, 40 bp, Artificial Sequence
  PCR primer for ORF amplification
tggaagtggttcaggaatgtcgacggataccatgtatttc

SEQ ID NO: 15859 - DNA, 40 bp, Artificial Sequence
  PCR primer for ORF amplification
tggaagtggttcaggaatggaaatagtgtacaagccattg

SEQ ID NO: 15860 - DNA, 40 bp, Artificial Sequence
  PCR primer for ORF amplification
tggaagtggttcaggaatgggccgtgatatatgcacatta

SEQ ID NO: 15861 - DNA, 40 bp, Artificial Sequence
  PCR primer for ORF amplification
tggaagtggttcaggaatgtctgacttagttaacaagaaa

SEQ ID NO: 15862 - DNA, 40 bp, Artificial Sequence
  PCR primer for ORF amplification
tggaagtggttcaggaatggctggagactccgataatgtg

SEQ ID NO: 15863 - DNA, 40 bp, Artificial Sequence
  PCR primer for ORF amplification
tggaagtggttcaggaatgaaactggcgcaagacatgaat

SEQ ID NO: 15864 - DNA, 40 bp, Artificial Sequence
  PCR primer for ORF amplification
tggaagtggttcaggaatgacgtcgaatagcgacggttca

SEQ ID NO: 15865 - DNA, 40 bp, Artificial Sequence
  PCR primer for ORF amplification
tggaagtggttcaggaatgagcaaatccactaacgttagt

SEQ ID NO: 15866 - DNA, 40 bp, Artificial Sequence
  PCR primer for ORF amplification
tggaagtggttcaggaatgagcagcattccagctggcact

SEQ ID NO: 15867 - DNA, 40 bp, Artificial Sequence
  PCR primer for ORF amplification
tggaagtggttcaggaatgtcgaacatcacttatgtcaaa

SEQ ID NO: 15868 - DNA, 40 bp, Artificial Sequence
  PCR primer for ORF amplification
tggaagtggttcaggaatgttgaagagcacgctgaggctt

SEQ ID NO: 15869 - DNA, 40 bp, Artificial Sequence
  PCR primer for ORF amplification
tggaagtggttcaggaatgttgaagtctatatttgcgaag

SEQ ID NO: 15870 - DNA, 40 bp, Artificial Sequence
  PCR primer for ORF amplification
tggaagtggttcaggaatgtttaatactacaccaattaat

SEQ ID NO: 15871 - DNA, 40 bp, Artificial Sequence
  PCR primer for ORF amplification
tggaagtggttcaggaatgtttcgagccggatcatcaaaa

SEQ ID NO: 15872 - DNA, 40 bp, Artificial Sequence
  PCR primer for ORF amplification
tggaagtggttcaggaatgaccttgtggccacatccgggg

SEQ ID NO: 15873 - DNA, 40 bp, Artificial Sequence
  PCR primer for ORF amplification
tggaagtggttcaggaatgactggataccctgacgtggcc

SEQ ID NO: 15874 - DNA, 40 bp, Artificial Sequence
  PCR primer for ORF amplification
tggaagtggttcaggaatgagttctgctaaacctattaat

SEQ ID NO: 15875 - DNA, 40 bp, Artificial Sequence
  PCR primer for ORF amplification
tggaagtggttcaggaatgccggttactaaatctttatct

SEQ ID NO: 15876 - DNA, 40 bp, Artificial Sequence
  PCR primer for ORF amplification
tggaagtggttcaggaatgcctgcgtatcactcgactttc

SEQ ID NO: 15877 - DNA, 40 bp, Artificial Sequence
  PCR primer for ORF amplification
tggaagtggttcaggaatgtcttcctccaagcgtattgcc

SEQ ID NO: 15878 - DNA, 40 bp, Artificial Sequence
  PCR primer for ORF amplification
tggaagtggttcaggaatgtcaaatccatttcaaaatata

SEQ ID NO: 15879 - DNA, 40 bp, Artificial Sequence
  PCR primer for ORF amplification
tggaagtggttcaggaatgaaaaagaccccagacccatct

SEQ ID NO: 15880 - DNA, 40 bp, Artificial Sequence
  PCR primer for ORF amplification
tggaagtggttcaggaatgaaatcatttcaaaaatcttat

SEQ ID NO: 15881 - DNA, 40 bp, Artificial Sequence
  PCR primer for ORF amplification
tggaagtggttcaggaatgagagaatataccagtaaaaaa

SEQ ID NO: 15882 - DNA, 40 bp, Artificial Sequence
  PCR primer for ORF amplification
tggaagtggttcaggaatgatatcatatgaattccaaact

SEQ ID NO: 15883 - DNA, 40 bp, Artificial Sequence
  PCR primer for ORF amplification
tggaagtggttcaggaatgatcaatttcctcctttttgtc

SEQ ID NO: 15884 - DNA, 40 bp, Artificial Sequence
  PCR primer for ORF amplification
tggaagtggttcaggaatgcctggtcttaagcttgttgaa

SEQ ID NO: 15885 - DNA, 40 bp, Artificial Sequence
  PCR primer for ORF amplification
tggaagtggttcaggaatggggtcgggcgatttgaatctg

SEQ ID NO: 15886 - DNA, 40 bp, Artificial Sequence
  PCR primer for ORF amplification
tggaagtggttcaggaatggtggttttagacaagaagtta

SEQ ID NO: 15887 - DNA, 40 bp, Artificial Sequence
  PCR primer for ORF amplification
tggaagtggttcaggaatggttaaggtatatattcatgac

SEQ ID NO: 15888 - DNA, 40 bp, Artificial Sequence
  PCR primer for ORF amplification
tggaagtggttcaggaatggctgtcaagactggtatgttt

SEQ ID NO: 15889 - DNA, 40 bp, Artificial Sequence
  PCR primer for ORF amplification
tggaagtggttcaggaatggctgtatgttagaaagatatt

SEQ ID NO: 15890 - DNA, 40 bp, Artificial Sequence
  PCR primer for ORF amplification
tggaagtggttcaggaatgtcttcttctaaacgtattgct

SEQ ID NO: 15891 - DNA, 40 bp, Artificial Sequence
  PCR primer for ORF amplification
tggaagtggttcaggaatgagtggaagtaatatgggatac

SEQ ID NO: 15892 - DNA, 40 bp, Artificial Sequence
  PCR primer for ORF amplification
tggaagtggttcaggaatgccaccaccatcaagaagtaga

SEQ ID NO: 15893 - DNA, 40 bp, Artificial Sequence
  PCR primer for ORF amplification
tggaagtggttcaggaatgctatacacaaggttgttacgt

SEQ ID NO: 15894 - DNA, 40 bp, Artificial Sequence
  PCR primer for ORF amplification
tggaagtggttcaggaatgggctcatcaaccgggtttcat

SEQ ID NO: 15895 - DNA, 40 bp, Artificial Sequence
  PCR primer for ORF amplification
tggaagtggttcaggaatgtcagactacgaggaggcgtat

SEQ ID NO: 15896 - DNA, 40 bp, Artificial Sequence
  PCR primer for ORF amplification
tggaagtggttcaggaatgaatactgaaggtgcttcttta

SEQ ID NO: 15897 - DNA, 40 bp, Artificial Sequence
  PCR primer for ORF amplification
tggaagtggttcaggaatgacaaacagtagtgaaaaacaa

SEQ ID NO: 15898 - DNA, 40 bp, Artificial Sequence
  PCR primer for ORF amplification
tggaagtggttcaggaatgagacagctaacagaagaagag

SEQ ID NO: 15899 - DNA, 40 bp, Artificial Sequence
  PCR primer for ORF amplification
tggaagtggttcaggaatgagtgaaacaaggatggcacag

SEQ ID NO: 15900 - DNA, 40 bp, Artificial Sequence
  PCR primer for ORF amplification
tggaagtggttcaggaatgatgttgccaagatccatgaaa

SEQ ID NO: 15901 - DNA, 40 bp, Artificial Sequence
  PCR primer for ORF amplification
tggaagtggttcaggaatgccttataaaacagctatagat

SEQ ID NO: 15902 - DNA, 40 bp, Artificial Sequence
  PCR primer for ORF amplification
tggaagtggttcaggaatggctggcaaagcagggaggaaa

SEQ ID NO: 15903 - DNA, 40 bp, Artificial Sequence
  PCR primer for ORF amplification
tggaagtggttcaggaatgggtctatacgcttctaagtta

SEQ ID NO: 15904 - DNA, 40 bp, Artificial Sequence
  PCR primer for ORF amplification
tggaagtggttcaggaatgggtttgtttgcctctaagttg

SEQ ID NO: 15905 - DNA, 40 bp, Artificial Sequence
  PCR primer for ORF amplification
tggaagtggttcaggaatgtctatttctgaatcttacgca

SEQ ID NO: 15906 - DNA, 40 bp, Artificial Sequence
  PCR primer for ORF amplification
tggaagtggttcaggaatgagcatgtataacaaacactga

SEQ ID NO: 15907 - DNA, 40 bp, Artificial Sequence
  PCR primer for ORF amplification
tggaagtggttcaggaatgccgaaagtaattctggagtct

SEQ ID NO: 15908 - DNA, 40 bp, Artificial Sequence
  PCR primer for ORF amplification
tggaagtggttcaggaatggtcagtataacatgattttat

SEQ ID NO: 15909 - DNA, 40 bp, Artificial Sequence
  PCR primer for ORF amplification
tggaagtggttcaggaatgatattacttcatgccatatat

SEQ ID NO: 15910 - DNA, 40 bp, Artificial Sequence
  PCR primer for ORF amplification
tggaagtggttcaggaatgccgttatttttggttctgaaa

SEQ ID NO: 15911 - DNA, 40 bp, Artificial Sequence
  PCR primer for ORF amplification
tggaagtggttcaggaatgtccatcgaggaggaagataca

SEQ ID NO: 15912 - DNA, 40 bp, Artificial Sequence
  PCR primer for ORF amplification
tggaagtggttcaggaatgttaaaaagacgctctaatgct

SEQ ID NO: 15913 - DNA, 40 bp, Artificial Sequence
  PCR primer for ORF amplification
tggaagtggttcaggaatgtttaaacgttccatcattcaa

SEQ ID NO: 15914 - DNA, 40 bp, Artificial Sequence
  PCR primer for ORF amplification
tggaagtggttcaggaatgaacagttacagcctattaact

SEQ ID NO: 15915 - DNA, 40 bp, Artificial Sequence
  PCR primer for ORF amplification
tggaagtggttcaggaatgaattctttgatttttggtaaa

SEQ ID NO: 15916 - DNA, 40 bp, Artificial Sequence
  PCR primer for ORF amplification
tggaagtggttcaggaatgccaaacttctggattcttgag

SEQ ID NO: 15917 - DNA, 40 bp, Artificial Sequence
  PCR primer for ORF amplification
tggaagtggttcaggaatgggcaattcaatttcgaaggtt

SEQ ID NO: 15918 - DNA, 40 bp, Artificial Sequence
  PCR primer for ORF amplification
tggaagtggttcaggaatgggtaacatttttagttcaatg

SEQ ID NO: 15919 - DNA, 40 bp, Artificial Sequence
  PCR primer for ORF amplification
tggaagtggttcaggaatggttagaaaactaaagcatcat

SEQ ID NO: 15920 - DNA, 40 bp, Artificial Sequence
  PCR primer for ORF amplification
tggaagtggttcaggaatgtacaaaacatggcgtctatgc

SEQ ID NO: 15921 - DNA, 40 bp, Artificial Sequence
  PCR primer for ORF amplification
tggaagtggttcaggaatgtcaaacagtcatcatacatcc

SEQ ID NO: 15922 - DNA, 40 bp, Artificial Sequence
  PCR primer for ORF amplification
tggaagtggttcaggaatgtcccagtcgaaccctatctta

SEQ ID NO: 15923 - DNA, 40 bp, Artificial Sequence
  PCR primer for ORF amplification
tggaagtggttcaggaatgtatgcatataatagaggaatt

SEQ ID NO: 15924 - DNA, 40 bp, Artificial Sequence
  PCR primer for ORF amplification
tggaagtggttcaggaatgaacaccaatagtaatactatg

SEQ ID NO: 15925 - DNA, 40 bp, Artificial Sequence
  PCR primer for ORF amplification
tggaagtggttcaggaatggaagatatcgaaaagataaaa

SEQ ID NO: 15926 - DNA, 40 bp, Artificial Sequence
  PCR primer for ORF amplification
tggaagtggttcaggaatggaggcagatgatcatgttagc

SEQ ID NO: 15927 - DNA, 40 bp, Artificial Sequence
  PCR primer for ORF amplification
tggaagtggttcaggaatgggagccgtactcagctgttgt

SEQ ID NO: 15928 - DNA, 40 bp, Artificial Sequence
  PCR primer for ORF amplification
tggaagtggttcaggaatgtcgtcgcttatttcaaaaacc

SEQ ID NO: 15929 - DNA, 40 bp, Artificial Sequence
  PCR primer for ORF amplification
tggaagtggttcaggaatgttctcctttgtccaaagattc

SEQ ID NO: 15930 - DNA, 40 bp, Artificial Sequence
  PCR primer for ORF amplification
tggaagtggttcaggaatgttgaaatacttggttcaacga

SEQ ID NO: 15931 - DNA, 40 bp, Artificial Sequence
  PCR primer for ORF amplification
tggaagtggttcaggaatgaggtatgttattcattaccaa

SEQ ID NO: 15932 - DNA, 40 bp, Artificial Sequence
  PCR primer for ORF amplification
tggaagtggttcaggaatgaaatgtctatatatcttgagt

SEQ ID NO: 15933 - DNA, 40 bp, Artificial Sequence
  PCR primer for ORF amplification
tggaagtggttcaggaatgaacatcagtggcaccttaaat

SEQ ID NO: 15934 - DNA, 40 bp, Artificial Sequence
  PCR primer for ORF amplification
tggaagtggttcaggaatgacaacaacctcaacaaccagt

SEQ ID NO: 15935 - DNA, 40 bp, Artificial Sequence
  PCR primer for ORF amplification
tggaagtggttcaggaatgagcaagttttcacttaagttg

SEQ ID NO: 15936 - DNA, 40 bp, Artificial Sequence
  PCR primer for ORF amplification
tggaagtggttcaggaatgcaggctaaattattgtttacc

SEQ ID NO: 15937 - DNA, 40 bp, Artificial Sequence
  PCR primer for ORF amplification
tggaagtggttcaggaatggatgcattcagcttaaagaag

SEQ ID NO: 15938 - DNA, 40 bp, Artificial Sequence
  PCR primer for ORF amplification
tggaagtggttcaggaatgttcagacaatcaattaggcca

SEQ ID NO: 15939 - DNA, 40 bp, Artificial Sequence
  PCR primer for ORF amplification
tggaagtggttcaggaatgagttcaaggtatgagaaatta

SEQ ID NO: 15940 - DNA, 40 bp, Artificial Sequence
  PCR primer for ORF amplification
tggaagtggttcaggaatgagtaggatcctagagagcgaa

SEQ ID NO: 15941 - DNA, 40 bp, Artificial Sequence
  PCR primer for ORF amplification
tggaagtggttcaggaatgagtgctaacaatggtgtcact

SEQ ID NO: 15942 - DNA, 40 bp, Artificial Sequence
  PCR primer for ORF amplification
tggaagtggttcaggaatgccggtcttaaatacgagaact

SEQ ID NO: 15943 - DNA, 40 bp, Artificial Sequence
  PCR primer for ORF amplification
tggaagtggttcaggaatgagtgcgaaacaagggtgggaa

SEQ ID NO: 15944 - DNA, 40 bp, Artificial Sequence
  PCR primer for ORF amplification
tggaagtggttcaggaatgagtgtcagccttgagcaaacg

SEQ ID NO: 15945 - DNA, 40 bp, Artificial Sequence
  PCR primer for ORF amplification
tggaagtggttcaggaatgataataacaattaaattcgag

SEQ ID NO: 15946 - DNA, 40 bp, Artificial Sequence
  PCR primer for ORF amplification
tggaagtggttcaggaatgcaagtctccccagctattgta

SEQ ID NO: 15947 - DNA, 40 bp, Artificial Sequence
  PCR primer for ORF amplification
tggaagtggttcaggaatgctacctttatatcttttaaca

SEQ ID NO: 15948 - DNA, 40 bp, Artificial Sequence
  PCR primer for ORF amplification
tggaagtggttcaggaatgtcccgtcctatcgtaatttct

SEQ ID NO: 15949 - DNA, 40 bp, Artificial Sequence
  PCR primer for ORF amplification
tggaagtggttcaggaatgtctatagcaagttatgcccaa

SEQ ID NO: 15950 - DNA, 40 bp, Artificial Sequence
  PCR primer for ORF amplification
tggaagtggttcaggaatgttatataacaaagagcaggga

SEQ ID NO: 15951 - DNA, 40 bp, Artificial Sequence
  PCR primer for ORF amplification
tggaagtggttcaggaatgaaggaactgctttactataca

SEQ ID NO: 15952 - DNA, 40 bp, Artificial Sequence
  PCR primer for ORF amplification
tggaagtggttcaggaatgaatcctcaagtcagtaacatc

SEQ ID NO: 15953 - DNA, 40 bp, Artificial Sequence
  PCR primer for ORF amplification
tggaagtggttcaggaatgcctttagaatctatatgggcc

SEQ ID NO: 15954 - DNA, 40 bp, Artificial Sequence
  PCR primer for ORF amplification
tggaagtggttcaggaatggattacgatagctctgataca

SEQ ID NO: 15955 - DNA, 40 bp, Artificial Sequence
  PCR primer for ORF amplification
tggaagtggttcaggaatggatttacccaaggacaaaagt

SEQ ID NO: 15956 - DNA, 40 bp, Artificial Sequence
  PCR primer for ORF amplification
tggaagtggttcaggaatgggcaaaaccgcggataatcat

SEQ ID NO: 15957 - DNA, 40 bp, Artificial Sequence
  PCR primer for ORF amplification
tggaagtggttcaggaatggatgataagaaaacatggagt

SEQ ID NO: 15958 - DNA, 40 bp, Artificial Sequence
  PCR primer for ORF amplification
tggaagtggttcaggaatgggtaaagctaagaaaacaaga

SEQ ID NO: 15959 - DNA, 40 bp, Artificial Sequence
  PCR primer for ORF amplification
tggaagtggttcaggaatggtgccgaatttggatttggaa

SEQ ID NO: 15960 - DNA, 40 bp, Artificial Sequence
  PCR primer for ORF amplification
tggaagtggttcaggaatgtccaattttttacttgtgatc

SEQ ID NO: 15961 - DNA, 40 bp, Artificial Sequence
  PCR primer for ORF amplification
tggaagtggttcaggaatgtcttctttatcgctatatact

SEQ ID NO: 15962 - DNA, 40 bp, Artificial Sequence
  PCR primer for ORF amplification
tggaagtggttcaggaatgacggttggtacacttcccatc

SEQ ID NO: 15963 - DNA, 40 bp, Artificial Sequence
  PCR primer for ORF amplification
tggaagtggttcaggaatgagtgaacaggagccttacgaa

SEQ ID NO: 15964 - DNA, 40 bp, Artificial Sequence
  PCR primer for ORF amplification
tggaagtggttcaggaatggatccattgactgtatacaaa

SEQ ID NO: 15965 - DNA, 40 bp, Artificial Sequence
  PCR primer for ORF amplification
tggaagtggttcaggaatgggagccaagacgtcaaagctt

SEQ ID NO: 15966 - DNA, 40 bp, Artificial Sequence
  PCR primer for ORF amplification
tggaagtggttcaggaatgtccagattaagaagattcaat

SEQ ID NO: 15967 - DNA, 40 bp, Artificial Sequence
  PCR primer for ORF amplification
tggaagtggttcaggaatgtccggtaaatggagactagtg

SEQ ID NO: 15968 - DNA, 40 bp, Artificial Sequence
  PCR primer for ORF amplification
tggaagtggttcaggaatgtcctctcaaaaaagtatgtaa

SEQ ID NO: 15969 - DNA, 40 bp, Artificial Sequence
  PCR primer for ORF amplification
tggaagtggttcaggaatgaaagtgggtattataatgggt

SEQ ID NO: 15970 - DNA, 40 bp, Artificial Sequence
  PCR primer for ORF amplification
tggaagtggttcaggaatgaaatacatccaaactgaacaa

SEQ ID NO: 15971 - DNA, 40 bp, Artificial Sequence
  PCR primer for ORF amplification
tggaagtggttcaggaatgaagtacattcaaaccgaacaa

SEQ ID NO: 15972 - DNA, 40 bp, Artificial Sequence
  PCR primer for ORF amplification
tggaagtggttcaggaatgcaaacgctaaagtgtgttgtt

SEQ ID NO: 15973 - DNA, 40 bp, Artificial Sequence
  PCR primer for ORF amplification
tggaagtggttcaggaatggaaaaatttggtttaaaagcg

SEQ ID NO: 15974 - DNA, 40 bp, Artificial Sequence
  PCR primer for ORF amplification
tggaagtggttcaggaatggaggatcaggatgctgcattt

SEQ ID NO: 15975 - DNA, 40 bp, Artificial Sequence
  PCR primer for ORF amplification
tggaagtggttcaggaatggcctcctcaagtagcacgcta

SEQ ID NO: 15976 - DNA, 40 bp, Artificial Sequence
  PCR primer for ORF amplification
tggaagtggttcaggaatggctgtttctaatatatggcaa

SEQ ID NO: 15977 - DNA, 40 bp, Artificial Sequence
  PCR primer for ORF amplification
tggaagtggttcaggaatgggactactaagtattatcagg

SEQ ID NO: 15978 - DNA, 40 bp, Artificial Sequence
  PCR primer for ORF amplification
tggaagtggttcaggaatgctattgtttcctggcttgaag

SEQ ID NO: 15979 - DNA, 40 bp, Artificial Sequence
  PCR primer for ORF amplification
tggaagtggttcaggaatgtctgaaaaggccgttagaagg

SEQ ID NO: 15980 - DNA, 40 bp, Artificial Sequence
  PCR primer for ORF amplification
tggaagtggttcaggaatgacagagaaacacaaaactatg

SEQ ID NO: 15981 - DNA, 40 bp, Artificial Sequence
  PCR primer for ORF amplification
tggaagtggttcaggaatgacagctcatgcaaatgaaagg

SEQ ID NO: 15982 - DNA, 40 bp, Artificial Sequence
  PCR primer for ORF amplification
tggaagtggttcaggaatggttacccttgaatacaatgca

SEQ ID NO: 15983 - DNA, 40 bp, Artificial Sequence
  PCR primer for ORF amplification
tggaagtggttcaggaatggtttctaccacgcaatcgagg

SEQ ID NO: 15984 - DNA, 40 bp, Artificial Sequence
  PCR primer for ORF amplification
tggaagtggttcaggaatgtccccaactggaaactactta

SEQ ID NO: 15985 - DNA, 40 bp, Artificial Sequence
  PCR primer for ORF amplification
tggaagtggttcaggaatgtctgctgttgcaacttatttg

SEQ ID NO: 15986 - DNA, 40 bp, Artificial Sequence
  PCR primer for ORF amplification
tggaagtggttcaggaatgtgtttagtcaaaactacggct

SEQ ID NO: 15987 - DNA, 40 bp, Artificial Sequence
  PCR primer for ORF amplification
tggaagtggttcaggaatgagtagtttgtgtctacagcgt

SEQ ID NO: 15988 - DNA, 40 bp, Artificial Sequence
  PCR primer for ORF amplification
tggaagtggttcaggaatgggttactatgacattgatgat

SEQ ID NO: 15989 - DNA, 40 bp, Artificial Sequence
  PCR primer for ORF amplification
tggaagtggttcaggaatggtgacttctaatgttgtccta

SEQ ID NO: 15990 - DNA, 40 bp, Artificial Sequence
  PCR primer for ORF amplification
tggaagtggttcaggaatgtccttacgtatactagcgaag

SEQ ID NO: 15991 - DNA, 40 bp, Artificial Sequence
  PCR primer for ORF amplification
tggaagtggttcaggaatgtcgaattttggcagaagaact

SEQ ID NO: 15992 - DNA, 40 bp, Artificial Sequence
  PCR primer for ORF amplification
tggaagtggttcaggaatggaaaacgataagggccaatta

SEQ ID NO: 15993 - DNA, 40 bp, Artificial Sequence
  PCR primer for ORF amplification
tggaagtggttcaggaatgacaacaattcagccttttgaa

SEQ ID NO: 15994 - DNA, 40 bp, Artificial Sequence
  PCR primer for ORF amplification
tggaagtggttcaggaatgacagatccccacttgaacacg

SEQ ID NO: 15995 - DNA, 40 bp, Artificial Sequence
  PCR primer for ORF amplification
tggaagtggttcaggaatgattggcagaggtgtgtgctgc

SEQ ID NO: 15996 - DNA, 40 bp, Artificial Sequence
  PCR primer for ORF amplification
tggaagtggttcaggaatggagccattgatatcggcaccg

SEQ ID NO: 15997 - DNA, 40 bp, Artificial Sequence
  PCR primer for ORF amplification
tggaagtggttcaggaatggccttcaccacaattcgatcg

SEQ ID NO: 15998 - DNA, 40 bp, Artificial Sequence
  PCR primer for ORF amplification
tggaagtggttcaggaatggtgaccgtggtggcggagaca

SEQ ID NO: 15999 - DNA, 40 bp, Artificial Sequence
  PCR primer for ORF amplification
tggaagtggttcaggaatgtccgggtcgttaaaatctcta

SEQ ID NO: 16000 - DNA, 40 bp, Artificial Sequence
  PCR primer for ORF amplification
tggaagtggttcaggaatgtcttggcaaggtatgtgaacg

SEQ ID NO: 16001 - DNA, 40 bp, Artificial Sequence
  PCR primer for ORF amplification
tggaagtggttcaggaatgaaacagatagtcaaaagaagc

SEQ ID NO: 16002 - DNA, 40 bp, Artificial Sequence
  PCR primer for ORF amplification
tggaagtggttcaggaatgaaagcaaccattcaaagagta

SEQ ID NO: 16003 - DNA, 40 bp, Artificial Sequence
  PCR primer for ORF amplification
tggaagtggttcaggaatgaatgttacagttactgtttat

SEQ ID NO: 16004 - DNA, 40 bp, Artificial Sequence
  PCR primer for ORF amplification
tggaagtggttcaggaatgagcaaaatacaggtggcacat

SEQ ID NO: 16005 - DNA, 40 bp, Artificial Sequence
  PCR primer for ORF amplification
tggaagtggttcaggaatgagtagggccaaagaattacaa

SEQ ID NO: 16006 - DNA, 40 bp, Artificial Sequence
  PCR primer for ORF amplification
tggaagtggttcaggaatgcagataataaccactacgttc

SEQ ID NO: 16007 - DNA, 40 bp, Artificial Sequence
  PCR primer for ORF amplification
tggaagtggttcaggaatgccaccaaaaggttggagaaaa

SEQ ID NO: 16008 - DNA, 40 bp, Artificial Sequence
  PCR primer for ORF amplification
tggaagtggttcaggaatgggcgtattagaaaatatagta

SEQ ID NO: 16009 - DNA, 40 bp, Artificial Sequence
  PCR primer for ORF amplification
tggaagtggttcaggaatggtagcagaagttcaaaaacaa

SEQ ID NO: 16010 - DNA, 40 bp, Artificial Sequence
  PCR primer for ORF amplification
tggaagtggttcaggaatggtcgctcaagttcaaaagcaa

SEQ ID NO: 16011 - DNA, 40 bp, Artificial Sequence
  PCR primer for ORF amplification
tggaagtggttcaggaatggttgataataggcgtacgttt

SEQ ID NO: 16012 - DNA, 40 bp, Artificial Sequence
  PCR primer for ORF amplification
tggaagtggttcaggaatgtcacaatcaatatcactaaag

SEQ ID NO: 16013 - DNA, 40 bp, Artificial Sequence
  PCR primer for ORF amplification
tggaagtggttcaggaatgaaatacatacccccattaaat

SEQ ID NO: 16014 - DNA, 40 bp, Artificial Sequence
  PCR primer for ORF amplification
tggaagtggttcaggaatgaagttattgcatttatatgaa

SEQ ID NO: 16015 - DNA, 40 bp, Artificial Sequence
  PCR primer for ORF amplification
tggaagtggttcaggaatgagcaacaacgaaattgtattt

SEQ ID NO: 16016 - DNA, 40 bp, Artificial Sequence
  PCR primer for ORF amplification
tggaagtggttcaggaatgatgcattttagaaagaaatcc

SEQ ID NO: 16017 - DNA, 40 bp, Artificial Sequence
  PCR primer for ORF amplification
tggaagtggttcaggaatgatgttaagactagtaactaaa

SEQ ID NO: 16018 - DNA, 40 bp, Artificial Sequence
  PCR primer for ORF amplification
tggaagtggttcaggaatggaactccgtagtttttctaga

SEQ ID NO: 16019 - DNA, 40 bp, Artificial Sequence
  PCR primer for ORF amplification
tggaagtggttcaggaatggaagcaagacggtatggaccg

SEQ ID NO: 16020 - DNA, 40 bp, Artificial Sequence
  PCR primer for ORF amplification
tggaagtggttcaggaatgtctgtttgtttagccatcaca

SEQ ID NO: 16021 - DNA, 40 bp, Artificial Sequence
  PCR primer for ORF amplification
tggaagtggttcaggaatgtttaccagtgccattagattg

SEQ ID NO: 16022 - DNA, 40 bp, Artificial Sequence; identical to SEQ ID NO: 15494
  PCR primer for ORF amplification

SEQ ID NO: 16023 - DNA, 40 bp, Artificial Sequence
  PCR primer for ORF amplification
tggaagtggttcaggaatgaataaagaccaggcagaaaaa

SEQ ID NO: 16024 - DNA, 40 bp, Artificial Sequence
  PCR primer for ORF amplification
tggaagtggttcaggaatgactttggcttttaatatgcaa

SEQ ID NO: 16025 - DNA, 40 bp, Artificial Sequence
  PCR primer for ORF amplification
tggaagtggttcaggaatgcaacaagatatcgtcaacgat

SEQ ID NO: 16026 - DNA, 40 bp, Artificial Sequence
  PCR primer for ORF amplification
tggaagtggttcaggaatgccaagagtagctatcatcatt

SEQ ID NO: 16027 - DNA, 40 bp, Artificial Sequence
  PCR primer for ORF amplification
tggaagtggttcaggaatggatattattctgggcatccgt

SEQ ID NO: 16028 - DNA, 40 bp, Artificial Sequence
  PCR primer for ORF amplification
tggaagtggttcaggaatggctattaaaccaaccaaaagt

SEQ ID NO: 16029 - DNA, 40 bp, Artificial Sequence
  PCR primer for ORF amplification
tggaagtggttcaggaatggtccggcctcagaatgttcac

SEQ ID NO: 16030 - DNA, 40 bp, Artificial Sequence
  PCR primer for ORF amplification
tggaagtggttcaggaatggtcgaatctaagaatactgaa

SEQ ID NO: 16031 - DNA, 40 bp, Artificial Sequence
  PCR primer for ORF amplification
tggaagtggttcaggaatggtgagaaatcgttttataaga

SEQ ID NO: 16032 - DNA, 40 bp, Artificial Sequence
  PCR primer for ORF amplification
tggaagtggttcaggaatgtcaatttctctattaggtaga

SEQ ID NO: 16033 - DNA, 40 bp, Artificial Sequence
  PCR primer for ORF amplification
tggaagtggttcaggaatgtctaaagacacgcatgatgat

SEQ ID NO: 16034 - DNA, 40 bp, Artificial Sequence
  PCR primer for ORF amplification
tggaagtggttcaggaatgtctgaattcttttgggatgta

SEQ ID NO: 16035 - DNA, 40 bp, Artificial Sequence
  PCR primer for ORF amplification
tggaagtggttcaggaatgtctgcaatgatggtcaagtta

SEQ ID NO: 16036 - DNA, 40 bp, Artificial Sequence
  PCR primer for ORF amplification
tggaagtggttcaggaatgttaagagaagtcatctattgt

SEQ ID NO: 16037 - DNA, 40 bp, Artificial Sequence
  PCR primer for ORF amplification
tggaagtggttcaggaatgtttcatttagtcaagggactt

SEQ ID NO: 16038 - DNA, 40 bp, Artificial Sequence
  PCR primer for ORF amplification
tggaagtggttcaggaatgacatcgattaacagttttccc

SEQ ID NO: 16039 - DNA, 40 bp, Artificial Sequence
  PCR primer for ORF amplification
tggaagtggttcaggaatgagaatttatcaatgccatttt

SEQ ID NO: 16040 - DNA, 40 bp, Artificial Sequence
  PCR primer for ORF amplification
tggaagtggttcaggaatggaagcaaccatcaaagtggta

SEQ ID NO: 16041 - DNA, 40 bp, Artificial Sequence
  PCR primer for ORF amplification
tggaagtggttcaggaatggacaaaatcagagaaaagcta

SEQ ID NO: 16042 - DNA, 40 bp, Artificial Sequence
  PCR primer for ORF amplification
tggaagtggttcaggaatggacacactgttcaactccacg

SEQ ID NO: 16043 - DNA, 40 bp, Artificial Sequence
  PCR primer for ORF amplification
tggaagtggttcaggaatggaccaggcaagaaatttctac

SEQ ID NO: 16044 - DNA, 40 bp, Artificial Sequence
  PCR primer for ORF amplification
tggaagtggttcaggaatggcgaaacacattgttgctgcc

SEQ ID NO: 16045 - DNA, 40 bp, Artificial Sequence
  PCR primer for ORF amplification
tggaagtggttcaggaatggtatgttagtatccaataaat

SEQ ID NO: 16046 - DNA, 40 bp, Artificial Sequence
  PCR primer for ORF amplification
tggaagtggttcaggaatgtctgcaaacgaattctactca

SEQ ID NO: 16047 - DNA, 40 bp, Artificial Sequence
  PCR primer for ORF amplification
tggaagtggttcaggaatgggtatttctcgtgattctcgt

SEQ ID NO: 16048 - DNA, 40 bp, Artificial Sequence
  PCR primer for ORF amplification
tggaagtggttcaggaatgaagtctagtaagcaattggtt

SEQ ID NO: 16049 - DNA, 40 bp, Artificial Sequence
  PCR primer for ORF amplification
tggaagtggttcaggaatgagaatctactacatcggtgta

SEQ ID NO: 16050 - DNA, 40 bp, Artificial Sequence
  PCR primer for ORF amplification
tggaagtggttcaggaatgagttacgataagaaggcagat

SEQ ID NO: 16051 - DNA, 40 bp, Artificial Sequence
  PCR primer for ORF amplification
tggaagtggttcaggaatggagcaaatattatataatcaa

SEQ ID NO: 16052 - DNA, 40 bp, Artificial Sequence
  PCR primer for ORF amplification
tggaagtggttcaggaatggcaggtatcaagttgacgcat

SEQ ID NO: 16053 - DNA, 40 bp, Artificial Sequence
  PCR primer for ORF amplification
tggaagtggttcaggaatggcttggactagtacattacca

SEQ ID NO: 16054 - DNA, 40 bp, Artificial Sequence
  PCR primer for ORF amplification
tggaagtggttcaggaatgggcctacacagtgaaccgtta

SEQ ID NO: 16055 - DNA, 40 bp, Artificial Sequence
  PCR primer for ORF amplification
tggaagtggttcaggaatggtacgttaatattgtgttaaa

SEQ ID NO: 16056 - DNA, 40 bp, Artificial Sequence
  PCR primer for ORF amplification
tggaagtggttcaggaatgggtgctgctccttccaaaatt

SEQ ID NO: 16057 - DNA, 40 bp, Artificial Sequence
  PCR primer for ORF amplification
tggaagtggttcaggaatgaaaccagtaacatgttgcaac

SEQ ID NO: 16058 - DNA, 40 bp, Artificial Sequence
  PCR primer for ORF amplification
tggaagtggttcaggaatgagtagtgacggcatgaacaga

SEQ ID NO: 16059 - DNA, 40 bp, Artificial Sequence
  PCR primer for ORF amplification
tggaagtggttcaggaatggatgagatggataatgtgata

SEQ ID NO: 16060 - DNA, 40 bp, Artificial Sequence
  PCR primer for ORF amplification
tggaagtggttcaggaatggctaggccagttaatacaaac

SEQ ID NO: 16061 - DNA, 40 bp, Artificial Sequence
  PCR primer for ORF amplification
tggaagtggttcaggaatggttaactcacatggaatacgg

SEQ ID NO: 16062 - DNA, 40 bp, Artificial Sequence
  PCR primer for ORF amplification
tggaagtggttcaggaatgtcagccaatgtacaagaagct

SEQ ID NO: 16063 - DNA, 40 bp, Artificial Sequence
  PCR primer for ORF amplification
tggaagtggttcaggaatgtccaacttagttaaagaaaaa

SEQ ID NO: 16064 - DNA, 40 bp, Artificial Sequence
  PCR primer for ORF amplification
tggaagtggttcaggaatgtctagcgaagataagaaacct

SEQ ID NO: 16065 - DNA, 40 bp, Artificial Sequence
  PCR primer for ORF amplification
tggaagtggttcaggaatgtctagtgccatcgttgctaaa

SEQ ID NO: 16066 - DNA, 40 bp, Artificial Sequence; identical to SEQ ID NO: 15460
  PCR primer for ORF amplification

SEQ ID NO: 16067 - DNA, 40 bp, Artificial Sequence
  PCR primer for ORF amplification
tggaagtggttcaggaatgacaacattgatgggaaagttt

SEQ ID NO: 16068 - DNA, 40 bp, Artificial Sequence
  PCR primer for ORF amplification
tggaagtggttcaggaatgctaaattataaattgatttta

SEQ ID NO: 16069 - DNA, 40 bp, Artificial Sequence
  PCR primer for ORF amplification
tggaagtggttcaggaatggccgaagaaagtaccgacttt

SEQ ID NO: 16070 - DNA, 40 bp, Artificial Sequence
  PCR primer for ORF amplification
tggaagtggttcaggaatggctactaatattacttggcat

SEQ ID NO: 16071 - DNA, 40 bp, Artificial Sequence
  PCR primer for ORF amplification
tggaagtggttcaggaatgggtattattgaagaaaaggct

SEQ ID NO: 16072 - DNA, 40 bp, Artificial Sequence
  PCR primer for ORF amplification
tggaagtggttcaggaatgtctgcattacctccagtatac

SEQ ID NO: 16073 - DNA, 40 bp, Artificial Sequence
  PCR primer for ORF amplification
tggaagtggttcaggaatgaatcagttaggagctttagcc

SEQ ID NO: 16074 - DNA, 40 bp, Artificial Sequence
  PCR primer for ORF amplification
tggaagtggttcaggaatgtctagatctgggtatgctaaa

SEQ ID NO: 16075 - DNA, 40 bp, Artificial Sequence
  PCR primer for ORF amplification
tggaagtggttcaggaatgttcaatcgttttaacaaattc

SEQ ID NO: 16076 - DNA, 40 bp, Artificial Sequence
  PCR primer for ORF amplification
tggaagtggttcaggaatgaaagaggcagaacttagtgcg

SEQ ID NO: 16077 - DNA, 40 bp, Artificial Sequence
  PCR primer for ORF amplification
tggaagtggttcaggaatgataaatgagtacgttgccaga

SEQ ID NO: 16078 - DNA, 40 bp, Artificial Sequence
  PCR primer for ORF amplification
tggaagtggttcaggaatgcttagaaataccattgcatta

SEQ ID NO: 16079 - DNA, 40 bp, Artificial Sequence
  PCR primer for ORF amplification
tggaagtggttcaggaatggacaaagcatttgacgaaatt

SEQ ID NO: 16080 - DNA, 40 bp, Artificial Sequence
  PCR primer for ORF amplification
tggaagtggttcaggaatggaggattcgagattgcttatc

SEQ ID NO: 16081 - DNA, 40 bp, Artificial Sequence
  PCR primer for ORF amplification
tggaagtggttcaggaatggcctcatttgctactaagttt

SEQ ID NO: 16082 - DNA, 40 bp, Artificial Sequence
  PCR primer for ORF amplification
tggaagtggttcaggaatggctattgttataaacaaaaga

SEQ ID NO: 16083 - DNA, 40 bp, Artificial Sequence
  PCR primer for ORF amplification
tggaagtggttcaggaatggctcaagccttgaactccacc

SEQ ID NO: 16084 - DNA, 40 bp, Artificial Sequence
  PCR primer for ORF amplification
tggaagtggttcaggaatggtttcgataagaaggtatttg

SEQ ID NO: 16085 - DNA, 40 bp, Artificial Sequence
  PCR primer for ORF amplification
tggaagtggttcaggaatgtcagcagaagattacaagaac

SEQ ID NO: 16086 - DNA, 40 bp, Artificial Sequence
  PCR primer for ORF amplification
tggaagtggttcaggaatgtcagttgaagaaaaaaagcgc

SEQ ID NO: 16087 - DNA, 40 bp, Artificial Sequence
  PCR primer for ORF amplification
tggaagtggttcaggaatgtcattatattacaccttggtt

SEQ ID NO: 16088 - DNA, 40 bp, Artificial Sequence
  PCR primer for ORF amplification
tggaagtggttcaggaatgaaactcaatgaacaaatacca

SEQ ID NO: 16089 - DNA, 40 bp, Artificial Sequence
  PCR primer for ORF amplification
tggaagtggttcaggaatgaaattctcttccgctttggtt

SEQ ID NO: 16090 - DNA, 40 bp, Artificial Sequence
  PCR primer for ORF amplification
tggaagtggttcaggaatgaagttctcttctgttactgct

SEQ ID NO: 16091 - DNA, 40 bp, Artificial Sequence
  PCR primer for ORF amplification
tggaagtggttcaggaatgaatagcggtggtagtgatagt

SEQ ID NO: 16092 - DNA, 40 bp, Artificial Sequence
  PCR primer for ORF amplification
tggaagtggttcaggaatgacagctgccactacatcacag

SEQ ID NO: 16093 - DNA, 40 bp, Artificial Sequence
  PCR primer for ORF amplification
tggaagtggttcaggaatggcaccaaagaaaccttctaag

SEQ ID NO: 16094 - DNA, 40 bp, Artificial Sequence
  PCR primer for ORF amplification
tggaagtggttcaggaatgggagcctacaaatatttagaa

SEQ ID NO: 16095 - DNA, 40 bp, Artificial Sequence
  PCR primer for ORF amplification
tggaagtggttcaggaatgggcaatgtgtctgtggcagtg

SEQ ID NO: 16096 - DNA, 40 bp, Artificial Sequence
  PCR primer for ORF amplification
tggaagtggttcaggaatgggtgcctacaaatatttggaa

SEQ ID NO: 16097 - DNA, 40 bp, Artificial Sequence
  PCR primer for ORF amplification
tggaagtggttcaggaatgtcacgtaattctgcagcaggt

SEQ ID NO: 16098 - DNA, 40 bp, Artificial Sequence
  PCR primer for ORF amplification
tggaagtggttcaggaatgtttcacagacgcaaaagacct

SEQ ID NO: 16099 - DNA, 40 bp, Artificial Sequence
  PCR primer for ORF amplification
tggaagtggttcaggaatgagaatagtgccagaaaagctg

SEQ ID NO: 16100 - DNA, 40 bp, Artificial Sequence
  PCR primer for ORF amplification
tggaagtggttcaggaatgaaattcagtggcttgtggtgt

SEQ ID NO: 16101 - DNA, 40 bp, Artificial Sequence
  PCR primer for ORF amplification
tggaagtggttcaggaatgagcacacaatatattgatgag

SEQ ID NO: 16102 - DNA, 40 bp, Artificial Sequence
  PCR primer for ORF amplification
tggaagtggttcaggaatgagtttcagaggaggtaataga

SEQ ID NO: 16103 - DNA, 40 bp, Artificial Sequence
  PCR primer for ORF amplification
tggaagtggttcaggaatgcaacgtacgagggaattggaa

SEQ ID NO: 16104 - DNA, 40 bp, Artificial Sequence
  PCR primer for ORF amplification
tggaagtggttcaggaatgcgttggtggccgtggtcaaat

SEQ ID NO: 16105 - DNA, 40 bp, Artificial Sequence
  PCR primer for ORF amplification
tggaagtggttcaggaatgcttgtgcggctgttgcgtgtg

SEQ ID NO: 16106 - DNA, 40 bp, Artificial Sequence
  PCR primer for ORF amplification
tggaagtggttcaggaatgtcggatccaagttctattaac

SEQ ID NO: 16107 - DNA, 40 bp, Artificial Sequence
  PCR primer for ORF amplification
tggaagtggttcaggaatgaaggagtcagtccaagagatc

SEQ ID NO: 16108 - DNA, 40 bp, Artificial Sequence
  PCR primer for ORF amplification
tggaagtggttcaggaatgaatagcgagtacgattacctg

SEQ ID NO: 16109 - DNA, 40 bp, Artificial Sequence
  PCR primer for ORF amplification
tggaagtggttcaggaatgagtttatactttacgacatta

SEQ ID NO: 16110 - DNA, 40 bp, Artificial Sequence
  PCR primer for ORF amplification
tggaagtggttcaggaatgagtttcctaaacatttttact

SEQ ID NO: 16111 - DNA, 40 bp, Artificial Sequence
  PCR primer for ORF amplification
tggaagtggttcaggaatgagtttcctaagcatttttact

SEQ ID NO: 16112 - DNA, 40 bp, Artificial Sequence
  PCR primer for ORF amplification
tggaagtggttcaggaatgatgccctacaacacccctcca

SEQ ID NO: 16113 - DNA, 40 bp, Artificial Sequence
  PCR primer for ORF amplification
tggaagtggttcaggaatgattttattaaagaggacaaaa

SEQ ID NO: 16114 - DNA, 40 bp, Artificial Sequence
  PCR primer for ORF amplification
tggaagtggttcaggaatgcctagtcatcgcaattcaaac

SEQ ID NO: 16115 - DNA, 40 bp, Artificial Sequence
  PCR primer for ORF amplification
tggaagtggttcaggaatggattttgaggaagattacgat

SEQ ID NO: 16116 - DNA, 40 bp, Artificial Sequence
  PCR primer for ORF amplification
tggaagtggttcaggaatgtcatcttcgctgagccaaaca

SEQ ID NO: 16117 - DNA, 40 bp, Artificial Sequence
  PCR primer for ORF amplification
tggaagtggttcaggaatgtccgaatttaatgaaacaaaa

SEQ ID NO: 16118 - DNA, 40 bp, Artificial Sequence
  PCR primer for ORF amplification
tggaagtggttcaggaatggtacgtaatgcctcattagga

SEQ ID NO: 16119 - DNA, 40 bp, Artificial Sequence
  PCR primer for ORF amplification
tggaagtggttcaggaatgtctgactctattatttccttt

SEQ ID NO: 16120 - DNA, 40 bp, Artificial Sequence
  PCR primer for ORF amplification
tggaagtggttcaggaatgacagtacagtcaagccccatt

SEQ ID NO: 16121 - DNA, 40 bp, Artificial Sequence
  PCR primer for ORF amplification
tggaagtggttcaggaatgactgtcatgaatcttttcttc

SEQ ID NO: 16122 - DNA, 40 bp, Artificial Sequence
  PCR primer for ORF amplification
tggaagtggttcaggaatgcgcgtttttactttgattgcg

SEQ ID NO: 16123 - DNA, 40 bp, Artificial Sequence
  PCR primer for ORF amplification
tggaagtggttcaggaatgctcaagcgtattgttggattg

SEQ ID NO: 16124 - DNA, 40 bp, Artificial Sequence
  PCR primer for ORF amplification
tggaagtggttcaggaatggtgtacacaggatttggtttg

SEQ ID NO: 16125 - DNA, 40 bp, Artificial Sequence
  PCR primer for ORF amplification
tggaagtggttcaggaatggttttgataataaggccctca

SEQ ID NO: 16126 - DNA, 40 bp, Artificial Sequence
  PCR primer for ORF amplification
tggaagtggttcaggaatgtctacatatgaaggtatgtaa

SEQ ID NO: 16127 - DNA, 40 bp, Artificial Sequence
  PCR primer for ORF amplification
tggaagtggttcaggaatgggtagtatgtagtaggacatt

SEQ ID NO: 16128 - DNA, 40 bp, Artificial Sequence
  PCR primer for ORF amplification
tggaagtggttcaggaatgagcctaattcaccccgataca

SEQ ID NO: 16129 - DNA, 40 bp, Artificial Sequence
  PCR primer for ORF amplification
tggaagtggttcaggaatggaaaagatgacagtttcttcg

SEQ ID NO: 16130 - DNA, 40 bp, Artificial Sequence
  PCR primer for ORF amplification
tggaagtggttcaggaatggtgtatttctatgaatcaaaa

SEQ ID NO: 16131 - DNA, 40 bp, Artificial Sequence
  PCR primer for ORF amplification
tggaagtggttcaggaatgtacagcaatcataatttaaat

SEQ ID NO: 16132 - DNA, 40 bp, Artificial Sequence
  PCR primer for ORF amplification
tggaagtggttcaggaatgtatggagatttaggtaataaa

SEQ ID NO: 16133 - DNA, 40 bp, Artificial Sequence
  PCR primer for ORF amplification
tggaagtggttcaggaatgtccctggaagaatttgacgaa

SEQ ID NO: 16134 - DNA, 40 bp, Artificial Sequence
  PCR primer for ORF amplification
tggaagtggttcaggaatgtcttctagaaaaaaaaatatt

SEQ ID NO: 16135 - DNA, 40 bp, Artificial Sequence
  PCR primer for ORF amplification
tggaagtggttcaggaatgtttacaccaattgatcaagct

SEQ ID NO: 16136 - DNA, 40 bp, Artificial Sequence
  PCR primer for ORF amplification
tggaagtggttcaggaatgaacatatacacatcacccacg

SEQ ID NO: 16137 - DNA, 40 bp, Artificial Sequence
  PCR primer for ORF amplification
tggaagtggttcaggaatgactactttagcatcaagtatt

SEQ ID NO: 16138 - DNA, 40 bp, Artificial Sequence
  PCR primer for ORF amplification
tggaagtggttcaggaatgatatcaccatcaaaaaagaga

SEQ ID NO: 16139 - DNA, 40 bp, Artificial Sequence
  PCR primer for ORF amplification
tggaagtggttcaggaatggaatacgccactatgtcttct

SEQ ID NO: 16140 - DNA, 40 bp, Artificial Sequence
  PCR primer for ORF amplification
tggaagtggttcaggaatggccgaaaatgagagaatgtac

SEQ ID NO: 16141 - DNA, 40 bp, Artificial Sequence
  PCR primer for ORF amplification
tggaagtggttcaggaatgtcacaacaagttggtaacagt

SEQ ID NO: 16142 - DNA, 40 bp, Artificial Sequence
  PCR primer for ORF amplification
tggaagtggttcaggaatgaataaaatacccattaaagac

SEQ ID NO: 16143 - DNA, 40 bp, Artificial Sequence
  PCR primer for ORF amplification
tggaagtggttcaggaatgaacaatactgatcctacttca

SEQ ID NO: 16144 - DNA, 40 bp, Artificial Sequence
  PCR primer for ORF amplification
tggaagtggttcaggaatgaacacatcagtcacttccata

SEQ ID NO: 16145 - DNA, 40 bp, Artificial Sequence
  PCR primer for ORF amplification
tggaagtggttcaggaatgatgagtcaagtatcgcattcc

SEQ ID NO: 16146 - DNA, 40 bp, Artificial Sequence
  PCR primer for ORF amplification
tggaagtggttcaggaatgattttacgggagcagatcgac

SEQ ID NO: 16147 - DNA, 40 bp, Artificial Sequence
  PCR primer for ORF amplification
tggaagtggttcaggaatgccgaaagtcgctattttgatt

SEQ ID NO: 16148 - DNA, 40 bp, Artificial Sequence
  PCR primer for ORF amplification
tggaagtggttcaggaatgcctgattcatcacattcaata

SEQ ID NO: 16149 - DNA, 40 bp, Artificial Sequence
  PCR primer for ORF amplification
tggaagtggttcaggaatgcttcaatccgttgtctttttc

SEQ ID NO: 16150 - DNA, 40 bp, Artificial Sequence
  PCR primer for ORF amplification
tggaagtggttcaggaatggttgctaagaagagaaacacg

SEQ ID NO: 16151 - DNA, 40 bp, Artificial Sequence
  PCR primer for ORF amplification
tggaagtggttcaggaatgtccgtttccaagattgctttc

SEQ ID NO: 16152 - DNA, 40 bp, Artificial Sequence
  PCR primer for ORF amplification
tggaagtggttcaggaatgttctcatattcagatttctgt

SEQ ID NO: 16153 - DNA, 40 bp, Artificial Sequence
  PCR primer for ORF amplification
tggaagtggttcaggaatgagaggaaaacaaccgaaaagg

SEQ ID NO: 16154 - DNA, 40 bp, Artificial Sequence
  PCR primer for ORF amplification
tggaagtggttcaggaatgagcaccgcattcaacgattac

SEQ ID NO: 16155 - DNA, 40 bp, Artificial Sequence
  PCR primer for ORF amplification
tggaagtggttcaggaatgcaaaacggcacagaagacaaa

SEQ ID NO: 16156 - DNA, 40 bp, Artificial Sequence
  PCR primer for ORF amplification
tggaagtggttcaggaatgcaggtgttacagttatggttg

SEQ ID NO: 16157 - DNA, 40 bp, Artificial Sequence
  PCR primer for ORF amplification
tggaagtggttcaggaatgctaagacgctctaaaaattcc

SEQ ID NO: 16158 - DNA, 40 bp, Artificial Sequence
  PCR primer for ORF amplification
tggaagtggttcaggaatggatagcaaagaatatctgata

SEQ ID NO: 16159 - DNA, 40 bp, Artificial Sequence
  PCR primer for ORF amplification
tggaagtggttcaggaatggatgctgtaatactgaatctc

SEQ ID NO: 16160 - DNA, 40 bp, Artificial Sequence
  PCR primer for ORF amplification
tggaagtggttcaggaatggccactaagcaattactgaga

SEQ ID NO: 16161 - DNA, 40 bp, Artificial Sequence
  PCR primer for ORF amplification
tggaagtggttcaggaatggctcaaagtaaaagtaatcct

SEQ ID NO: 16162 - DNA, 40 bp, Artificial Sequence
  PCR primer for ORF amplification
tggaagtggttcaggaatggctggaggaaagattcctatt

SEQ ID NO: 16163 - DNA, 40 bp, Artificial Sequence
  PCR primer for ORF amplification
tggaagtggttcaggaatgggtaatattataacggatacg

SEQ ID NO: 16164 - DNA, 40 bp, Artificial Sequence
  PCR primer for ORF amplification
tggaagtggttcaggaatgaaatataatatagtgcatgga

SEQ ID NO: 16165 - DNA, 40 bp, Artificial Sequence
  PCR primer for ORF amplification
tggaagtggttcaggaatgagcacatccgccagcggtcca

SEQ ID NO: 16166 - DNA, 40 bp, Artificial Sequence
  PCR primer for ORF amplification
tggaagtggttcaggaatgctctcatactatgaacacaat

SEQ ID NO: 16167 - DNA, 40 bp, Artificial Sequence
  PCR primer for ORF amplification
tggaagtggttcaggaatggctgatttatttgctcctgct

SEQ ID NO: 16168 - DNA, 40 bp, Artificial Sequence
  PCR primer for ORF amplification
tggaagtggttcaggaatgtcgtccacggatatcaagcct

SEQ ID NO: 16169 - DNA, 40 bp, Artificial Sequence
  PCR primer for ORF amplification
tggaagtggttcaggaatgtgggaacaaagacgacaaaag

SEQ ID NO: 16170 - DNA, 40 bp, Artificial Sequence
  PCR primer for ORF amplification
tggaagtggttcaggaatgtttaatagagtctttaccagg

SEQ ID NO: 16171 - DNA, 40 bp, Artificial Sequence
  PCR primer for ORF amplification
tggaagtggttcaggaatgtttatcctttcaaaaatcgct

SEQ ID NO: 16172 - DNA, 40 bp, Artificial Sequence
  PCR primer for ORF amplification
tggaagtggttcaggaatgaaagtaaaggctacaaaacta

SEQ ID NO: 16173 - DNA, 40 bp, Artificial Sequence
  PCR primer for ORF amplification
tggaagtggttcaggaatgaacaaggaatctaaagatgat

SEQ ID NO: 16174 - DNA, 40 bp, Artificial Sequence
  PCR primer for ORF amplification
tggaagtggttcaggaatgaactacagcgcagactctggt

SEQ ID NO: 16175 - DNA, 40 bp, Artificial Sequence
  PCR primer for ORF amplification
tggaagtggttcaggaatgaagtacattattgagcatatg

SEQ ID NO: 16176 - DNA, 40 bp, Artificial Sequence
  PCR primer for ORF amplification
tggaagtggttcaggaatgattatgaatagtacaaacaca

SEQ ID NO: 16177 - DNA, 40 bp, Artificial Sequence
  PCR primer for ORF amplification
tggaagtggttcaggaatggaatatgaagatttggaactg

SEQ ID NO: 16178 - DNA, 40 bp, Artificial Sequence
  PCR primer for ORF amplification
tggaagtggttcaggaatgggacttatttcatacgaaaat

SEQ ID NO: 16179 - DNA, 40 bp, Artificial Sequence
  PCR primer for ORF amplification
tggaagtggttcaggaatgtcacaaaaggataacctactc

SEQ ID NO: 16180 - DNA, 40 bp, Artificial Sequence
  PCR primer for ORF amplification
tggaagtggttcaggaatgtcactaccggcacatttgcag

SEQ ID NO: 16181 - DNA, 40 bp, Artificial Sequence
  PCR primer for ORF amplification
tggaagtggttcaggaatgtccgttgaagaagttagcaag

SEQ ID NO: 16182 - DNA, 40 bp, Artificial Sequence
  PCR primer for ORF amplification
tggaagtggttcaggaatgaacattctgcgaatagcatgt

SEQ ID NO: 16183 - DNA, 40 bp, Artificial Sequence
  PCR primer for ORF amplification
tggaagtggttcaggaatgagcgacaagatatcctttcta

SEQ ID NO: 16184 - DNA, 40 bp, Artificial Sequence
  PCR primer for ORF amplification
tggaagtggttcaggaatgagtaatggacacgtcaagttt

SEQ ID NO: 16185 - DNA, 40 bp, Artificial Sequence
  PCR primer for ORF amplification
tggaagtggttcaggaatgataaagtcaacactaatctac

SEQ ID NO: 16186 - DNA, 40 bp, Artificial Sequence
  PCR primer for ORF amplification
tggaagtggttcaggaatggccagaattgtcgtattaatt

SEQ ID NO: 16187 - DNA, 40 bp, Artificial Sequence
  PCR primer for ORF amplification
tggaagtggttcaggaatgtcatttaacagtccatttttt

SEQ ID NO: 16188 - DNA, 40 bp, Artificial Sequence
  PCR primer for ORF amplification
tggaagtggttcaggaatgtcatttattcagaggaggtta

SEQ ID NO: 16189 - DNA, 40 bp, Artificial Sequence
  PCR primer for ORF amplification
tggaagtggttcaggaatgactgcagttaacatctggaag

SEQ ID NO: 16190 - DNA, 40 bp, Artificial Sequence
  PCR primer for ORF amplification
tggaagtggttcaggaatgagcagatccgggaaatcattg

SEQ ID NO: 16191 - DNA, 40 bp, Artificial Sequence
  PCR primer for ORF amplification
tggaagtggttcaggaatgagcgaggaaccaccttctgac

SEQ ID NO: 16192 - DNA, 40 bp, Artificial Sequence
  PCR primer for ORF amplification
tggaagtggttcaggaatgagctgtaccactgataagtta

SEQ ID NO: 16193 - DNA, 40 bp, Artificial Sequence
  PCR primer for ORF amplification
tggaagtggttcaggaatgatcaaatctacaattgctcta

SEQ ID NO: 16194 - DNA, 40 bp, Artificial Sequence
  PCR primer for ORF amplification
tggaagtggttcaggaatggaccaagaaaatgaaagaaac

SEQ ID NO: 16195 - DNA, 40 bp, Artificial Sequence
  PCR primer for ORF amplification
tggaagtggttcaggaatggatttttacaaattagacgag

SEQ ID NO: 16196 - DNA, 40 bp, Artificial Sequence
  PCR primer for ORF amplification
tggaagtggttcaggaatgggccttttggcttatatccct

SEQ ID NO: 16197 - DNA, 40 bp, Artificial Sequence
  PCR primer for ORF amplification
tggaagtggttcaggaatgggtgaagcactacgtagatca

SEQ ID NO: 16198 - DNA, 40 bp, Artificial Sequence
  PCR primer for ORF amplification
tggaagtggttcaggaatgtcaggcttgagaactgtttct

SEQ ID NO: 16199 - DNA, 40 bp, Artificial Sequence
  PCR primer for ORF amplification
tggaagtggttcaggaatgtctagggctaagagaattatg

SEQ ID NO: 16200 - DNA, 40 bp, Artificial Sequence
  PCR primer for ORF amplification
tggaagtggttcaggaatgtctgcttcattgattaatcgt

SEQ ID NO: 16201 - DNA, 40 bp, Artificial Sequence
  PCR primer for ORF amplification
tggaagtggttcaggaatgttaggaataagatcatctgtc

SEQ ID NO: 16202 - DNA, 40 bp, Artificial Sequence
  PCR primer for ORF amplification
tggaagtggttcaggaatgttcgaaattaaactgaatgat

SEQ ID NO: 16203 - DNA, 40 bp, Artificial Sequence
  PCR primer for ORF amplification
tggaagtggttcaggaatgagtgatactacggaagtccct

SEQ ID NO: 16204 - DNA, 40 bp, Artificial Sequence
  PCR primer for ORF amplification
tggaagtggttcaggaatgtttaagaagtatgtctaacat

SEQ ID NO: 16205 - DNA, 40 bp, Artificial Sequence
  PCR primer for ORF amplification
tggaagtggttcaggaatgcaagcaagtttacctggcgaa

SEQ ID NO: 16206 - DNA, 40 bp, Artificial Sequence
  PCR primer for ORF amplification
tggaagtggttcaggaatgaagactttaattgttgttgat

SEQ ID NO: 16207 - DNA, 40 bp, Artificial Sequence
  PCR primer for ORF amplification
tggaagtggttcaggaatgatgggtcgtggcaaattaata

SEQ ID NO: 16208 - DNA, 40 bp, Artificial Sequence
  PCR primer for ORF amplification
tggaagtggttcaggaatgattgaccgcactaaaaacgaa

SEQ ID NO: 16209 - DNA, 40 bp, Artificial Sequence
  PCR primer for ORF amplification
tggaagtggttcaggaatgtcacaaggtcagtccaaaaaa

SEQ ID NO: 16210 - DNA, 40 bp, Artificial Sequence
  PCR primer for ORF amplification
tggaagtggttcaggaatgtccgataaagttattaaccct

SEQ ID NO: 16211 - DNA, 40 bp, Artificial Sequence
  PCR primer for ORF amplification
tggaagtggttcaggaatgtcttcggaaccatttaagaac

SEQ ID NO: 16212 - DNA, 40 bp, Artificial Sequence
  PCR primer for ORF amplification
tggaagtggttcaggaatgttatcacactacatcttcctg

SEQ ID NO: 16213 - DNA, 40 bp, Artificial Sequence
  PCR primer for ORF amplification
tggaagtggttcaggaatgttattggacgcgcagcgattt

SEQ ID NO: 16214 - DNA, 40 bp, Artificial Sequence
  PCR primer for ORF amplification
tggaagtggttcaggaatgtttatggcaagacaagtgtta

SEQ ID NO: 16215 - DNA, 40 bp, Artificial Sequence
  PCR primer for ORF amplification
tggaagtggttcaggaatggtagtatccatcataccgcaa

SEQ ID NO: 16216 - DNA, 40 bp, Artificial Sequence
  PCR primer for ORF amplification
tggaagtggttcaggaatgaaagcaatagataaaatgacg

SEQ ID NO: 16217 - DNA, 40 bp, Artificial Sequence
  PCR primer for ORF amplification
tggaagtggttcaggaatgagttccctattaatatcatac

SEQ ID NO: 16218 - DNA, 40 bp, Artificial Sequence
  PCR primer for ORF amplification
tggaagtggttcaggaatgctgttacaacctgtttggaaa

SEQ ID NO: 16219 - DNA, 40 bp, Artificial Sequence
  PCR primer for ORF amplification
tggaagtggttcaggaatggatcaaagtgtggaagactta

SEQ ID NO: 16220 - DNA, 40 bp, Artificial Sequence
  PCR primer for ORF amplification
tggaagtggttcaggaatgggaaaggcctgtttgaataaa

SEQ ID NO: 16221 - DNA, 40 bp, Artificial Sequence
  PCR primer for ORF amplification
tggaagtggttcaggaatgggagtgaagcaaaccccacca

SEQ ID NO: 16222 - DNA, 40 bp, Artificial Sequence
  PCR primer for ORF amplification
tggaagtggttcaggaatgtcaaaaaaacttgcgtcacca

SEQ ID NO: 16223 - DNA, 40 bp, Artificial Sequence
  PCR primer for ORF amplification
tggaagtggttcaggaatgtcatggaggtatgcgttaaaa

SEQ ID NO: 16224 - DNA, 40 bp, Artificial Sequence
  PCR primer for ORF amplification
tggaagtggttcaggaatgtccaagatcacttcttctcaa

SEQ ID NO: 16225 - DNA, 40 bp, Artificial Sequence
  PCR primer for ORF amplification
tggaagtggttcaggaatgtctaagatcacctcttctcaa

SEQ ID NO: 16226 - DNA, 40 bp, Artificial Sequence
  PCR primer for ORF amplification
tggaagtggttcaggaatgggtagtatgtacaggaattat

SEQ ID NO: 16227 - DNA, 40 bp, Artificial Sequence
  PCR primer for ORF amplification
tggaagtggttcaggaatgaagattgaaaaggcttctcat

SEQ ID NO: 16228 - DNA, 40 bp, Artificial Sequence
  PCR primer for ORF amplification
tggaagtggttcaggaatgacaaagctacaaggactacag

SEQ ID NO: 16229 - DNA, 40 bp, Artificial Sequence
  PCR primer for ORF amplification
tggaagtggttcaggaatgacacaatataatttcattata

SEQ ID NO: 16230 - DNA, 40 bp, Artificial Sequence
  PCR primer for ORF amplification
tggaagtggttcaggaatggcagattattcttcccttact

SEQ ID NO: 16231 - DNA, 40 bp, Artificial Sequence
  PCR primer for ORF amplification
tggaagtggttcaggaatggtgaccggaatatcggaggaa

SEQ ID NO: 16232 - DNA, 40 bp, Artificial Sequence
  PCR primer for ORF amplification
tggaagtggttcaggaatgtttacgtggactatttatgtt

SEQ ID NO: 16233 - DNA, 40 bp, Artificial Sequence
  PCR primer for ORF amplification
tggaagtggttcaggaatgaaccaagcaatagacttcgca

SEQ ID NO: 16234 - DNA, 40 bp, Artificial Sequence
  PCR primer for ORF amplification
tggaagtggttcaggaatgaggttccagcttttcatatat

SEQ ID NO: 16235 - DNA, 40 bp, Artificial Sequence
  PCR primer for ORF amplification
tggaagtggttcaggaatgccagctaaaaaaaggactaga

SEQ ID NO: 16236 - DNA, 40 bp, Artificial Sequence
  PCR primer for ORF amplification
tggaagtggttcaggaatgcttttaacctctcttttacag

SEQ ID NO: 16237 - DNA, 40 bp, Artificial Sequence
  PCR primer for ORF amplification
tggaagtggttcaggaatggaacatctcgccaacgaaaac

SEQ ID NO: 16238 - DNA, 40 bp, Artificial Sequence
  PCR primer for ORF amplification
tggaagtggttcaggaatggccatcgaaacaatacttgta

SEQ ID NO: 16239 - DNA, 40 bp, Artificial Sequence
  PCR primer for ORF amplification
tggaagtggttcaggaatggcttcatgcttttcagtttca

SEQ ID NO: 16240 - DNA, 40 bp, Artificial Sequence
  PCR primer for ORF amplification
tggaagtggttcaggaatgtctaacgaaattgaattactg

SEQ ID NO: 16241 - DNA, 40 bp, Artificial Sequence
  PCR primer for ORF amplification
tggaagtggttcaggaatgtctgccccagctgctaacggt

SEQ ID NO: 16242 - DNA, 40 bp, Artificial Sequence
  PCR primer for ORF amplification
tggaagtggttcaggaatgttaaagttaacaacaacatcc

SEQ ID NO: 16243 - DNA, 40 bp, Artificial Sequence
  PCR primer for ORF amplification
tggaagtggttcaggaatgattcatgcagttctaatatgt

SEQ ID NO: 16244 - DNA, 40 bp, Artificial Sequence
  PCR primer for ORF amplification
tggaagtggttcaggaatgacagagcagaaagccctagta

SEQ ID NO: 16245 - DNA, 40 bp, Artificial Sequence
  PCR primer for ORF amplification
tggaagtggttcaggaatgagttcgaattcaacaccagaa

SEQ ID NO: 16246 - DNA, 40 bp, Artificial Sequence
  PCR primer for ORF amplification
tggaagtggttcaggaatggaggaagaagaattaagtaaa

SEQ ID NO: 16247 - DNA, 40 bp, Artificial Sequence
  PCR primer for ORF amplification
tggaagtggttcaggaatggataaacatacagcagctatt

SEQ ID NO: 16248 - DNA, 40 bp, Artificial Sequence
  PCR primer for ORF amplification
tggaagtggttcaggaatggcttctagagtggacgaaact

SEQ ID NO: 16249 - DNA, 40 bp, Artificial Sequence
  PCR primer for ORF amplification
tggaagtggttcaggaatggtaaagtcaacaagcaaaact

SEQ ID NO: 16250 - DNA, 40 bp, Artificial Sequence
  PCR primer for ORF amplification
tggaagtggttcaggaatgtcagcacctgctcaaaacaat

SEQ ID NO: 16251 - DNA, 40 bp, Artificial Sequence
  PCR primer for ORF amplification
tggaagtggttcaggaatgtccataggttacaaagacaac

SEQ ID NO: 16252 - DNA, 40 bp, Artificial Sequence
  PCR primer for ORF amplification
tggaagtggttcaggaatgtcggcaggtgatatatcagcc

SEQ ID NO: 16253 - DNA, 40 bp, Artificial Sequence
  PCR primer for ORF amplification
tggaagtggttcaggaatgaatgtttctacatcaaccttt

SEQ ID NO: 16254 - DNA, 40 bp, Artificial Sequence
  PCR primer for ORF amplification
tggaagtggttcaggaatgagcgctaccgaatcttcatct

SEQ ID NO: 16255 - DNA, 40 bp, Artificial Sequence
  PCR primer for ORF amplification
tggaagtggttcaggaatgagtgaccaaatcaacgttttg

SEQ ID NO: 16256 - DNA, 40 bp, Artificial Sequence
  PCR primer for ORF amplification
tggaagtggttcaggaatgcgatataataattatgacaac

SEQ ID NO: 16257 - DNA, 40 bp, Artificial Sequence
  PCR primer for ORF amplification
tggaagtggttcaggaatgctaccgaccccttatgtaaaa

SEQ ID NO: 16258 - DNA, 40 bp, Artificial Sequence
  PCR primer for ORF amplification
tggaagtggttcaggaatggccagcatagacgcattttcg

SEQ ID NO: 16259 - DNA, 40 bp, Artificial Sequence
  PCR primer for ORF amplification
tggaagtggttcaggaatggctagaagaccagctagatgt

SEQ ID NO: 16260 - DNA, 40 bp, Artificial Sequence
  PCR primer for ORF amplification
tggaagtggttcaggaatgggaattcaggaaaagacattg

SEQ ID NO: 16261 - DNA, 40 bp, Artificial Sequence
  PCR primer for ORF amplification
tggaagtggttcaggaatgggccaaaaaagtagtaaagtg

SEQ ID NO: 16262 - DNA, 40 bp, Artificial Sequence
  PCR primer for ORF amplification
tggaagtggttcaggaatgtcggcaaacgataagcaatac

SEQ ID NO: 16263 - DNA, 40 bp, Artificial Sequence
  PCR primer for ORF amplification
tggaagtggttcaggaatgaccgtcgttatcggagtcttg

SEQ ID NO: 16264 - DNA, 40 bp, Artificial Sequence
  PCR primer for ORF amplification
tggaagtggttcaggaatgaacgctaatatatgggtggct

SEQ ID NO: 16265 - DNA, 40 bp, Artificial Sequence
  PCR primer for ORF amplification
tggaagtggttcaggaatgaagtttttcccactccttttg

SEQ ID NO: 16266 - DNA, 40 bp, Artificial Sequence
  PCR primer for ORF amplification
tggaagtggttcaggaatgaccgaattagattatcaagga

SEQ ID NO: 16267 - DNA, 40 bp, Artificial Sequence
  PCR primer for ORF amplification
tggaagtggttcaggaatgagcaacgaagattacggatac

SEQ ID NO: 16268 - DNA, 40 bp, Artificial Sequence
  PCR primer for ORF amplification
tggaagtggttcaggaatgcacaatcaggaagagtggcta

SEQ ID NO: 16269 - DNA, 40 bp, Artificial Sequence
  PCR primer for ORF amplification
tggaagtggttcaggaatgtccaatgatcctggtaatgag

SEQ ID NO: 16270 - DNA, 40 bp, Artificial Sequence
  PCR primer for ORF amplification
tggaagtggttcaggaatgtcgtggctttttggagataag

SEQ ID NO: 16271 - DNA, 40 bp, Artificial Sequence
  PCR primer for ORF amplification
tggaagtggttcaggaatgtctagctcagaatccattaga

SEQ ID NO: 16272 - DNA, 40 bp, Artificial Sequence
  PCR primer for ORF amplification
tggaagtggttcaggaatgaaaaccaataagaaaatttct

SEQ ID NO: 16273 - DNA, 40 bp, Artificial Sequence
  PCR primer for ORF amplification
tggaagtggttcaggaatgaagaaacaaatattaatagtt

SEQ ID NO: 16274 - DNA, 40 bp, Artificial Sequence
  PCR primer for ORF amplification
tggaagtggttcaggaatgacgaagaatgtattgatgtta

SEQ ID NO: 16275 - DNA, 40 bp, Artificial Sequence
  PCR primer for ORF amplification
tggaagtggttcaggaatgagcagcgaggactacgggtat

SEQ ID NO: 16276 - DNA, 40 bp, Artificial Sequence
  PCR primer for ORF amplification
tggaagtggttcaggaatgagcgtccaagcagaaataggg

SEQ ID NO: 16277 - DNA, 40 bp, Artificial Sequence
  PCR primer for ORF amplification
tggaagtggttcaggaatgagctcacaaccgtctttcgtc

SEQ ID NO: 16278 - DNA, 40 bp, Artificial Sequence
  PCR primer for ORF amplification
tggaagtggttcaggaatggaggataaggagaaacttatt

SEQ ID NO: 16279 - DNA, 40 bp, Artificial Sequence
  PCR primer for ORF amplification
tggaagtggttcaggaatggcagccaggaatcgtagaaag

SEQ ID NO: 16280 - DNA, 40 bp, Artificial Sequence
  PCR primer for ORF amplification
tggaagtggttcaggaatgtcacaatctactgcatcactg

SEQ ID NO: 16281 - DNA, 40 bp, Artificial Sequence
  PCR primer for ORF amplification
tggaagtggttcaggaatgtcgaaggatgtaatagaatac

SEQ ID NO: 16282 - DNA, 40 bp, Artificial Sequence
  PCR primer for ORF amplification
tggaagtggttcaggaatgaaagtacaaatgatagaaagg

SEQ ID NO: 16283 - DNA, 40 bp, Artificial Sequence
  PCR primer for ORF amplification
tggaagtggttcaggaatgaacaacagtgaagatccgttt

SEQ ID NO: 16284 - DNA, 40 bp, Artificial Sequence
  PCR primer for ORF amplification
tggaagtggttcaggaatgaagattttaacccaagacgaa

SEQ ID NO: 16285 - DNA, 40 bp, Artificial Sequence
  PCR primer for ORF amplification
tggaagtggttcaggaatgacactagtgactccgttacaa

SEQ ID NO: 16286 - DNA, 40 bp, Artificial Sequence
  PCR primer for ORF amplification
tggaagtggttcaggaatgatatttgctccttctttctcc

SEQ ID NO: 16287 - DNA, 40 bp, Artificial Sequence
  PCR primer for ORF amplification
tggaagtggttcaggaatgatgtcttcagaccaacagggg

SEQ ID NO: 16288 - DNA, 40 bp, Artificial Sequence
  PCR primer for ORF amplification
tggaagtggttcaggaatgcacaaaacccacagtacaatg

SEQ ID NO: 16289 - DNA, 40 bp, Artificial Sequence
  PCR primer for ORF amplification
tggaagtggttcaggaatggattatataaaaaaagccata

SEQ ID NO: 16290 - DNA, 40 bp, Artificial Sequence
  PCR primer for ORF amplification
tggaagtggttcaggaatgtctgttattaatttcacaggt

SEQ ID NO: 16291 - DNA, 40 bp, Artificial Sequence
  PCR primer for ORF amplification
tggaagtggttcaggaatgtctttcactgaggatcaagaa

SEQ ID NO: 16292 - DNA, 40 bp, Artificial Sequence
  PCR primer for ORF amplification
tggaagtggttcaggaatgtgggattcgttaattgtaagc

SEQ ID NO: 16293 - DNA, 40 bp, Artificial Sequence
  PCR primer for ORF amplification
tggaagtggttcaggaatgtccgaatatgcatctagtatt

SEQ ID NO: 16294 - DNA, 40 bp, Artificial Sequence
  PCR primer for ORF amplification
tggaagtggttcaggaatgtcacagtacggatttgtaaga

SEQ ID NO: 16295 - DNA, 40 bp, Artificial Sequence
  PCR primer for ORF amplification
tggaagtggttcaggaatgaaagcagacgcgaaacaaata

SEQ ID NO: 16296 - DNA, 40 bp, Artificial Sequence
  PCR primer for ORF amplification
tggaagtggttcaggaatgaagcttcaatttttttccttt

SEQ ID NO: 16297 - DNA, 40 bp, Artificial Sequence
  PCR primer for ORF amplification
tggaagtggttcaggaatgaggttttctatgttaatcggg

SEQ ID NO: 16298 - DNA, 40 bp, Artificial Sequence
  PCR primer for ORF amplification
tggaagtggttcaggaatggggtccgaggaagataaaaag

SEQ ID NO: 16299 - DNA, 40 bp, Artificial Sequence
  PCR primer for ORF amplification
tggaagtggttcaggaatggtcgtaattaacggggtcaaa

SEQ ID NO: 16300 - DNA, 40 bp, Artificial Sequence
  PCR primer for ORF amplification
tggaagtggttcaggaatgtccaatttatgtgtacttttc

SEQ ID NO: 16301 - DNA, 40 bp, Artificial Sequence
  PCR primer for ORF amplification
tggaagtggttcaggaatgtctgacaccgaagctccagtt

SEQ ID NO: 16302 - DNA, 40 bp, Artificial Sequence
  PCR primer for ORF amplification
tggaagtggttcaggaatgtctgacggaacactgtttact

SEQ ID NO: 16303 - DNA, 40 bp, Artificial Sequence
  PCR primer for ORF amplification
tggaagtggttcaggaatgaaggtaaaccattcaatttca

SEQ ID NO: 16304 - DNA, 40 bp, Artificial Sequence
  PCR primer for ORF amplification
tggaagtggttcaggaatgcctattatgttggaagactac

SEQ ID NO: 16305 - DNA, 40 bp, Artificial Sequence
  PCR primer for ORF amplification
tggaagtggttcaggaatggccgacatcaataaatatatt

SEQ ID NO: 16306 - DNA, 40 bp, Artificial Sequence
  PCR primer for ORF amplification
tggaagtggttcaggaatggcgacgattgaagatattaag

SEQ ID NO: 16307 - DNA, 40 bp, Artificial Sequence
  PCR primer for ORF amplification
tggaagtggttcaggaatggctccgacaataagcaaaagg

SEQ ID NO: 16308 - DNA, 40 bp, Artificial Sequence
  PCR primer for ORF amplification
tggaagtggttcaggaatgtatgatatattacgcacacga

SEQ ID NO: 16309 - DNA, 40 bp, Artificial Sequence
  PCR primer for ORF amplification
tggaagtggttcaggaatgaatggacttagagttgcagca

SEQ ID NO: 16310 - DNA, 40 bp, Artificial Sequence
  PCR primer for ORF amplification
tggaagtggttcaggaatgcaattcaaaaacgtcgcccta

SEQ ID NO: 16311 - DNA, 40 bp, Artificial Sequence
  PCR primer for ORF amplification
tggaagtggttcaggaatgggagacaattactcgacttac

SEQ ID NO: 16312 - DNA, 40 bp, Artificial Sequence
  PCR primer for ORF amplification
tggaagtggttcaggaatgtctcctatgaaagttgcggtt

SEQ ID NO: 16313 - DNA, 40 bp, Artificial Sequence
  PCR primer for ORF amplification
tggaagtggttcaggaatgtctgcatctactacaagttta

SEQ ID NO: 16314 - DNA, 40 bp, Artificial Sequence
  PCR primer for ORF amplification
tggaagtggttcaggaatgactaaacaagctgaggagacc

SEQ ID NO: 16315 - DNA, 40 bp, Artificial Sequence
  PCR primer for ORF amplification
tggaagtggttcaggaatgactgtttctacttccaagacc

SEQ ID NO: 16316 - DNA, 40 bp, Artificial Sequence
  PCR primer for ORF amplification
tggaagtggttcaggaatgagagctttttcagcagccacc

SEQ ID NO: 16317 - DNA, 40 bp, Artificial Sequence
  PCR primer for ORF amplification
tggaagtggttcaggaatgctgttagaattgatttcttat

SEQ ID NO: 16318 - DNA, 40 bp, Artificial Sequence
  PCR primer for ORF amplification
tggaagtggttcaggaatggctgaattaaacgattatagt

SEQ ID NO: 16319 - DNA, 40 bp, Artificial Sequence
  PCR primer for ORF amplification
tggaagtggttcaggaatgtctaattatcctttgcatcaa

SEQ ID NO: 16320 - DNA, 40 bp, Artificial Sequence
  PCR primer for ORF amplification
tggaagtggttcaggaatgaacaggattttcggatatggg

SEQ ID NO: 16321 - DNA, 40 bp, Artificial Sequence
  PCR primer for ORF amplification
tggaagtggttcaggaatggatggaaatcataggtttact

SEQ ID NO: 16322 - DNA, 40 bp, Artificial Sequence
  PCR primer for ORF amplification
tggaagtggttcaggaatggctccaaacgtacgttaattt

SEQ ID NO: 16323 - DNA, 40 bp, Artificial Sequence
  PCR primer for ORF amplification
tggaagtggttcaggaatgggaggtatacttaaaaacccg

SEQ ID NO: 16324 - DNA, 40 bp, Artificial Sequence
  PCR primer for ORF amplification
tggaagtggttcaggaatgtcaagtaaacaacaatgggtt

SEQ ID NO: 16325 - DNA, 40 bp, Artificial Sequence
  PCR primer for ORF amplification
tggaagtggttcaggaatgttgaggacaaaagtgtttgca

SEQ ID NO: 16326 - DNA, 40 bp, Artificial Sequence
  PCR primer for ORF amplification
tggaagtggttcaggaatggccggtttaaaagacgttgtc

SEQ ID NO: 16327 - DNA, 40 bp, Artificial Sequence
  PCR primer for ORF amplification
tggaagtggttcaggaatgaaattgtttcaaaacagttac

SEQ ID NO: 16328 - DNA, 40 bp, Artificial Sequence
  PCR primer for ORF amplification
tggaagtggttcaggaatgactaaggaagtaccatattat

SEQ ID NO: 16329 - DNA, 40 bp, Artificial Sequence
  PCR primer for ORF amplification
tggaagtggttcaggaatgattttaaccacagctagatta

SEQ ID NO: 16330 - DNA, 40 bp, Artificial Sequence
  PCR primer for ORF amplification
tggaagtggttcaggaatgcctgtcccatctgttactgtc

SEQ ID NO: 16331 - DNA, 40 bp, Artificial Sequence
  PCR primer for ORF amplification
tggaagtggttcaggaatgcgccaggtactacaaaaagat

SEQ ID NO: 16332 - DNA, 40 bp, Artificial Sequence
  PCR primer for ORF amplification
tggaagtggttcaggaatgcgtaagccttctattacgata

SEQ ID NO: 16333 - DNA, 40 bp, Artificial Sequence
  PCR primer for ORF amplification
tggaagtggttcaggaatggaagataaattagacagatac

SEQ ID NO: 16334 - DNA, 40 bp, Artificial Sequence
  PCR primer for ORF amplification
tggaagtggttcaggaatgggtgtttgcactatttttagg

SEQ ID NO: 16335 - DNA, 40 bp, Artificial Sequence
  PCR primer for ORF amplification
tggaagtggttcaggaatgaatgggttggtattaggcgct

SEQ ID NO: 16336 - DNA, 40 bp, Artificial Sequence
  PCR primer for ORF amplification
tggaagtggttcaggaatgacatccgttagaaaaagaaag

SEQ ID NO: 16337 - DNA, 40 bp, Artificial Sequence
  PCR primer for ORF amplification
tggaagtggttcaggaatgaccggagcagcaactgcagca

SEQ ID NO: 16338 - DNA, 40 bp, Artificial Sequence
  PCR primer for ORF amplification
tggaagtggttcaggaatgacgagatactattgtgaatac

SEQ ID NO: 16339 - DNA, 40 bp, Artificial Sequence
  PCR primer for ORF amplification
tggaagtggttcaggaatgataccttccaataagagaaat

SEQ ID NO: 16340 - DNA, 40 bp, Artificial Sequence
  PCR primer for ORF amplification
tggaagtggttcaggaatgtcagcttgcccttgcaacatc

SEQ ID NO: 16341 - DNA, 40 bp, Artificial Sequence
  PCR primer for ORF amplification
tggaagtggttcaggaatgtcatttctatgtgggtcagct

SEQ ID NO: 16342 - DNA, 40 bp, Artificial Sequence
  PCR primer for ORF amplification
tggaagtggttcaggaatgtctgagtttttgaatgaaaat

SEQ ID NO: 16343 - DNA, 40 bp, Artificial Sequence
  PCR primer for ORF amplification
tggaagtggttcaggaatgttttacccatataactatagt

SEQ ID NO: 16344 - DNA, 40 bp, Artificial Sequence
  PCR primer for ORF amplification
tggaagtggttcaggaatgtttttgagaaacgtaagagtt

SEQ ID NO: 16345 - DNA, 40 bp, Artificial Sequence
  PCR primer for ORF amplification
tggaagtggttcaggaatgactaatgacaacagtggtatc

SEQ ID NO: 16346 - DNA, 40 bp, Artificial Sequence
  PCR primer for ORF amplification
tggaagtggttcaggaatggacagaaaagctgtcgaagaa

SEQ ID NO: 16347 - DNA, 40 bp, Artificial Sequence
  PCR primer for ORF amplification
tggaagtggttcaggaatggacgtgcctgcagattcccat

SEQ ID NO: 16348 - DNA, 40 bp, Artificial Sequence
  PCR primer for ORF amplification
tggaagtggttcaggaatggcagattatgatagtgcgaaa

SEQ ID NO: 16349 - DNA, 40 bp, Artificial Sequence
  PCR primer for ORF amplification
tggaagtggttcaggaatgtccttcgagaacaaactgcca

SEQ ID NO: 16350 - DNA, 40 bp, Artificial Sequence
  PCR primer for ORF amplification
tggaagtggttcaggaatgtctggaaatagtcaactgcca

SEQ ID NO: 16351 - DNA, 40 bp, Artificial Sequence
  PCR primer for ORF amplification
tggaagtggttcaggaatgttcccctatttaacaagaatg

SEQ ID NO: 16352 - DNA, 40 bp, Artificial Sequence
  PCR primer for ORF amplification
tggaagtggttcaggaatggtacgtagatgcaactatatc

SEQ ID NO: 16353 - DNA, 40 bp, Artificial Sequence
  PCR primer for ORF amplification
tggaagtggttcaggaatgaaacagtttggactggcagcc

SEQ ID NO: 16354 - DNA, 40 bp, Artificial Sequence
  PCR primer for ORF amplification
tggaagtggttcaggaatgaatggcagaggtttcctgatt

SEQ ID NO: 16355 - DNA, 40 bp, Artificial Sequence
  PCR primer for ORF amplification
tggaagtggttcaggaatgacaaaagatttttaccgtcag

SEQ ID NO: 16356 - DNA, 40 bp, Artificial Sequence
  PCR primer for ORF amplification
tggaagtggttcaggaatggcaaatgatgggattcagagg

SEQ ID NO: 16357 - DNA, 40 bp, Artificial Sequence
  PCR primer for ORF amplification
tggaagtggttcaggaatggctaaattacagaggaagaga

SEQ ID NO: 16358 - DNA, 40 bp, Artificial Sequence
  PCR primer for ORF amplification
tggaagtggttcaggaatgtcagagaaattccctcctttg

SEQ ID NO: 16359 - DNA, 40 bp, Artificial Sequence
  PCR primer for ORF amplification
tggaagtggttcaggaatgtccaagctttcgaaagattac

SEQ ID NO: 16360 - DNA, 40 bp, Artificial Sequence
  PCR primer for ORF amplification
tggaagtggttcaggaatgtcctccgctattactgctttg

SEQ ID NO: 16361 - DNA, 40 bp, Artificial Sequence
  PCR primer for ORF amplification
tggaagtggttcaggaatgttatcccgtgtttcagttttc

SEQ ID NO: 16362 - DNA, 40 bp, Artificial Sequence
  PCR primer for ORF amplification
tggaagtggttcaggaatgttcgcgaaaacagcagctgct

SEQ ID NO: 16363 - DNA, 40 bp, Artificial Sequence
  PCR primer for ORF amplification
tggaagtggttcaggaatgaggtttttgaggggatttgta

SEQ ID NO: 16364 - DNA, 40 bp, Artificial Sequence
  PCR primer for ORF amplification
tggaagtggttcaggaatgcaaacaccttcagaaaatacc

SEQ ID NO: 16365 - DNA, 40 bp, Artificial Sequence
  PCR primer for ORF amplification
tggaagtggttcaggaatgcagacccctccagaaagtacc

SEQ ID NO: 16366 - DNA, 40 bp, Artificial Sequence
  PCR primer for ORF amplification
tggaagtggttcaggaatgcagacccctctagaaagtacc

SEQ ID NO: 16367 - DNA, 40 bp, Artificial Sequence
  PCR primer for ORF amplification
tggaagtggttcaggaatggtaaatttttatgatgacgtg

SEQ ID NO: 16368 - DNA, 40 bp, Artificial Sequence
  PCR primer for ORF amplification
tggaagtggttcaggaatgtcagatcttcaaaagttacag

SEQ ID NO: 16369 - DNA, 40 bp, Artificial Sequence
  PCR primer for ORF amplification
tggaagtggttcaggaatgtcgttgccaattatcaaagtc

SEQ ID NO: 16370 - DNA, 40 bp, Artificial Sequence
  PCR primer for ORF amplification
tggaagtggttcaggaatgttcaggaacaattacgacggg

SEQ ID NO: 16371 - DNA, 40 bp, Artificial Sequence
  PCR primer for ORF amplification
tggaagtggttcaggaatgttgcaatttaaactagtttta

SEQ ID NO: 16372 - DNA, 40 bp, Artificial Sequence
  PCR primer for ORF amplification
tggaagtggttcaggaatgttttcacagattgttctttta

SEQ ID NO: 16373 - DNA, 40 bp, Artificial Sequence
  PCR primer for ORF amplification
tggaagtggttcaggaatgcaaaccccttcagaaaatacc

SEQ ID NO: 16374 - DNA, 40 bp, Artificial Sequence
  PCR primer for ORF amplification
tggaagtggttcaggaatgaaaaatattaaaaaaaatcaa

SEQ ID NO: 16375 - DNA, 40 bp, Artificial Sequence
  PCR primer for ORF amplification
tggaagtggttcaggaatgagtagaaatgtagataaggcc

SEQ ID NO: 16376 - DNA, 40 bp, Artificial Sequence
  PCR primer for ORF amplification
tggaagtggttcaggaatgagtcacaagagaaggggcctg

SEQ ID NO: 16377 - DNA, 40 bp, Artificial Sequence
  PCR primer for ORF amplification
tggaagtggttcaggaatgagttcagaattattaatatct

SEQ ID NO: 16378 - DNA, 40 bp, Artificial Sequence
  PCR primer for ORF amplification
tggaagtggttcaggaatgcattgggcagcagcggtagcg

SEQ ID NO: 16379 - DNA, 40 bp, Artificial Sequence
  PCR primer for ORF amplification
tggaagtggttcaggaatggataccaagctatctgtaaca

SEQ ID NO: 16380 - DNA, 40 bp, Artificial Sequence
  PCR primer for ORF amplification
tggaagtggttcaggaatggctgttcacaccaataggcaa

SEQ ID NO: 16381 - DNA, 40 bp, Artificial Sequence
  PCR primer for ORF amplification
tggaagtggttcaggaatgtcatacggaagagaagacact

SEQ ID NO: 16382 - DNA, 40 bp, Artificial Sequence
  PCR primer for ORF amplification
tggaagtggttcaggaatgttttttttcccgaagcttaga

SEQ ID NO: 16383 - DNA, 40 bp, Artificial Sequence
  PCR primer for ORF amplification
tggaagtggttcaggaatgacacatcctgtagcagtgaag

SEQ ID NO: 16384 - DNA, 40 bp, Artificial Sequence
  PCR primer for ORF amplification
tggaagtggttcaggaatgagcggagaaaatcgtgctgtg

SEQ ID NO: 16385 - DNA, 40 bp, Artificial Sequence
  PCR primer for ORF amplification
tggaagtggttcaggaatgccaagatcaaaacgttccaag

SEQ ID NO: 16386 - DNA, 40 bp, Artificial Sequence
  PCR primer for ORF amplification
tggaagtggttcaggaatggagcaaatgcattcattggaa

SEQ ID NO: 16387 - DNA, 40 bp, Artificial Sequence
  PCR primer for ORF amplification
tggaagtggttcaggaatggcaacgatggaaacgaccaca

SEQ ID NO: 16388 - DNA, 40 bp, Artificial Sequence
  PCR primer for ORF amplification
tggaagtggttcaggaatggcgaatttaaatatatttggg

SEQ ID NO: 16389 - DNA, 40 bp, Artificial Sequence
  PCR primer for ORF amplification
tggaagtggttcaggaatggtctgtgatacactggtatat

SEQ ID NO: 16390 - DNA, 40 bp, Artificial Sequence
  PCR primer for ORF amplification
tggaagtggttcaggaatgttaggattatatctatcctcc

SEQ ID NO: 16391 - DNA, 40 bp, Artificial Sequence
  PCR primer for ORF amplification
tggaagtggttcaggaatggctggttgggatatttttggt

SEQ ID NO: 16392 - DNA, 40 bp, Artificial Sequence
  PCR primer for ORF amplification
tggaagtggttcaggaatgactccaaaaagagcgctaata

SEQ ID NO: 16393 - DNA, 40 bp, Artificial Sequence; identical to SEQ ID NO: 16373
  PCR primer for ORF amplification

SEQ ID NO: 16394 - DNA, 40 bp, Artificial Sequence
  PCR primer for ORF amplification
tggaagtggttcaggaatgaaaacggcctacttggcgtca

SEQ ID NO: 16395 - DNA, 40 bp, Artificial Sequence
  PCR primer for ORF amplification
tggaagtggttcaggaatgaacagcaaatctcaacaacaa

SEQ ID NO: 16396 - DNA, 40 bp, Artificial Sequence
  PCR primer for ORF amplification
tggaagtggttcaggaatgaatcaaggttacacacagctt

SEQ ID NO: 16397 - DNA, 40 bp, Artificial Sequence
  PCR primer for ORF amplification
tggaagtggttcaggaatggcaaactctaaatttggatac

SEQ ID NO: 16398 - DNA, 40 bp, Artificial Sequence
  PCR primer for ORF amplification
tggaagtggttcaggaatggccccaaaaaaagttttactc

SEQ ID NO: 16399 - DNA, 40 bp, Artificial Sequence
  PCR primer for ORF amplification
tggaagtggttcaggaatggctcgccaaaattttttaggc

SEQ ID NO: 16400 - DNA, 40 bp, Artificial Sequence
  PCR primer for ORF amplification
tggaagtggttcaggaatggttcttcaatacccccagaat

SEQ ID NO: 16401 - DNA, 40 bp, Artificial Sequence
  PCR primer for ORF amplification
tggaagtggttcaggaatgtcgttaaaggataggtatcta

SEQ ID NO: 16402 - DNA, 40 bp, Artificial Sequence
  PCR primer for ORF amplification
tggaagtggttcaggaatgtgcgatagccatcaaaaggaa

SEQ ID NO: 16403 - DNA, 40 bp, Artificial Sequence
  PCR primer for ORF amplification
tggaagtggttcaggaatgaagttcacccctagcatagtt

SEQ ID NO: 16404 - DNA, 40 bp, Artificial Sequence
  PCR primer for ORF amplification
tggaagtggttcaggaatgacagacacatataatagcata

SEQ ID NO: 16405 - DNA, 40 bp, Artificial Sequence
  PCR primer for ORF amplification
tggaagtggttcaggaatgacagcaacgatcacaaataag

SEQ ID NO: 16406 - DNA, 40 bp, Artificial Sequence
  PCR primer for ORF amplification
tggaagtggttcaggaatgacagtgggtattgctaggaaa

SEQ ID NO: 16407 - DNA, 40 bp, Artificial Sequence
  PCR primer for ORF amplification
tggaagtggttcaggaatgacatctaaagttggtgaatat

SEQ ID NO: 16408 - DNA, 40 bp, Artificial Sequence
  PCR primer for ORF amplification
tggaagtggttcaggaatgacgatacaagcgaagcccagt

SEQ ID NO: 16409 - DNA, 40 bp, Artificial Sequence
  PCR primer for ORF amplification
tggaagtggttcaggaatgcctattaatattcgcagagcg

SEQ ID NO: 16410 - DNA, 40 bp, Artificial Sequence
  PCR primer for ORF amplification
tggaagtggttcaggaatgcgtgccaccactttattatct

SEQ ID NO: 16411 - DNA, 40 bp, Artificial Sequence
  PCR primer for ORF amplification
tggaagtggttcaggaatggattacgagaagtttctgtta

SEQ ID NO: 16412 - DNA, 40 bp, Artificial Sequence
  PCR primer for ORF amplification
tggaagtggttcaggaatggtcaaaccaattatagctccc

SEQ ID NO: 16413 - DNA, 40 bp, Artificial Sequence
  PCR primer for ORF amplification
tggaagtggttcaggaatgtcccacaaattaacaatcctg

SEQ ID NO: 16414 - DNA, 40 bp, Artificial Sequence
  PCR primer for ORF amplification
tggaagtggttcaggaatgtttactggtattgtagaatgc

SEQ ID NO: 16415 - DNA, 40 bp, Artificial Sequence
  PCR primer for ORF amplification
tggaagtggttcaggaatgaaattctccactgctttgtct

SEQ ID NO: 16416 - DNA, 40 bp, Artificial Sequence
  PCR primer for ORF amplification
tggaagtggttcaggaatgaatagtaccgccgctgcaata

SEQ ID NO: 16417 - DNA, 40 bp, Artificial Sequence
  PCR primer for ORF amplification
tggaagtggttcaggaatgagctcaagtttgcctaggtct

SEQ ID NO: 16418 - DNA, 40 bp, Artificial Sequence
  PCR primer for ORF amplification
tggaagtggttcaggaatgatgtcttgtctggtaccaaca

SEQ ID NO: 16419 - DNA, 40 bp, Artificial Sequence
  PCR primer for ORF amplification
tggaagtggttcaggaatgcaccaagattttcaagaagac

SEQ ID NO: 16420 - DNA, 40 bp, Artificial Sequence
  PCR primer for ORF amplification
tggaagtggttcaggaatgcagcctcatttagacaacaac

SEQ ID NO: 16421 - DNA, 40 bp, Artificial Sequence
  PCR primer for ORF amplification
tggaagtggttcaggaatggatgttgaaaaggatgtcctg

SEQ ID NO: 16422 - DNA, 40 bp, Artificial Sequence
  PCR primer for ORF amplification
tggaagtggttcaggaatggcaatagcattatggtattgt

SEQ ID NO: 16423 - DNA, 40 bp, Artificial Sequence
  PCR primer for ORF amplification
tggaagtggttcaggaatggttagcatgatccatattgtg

SEQ ID NO: 16424 - DNA, 40 bp, Artificial Sequence
  PCR primer for ORF amplification
tggaagtggttcaggaatgtctagtatgtttaatcacata

SEQ ID NO: 16425 - DNA, 40 bp, Artificial Sequence
  PCR primer for ORF amplification
tggaagtggttcaggaatgaaagatctccagaaaaaaagc

SEQ ID NO: 16426 - DNA, 40 bp, Artificial Sequence
  PCR primer for ORF amplification
tggaagtggttcaggaatgaaaggaacaggtggagtagta

SEQ ID NO: 16427 - DNA, 40 bp, Artificial Sequence
  PCR primer for ORF amplification
tggaagtggttcaggaatgacttcgaaaaaagtgatatta

SEQ ID NO: 16428 - DNA, 40 bp, Artificial Sequence
  PCR primer for ORF amplification
tggaagtggttcaggaatggccgatgaggaacgtttaaag

SEQ ID NO: 16429 - DNA, 40 bp, Artificial Sequence
  PCR primer for ORF amplification
tggaagtggttcaggaatggtcgctttaatctctaagaaa

SEQ ID NO: 16430 - DNA, 40 bp, Artificial Sequence
  PCR primer for ORF amplification
tggaagtggttcaggaatgtcagggttcattaagagcacg

SEQ ID NO: 16431 - DNA, 40 bp, Artificial Sequence
  PCR primer for ORF amplification
tggaagtggttcaggaatgtctacgttcatattccctggt

SEQ ID NO: 16432 - DNA, 40 bp, Artificial Sequence
  PCR primer for ORF amplification
tggaagtggttcaggaatgtggtcatcactttttggttgg

SEQ ID NO: 16433 - DNA, 40 bp, Artificial Sequence
  PCR primer for ORF amplification
tggaagtggttcaggaatggaaaacgataagggtcaatta

SEQ ID NO: 16434 - DNA, 40 bp, Artificial Sequence
  PCR primer for ORF amplification
tggaagtggttcaggaatggtacgtaccacgagatgttga

SEQ ID NO: 16435 - DNA, 40 bp, Artificial Sequence
  PCR primer for ORF amplification
tggaagtggttcaggaatgaatatgggaggcagtagcagc

SEQ ID NO: 16436 - DNA, 40 bp, Artificial Sequence
  PCR primer for ORF amplification
tggaagtggttcaggaatgagtgaagaagaagcgcataaa

SEQ ID NO: 16437 - DNA, 40 bp, Artificial Sequence
  PCR primer for ORF amplification
tggaagtggttcaggaatgctggtagtgggattgacaggt

SEQ ID NO: 16438 - DNA, 40 bp, Artificial Sequence
  PCR primer for ORF amplification
tggaagtggttcaggaatggccactattgcatcagaatac

SEQ ID NO: 16439 - DNA, 40 bp, Artificial Sequence
  PCR primer for ORF amplification
tggaagtggttcaggaatggtacccgcacctgggtcacgt

SEQ ID NO: 16440 - DNA, 40 bp, Artificial Sequence
  PCR primer for ORF amplification
tggaagtggttcaggaatggtcaaagctgttatttttacc

SEQ ID NO: 16441 - DNA, 40 bp, Artificial Sequence
  PCR primer for ORF amplification
tggaagtggttcaggaatgtctgcgtcactagtgaatcga

SEQ ID NO: 16442 - DNA, 40 bp, Artificial Sequence
  PCR primer for ORF amplification
tggaagtggttcaggaatgtctttttcatctatcttatca

SEQ ID NO: 16443 - DNA, 40 bp, Artificial Sequence
  PCR primer for ORF amplification
tggaagtggttcaggaatggcaccgaaaaagaaatcaaac

SEQ ID NO: 16444 - DNA, 40 bp, Artificial Sequence
  PCR primer for ORF amplification
tggaagtggttcaggaatgttgatgccaaagcaagaaaga

SEQ ID NO: 16445 - DNA, 40 bp, Artificial Sequence
  PCR primer for ORF amplification
tggaagtggttcaggaatgactgataggaatttctcacca

SEQ ID NO: 16446 - DNA, 40 bp, Artificial Sequence
  PCR primer for ORF amplification
tggaagtggttcaggaatgataaaaaactatttgggacga

SEQ ID NO: 16447 - DNA, 40 bp, Artificial Sequence
  PCR primer for ORF amplification
tggaagtggttcaggaatgcaaaaacacaatataaaatta

SEQ ID NO: 16448 - DNA, 40 bp, Artificial Sequence
  PCR primer for ORF amplification
tggaagtggttcaggaatgctcctatttccaagaagaact

SEQ ID NO: 16449 - DNA, 40 bp, Artificial Sequence
  PCR primer for ORF amplification
tggaagtggttcaggaatggaagttttaaagaacattaga

SEQ ID NO: 16450 - DNA, 40 bp, Artificial Sequence
  PCR primer for ORF amplification
tggaagtggttcaggaatggctgtcaatgaatttcaagtg

SEQ ID NO: 16451 - DNA, 40 bp, Artificial Sequence
  PCR primer for ORF amplification
tggaagtggttcaggaatgtcctcgacagtgatttcattg

SEQ ID NO: 16452 - DNA, 40 bp, Artificial Sequence
  PCR primer for ORF amplification
tggaagtggttcaggaatgttgcatttggaagatgacaat

SEQ ID NO: 16453 - DNA, 40 bp, Artificial Sequence
  PCR primer for ORF amplification
tggaagtggttcaggaatggcatcattacccaagagaata

SEQ ID NO: 16454 - DNA, 40 bp, Artificial Sequence
  PCR primer for ORF amplification
tggaagtggttcaggaatgactgtacaaattccaaaatta

SEQ ID NO: 16455 - DNA, 40 bp, Artificial Sequence
  PCR primer for ORF amplification
tggaagtggttcaggaatgcaacaaacaaaatttggcaag

SEQ ID NO: 16456 - DNA, 40 bp, Artificial Sequence
  PCR primer for ORF amplification
tggaagtggttcaggaatgcataacatccaattagtgcaa

SEQ ID NO: 16457 - DNA, 40 bp, Artificial Sequence
  PCR primer for ORF amplification
tggaagtggttcaggaatggctagaaatagaacaacctcc

SEQ ID NO: 16458 - DNA, 40 bp, Artificial Sequence
  PCR primer for ORF amplification
tggaagtggttcaggaatgggaaaatcagcgtatgtaaag

SEQ ID NO: 16459 - DNA, 40 bp, Artificial Sequence
  PCR primer for ORF amplification
tggaagtggttcaggaatgactgtggttgaaataaaaagc

SEQ ID NO: 16460 - DNA, 40 bp, Artificial Sequence
  PCR primer for ORF amplification
tggaagtggttcaggaatgagcatgagtatgggtgtccgt

SEQ ID NO: 16461 - DNA, 40 bp, Artificial Sequence
  PCR primer for ORF amplification
tggaagtggttcaggaatgccagcattattaaaaagatta

SEQ ID NO: 16462 - DNA, 40 bp, Artificial Sequence
  PCR primer for ORF amplification
tggaagtggttcaggaatgcttagtaatacacttattatt

SEQ ID NO: 16463 - DNA, 40 bp, Artificial Sequence
  PCR primer for ORF amplification
tggaagtggttcaggaatggaaacaagaatacttgttgtg

SEQ ID NO: 16464 - DNA, 40 bp, Artificial Sequence
  PCR primer for ORF amplification
tggaagtggttcaggaatgtctgctgttgaaatttcccct

SEQ ID NO: 16465 - DNA, 40 bp, Artificial Sequence
  PCR primer for ORF amplification
tggaagtggttcaggaatgtcttcacaagatgttctgata

SEQ ID NO: 16466 - DNA, 40 bp, Artificial Sequence
  PCR primer for ORF amplification
tggaagtggttcaggaatgtctttgacaccactgtgtgaa

SEQ ID NO: 16467 - DNA, 40 bp, Artificial Sequence
  PCR primer for ORF amplification
tggaagtggttcaggaatgtttaaaagaatcgcaatagcc

SEQ ID NO: 16468 - DNA, 40 bp, Artificial Sequence
  PCR primer for ORF amplification
tggaagtggttcaggaatgaatagatgggtagagaagtgg

SEQ ID NO: 16469 - DNA, 40 bp, Artificial Sequence
  PCR primer for ORF amplification
tggaagtggttcaggaatgacaatggaaaaaaatggaggt

SEQ ID NO: 16470 - DNA, 40 bp, Artificial Sequence
  PCR primer for ORF amplification
tggaagtggttcaggaatgagacaacgaaggtctgtagta

SEQ ID NO: 16471 - DNA, 40 bp, Artificial Sequence
  PCR primer for ORF amplification
tggaagtggttcaggaatgccttatacttggaagttttta

SEQ ID NO: 16472 - DNA, 40 bp, Artificial Sequence
  PCR primer for ORF amplification
tggaagtggttcaggaatggcatgtactaatgatggtcct

SEQ ID NO: 16473 - DNA, 40 bp, Artificial Sequence
  PCR primer for ORF amplification
tggaagtggttcaggaatggctacaccaagcacgggagca

SEQ ID NO: 16474 - DNA, 40 bp, Artificial Sequence
  PCR primer for ORF amplification
tggaagtggttcaggaatggctaccaggactcaatttgaa

SEQ ID NO: 16475 - DNA, 40 bp, Artificial Sequence
  PCR primer for ORF amplification
tggaagtggttcaggaatggctctacctctgataaaacct

SEQ ID NO: 16476 - DNA, 40 bp, Artificial Sequence
  PCR primer for ORF amplification
tggaagtggttcaggaatggctgaaacttccaacgacccc

SEQ ID NO: 16477 - DNA, 40 bp, Artificial Sequence
  PCR primer for ORF amplification
tggaagtggttcaggaatgagtactttagcggaagtaagt

SEQ ID NO: 16478 - DNA, 40 bp, Artificial Sequence
  PCR primer for ORF amplification
tggaagtggttcaggaatgactacagatccttctgtcaaa

SEQ ID NO: 16479 - DNA, 40 bp, Artificial Sequence
  PCR primer for ORF amplification
tggaagtggttcaggaatgagcaaagacaaagatatcaaa

SEQ ID NO: 16480 - DNA, 40 bp, Artificial Sequence
  PCR primer for ORF amplification
tggaagtggttcaggaatgccacaattttcagtagatctt

SEQ ID NO: 16481 - DNA, 40 bp, Artificial Sequence
  PCR primer for ORF amplification
tggaagtggttcaggaatggagagtatatttggtgggttt

SEQ ID NO: 16482 - DNA, 40 bp, Artificial Sequence
  PCR primer for ORF amplification
tggaagtggttcaggaatggcagaattttcagctgatcta

SEQ ID NO: 16483 - DNA, 40 bp, Artificial Sequence
  PCR primer for ORF amplification
tggaagtggttcaggaatggcatctaatcaacctggcaag

SEQ ID NO: 16484 - DNA, 40 bp, Artificial Sequence
  PCR primer for ORF amplification
tggaagtggttcaggaatgtcaagactagaaatatactcg

SEQ ID NO: 16485 - DNA, 40 bp, Artificial Sequence
  PCR primer for ORF amplification
tggaagtggttcaggaatgtctacgttgaaagttgtttca

SEQ ID NO: 16486 - DNA, 40 bp, Artificial Sequence
  PCR primer for ORF amplification
tggaagtggttcaggaatgtttcttaagacacctaattgg

SEQ ID NO: 16487 - DNA, 40 bp, Artificial Sequence
  PCR primer for ORF amplification
tggaagtggttcaggaatgtttgctgcaattgcctcagga

SEQ ID NO: 16488 - DNA, 40 bp, Artificial Sequence
  PCR primer for ORF amplification
tggaagtggttcaggaatgatcttaagcaaaacaaagaaa

SEQ ID NO: 16489 - DNA, 40 bp, Artificial Sequence
  PCR primer for ORF amplification
tggaagtggttcaggaatggtatgtctaataaaaccatca

SEQ ID NO: 16490 - DNA, 40 bp, Artificial Sequence
  PCR primer for ORF amplification
tggaagtggttcaggaatgagtgagcaaagccaattagat

SEQ ID NO: 16491 - DNA, 40 bp, Artificial Sequence
  PCR primer for ORF amplification
tggaagtggttcaggaatgccaaagttagttttagttaga

SEQ ID NO: 16492 - DNA, 40 bp, Artificial Sequence
  PCR primer for ORF amplification
tggaagtggttcaggaatgcctttgttagataccttcaag

SEQ ID NO: 16493 - DNA, 40 bp, Artificial Sequence
  PCR primer for ORF amplification
tggaagtggttcaggaatgctgcattgtgcgaggaggtat

SEQ ID NO: 16494 - DNA, 40 bp, Artificial Sequence
  PCR primer for ORF amplification
tggaagtggttcaggaatggtaaagattgcgataattact

SEQ ID NO: 16495 - DNA, 40 bp, Artificial Sequence
  PCR primer for ORF amplification
tggaagtggttcaggaatgtggagaacaaaaacgctagaa

SEQ ID NO: 16496 - DNA, 40 bp, Artificial Sequence
  PCR primer for ORF amplification
tggaagtggttcaggaatgataagaaatcagggatggtca

SEQ ID NO: 16497 - DNA, 40 bp, Artificial Sequence
  PCR primer for ORF amplification
tggaagtggttcaggaatggatcattcaatagaagtcact

SEQ ID NO: 16498 - DNA, 40 bp, Artificial Sequence
  PCR primer for ORF amplification
tggaagtggttcaggaatggcgaaaactttggcacaagga

SEQ ID NO: 16499 - DNA, 40 bp, Artificial Sequence
  PCR primer for ORF amplification
tggaagtggttcaggaatggctagaactttctttgtcggt

SEQ ID NO: 16500 - DNA, 40 bp, Artificial Sequence
  PCR primer for ORF amplification
tggaagtggttcaggaatgtctttctacaatactagtaac

SEQ ID NO: 16501 - DNA, 40 bp, Artificial Sequence
  PCR primer for ORF amplification
tggaagtggttcaggaatgaagttctcttccggcaaatct

SEQ ID NO: 16502 - DNA, 40 bp, Artificial Sequence
  PCR primer for ORF amplification
tggaagtggttcaggaatgaccacgaacgatacatacgag

SEQ ID NO: 16503 - DNA, 40 bp, Artificial Sequence
  PCR primer for ORF amplification
tggaagtggttcaggaatgatttatacgtcgtcaaagagc

SEQ ID NO: 16504 - DNA, 40 bp, Artificial Sequence
  PCR primer for ORF amplification
tggaagtggttcaggaatgctaatagaggagatagagttt

SEQ ID NO: 16505 - DNA, 40 bp, Artificial Sequence
  PCR primer for ORF amplification
tggaagtggttcaggaatggtgacagtcggtgtgttttct

SEQ ID NO: 16506 - DNA, 40 bp, Artificial Sequence
  PCR primer for ORF amplification
tggaagtggttcaggaatgtccattatgaagcagaggcta

SEQ ID NO: 16507 - DNA, 40 bp, Artificial Sequence
  PCR primer for ORF amplification
tggaagtggttcaggaatgttgcagctaaggtttatgcct

SEQ ID NO: 16508 - DNA, 40 bp, Artificial Sequence
  PCR primer for ORF amplification
tggaagtggttcaggaatgaagttcgaagacctcttggca

SEQ ID NO: 16509 - DNA, 40 bp, Artificial Sequence
  PCR primer for ORF amplification
tggaagtggttcaggaatgaatgttcaagacagaaggagg

SEQ ID NO: 16510 - DNA, 40 bp, Artificial Sequence
  PCR primer for ORF amplification
tggaagtggttcaggaatgaccgacagatattctttttcg

SEQ ID NO: 16511 - DNA, 40 bp, Artificial Sequence
  PCR primer for ORF amplification
tggaagtggttcaggaatgagtgacgacgattatatgaac

SEQ ID NO: 16512 - DNA, 40 bp, Artificial Sequence
  PCR primer for ORF amplification
tggaagtggttcaggaatgataaacacaggaagaagcagg

SEQ ID NO: 16513 - DNA, 40 bp, Artificial Sequence
  PCR primer for ORF amplification
tggaagtggttcaggaatgattgagaataaggttgaactg

SEQ ID NO: 16514 - DNA, 40 bp, Artificial Sequence
  PCR primer for ORF amplification
tggaagtggttcaggaatgcagcatattaaacatatgagg

SEQ ID NO: 16515 - DNA, 40 bp, Artificial Sequence
  PCR primer for ORF amplification
tggaagtggttcaggaatgcctatcaatcaaccgtcggga

SEQ ID NO: 16516 - DNA, 40 bp, Artificial Sequence
  PCR primer for ORF amplification
tggaagtggttcaggaatgcctttgaccacaaaaccttta

SEQ ID NO: 16517 - DNA, 40 bp, Artificial Sequence
  PCR primer for ORF amplification
tggaagtggttcaggaatggacccgattggaataaacaaa

SEQ ID NO: 16518 - DNA, 40 bp, Artificial Sequence
  PCR primer for ORF amplification
tggaagtggttcaggaatggctaaacttgtacatgatgtt

SEQ ID NO: 16519 - DNA, 40 bp, Artificial Sequence
  PCR primer for ORF amplification
tggaagtggttcaggaatggctacaaagcaggctcacaag

SEQ ID NO: 16520 - DNA, 40 bp, Artificial Sequence
  PCR primer for ORF amplification
tggaagtggttcaggaatgggattgactactaaacctcta

SEQ ID NO: 16521 - DNA, 40 bp, Artificial Sequence
  PCR primer for ORF amplification
tggaagtggttcaggaatgggctccaagcacagagtagac

SEQ ID NO: 16522 - DNA, 40 bp, Artificial Sequence
  PCR primer for ORF amplification
tggaagtggttcaggaatgtcccaggaagagaaagtggat

SEQ ID NO: 16523 - DNA, 40 bp, Artificial Sequence
  PCR primer for ORF amplification
tggaagtggttcaggaatgcaaatgtatgttacggcgaat

SEQ ID NO: 16524 - DNA, 40 bp, Artificial Sequence
  PCR primer for ORF amplification
tggaagtggttcaggaatggccccaaacgtatgatacttt

SEQ ID NO: 16525 - DNA, 40 bp, Artificial Sequence
  PCR primer for ORF amplification
tggaagtggttcaggaatgttgatgccaaaggaagacaga

SEQ ID NO: 16526 - DNA, 40 bp, Artificial Sequence
  PCR primer for ORF amplification
tggaagtggttcaggaatgacagtaaaaaaaatagctatt

SEQ ID NO: 16527 - DNA, 40 bp, Artificial Sequence
  PCR primer for ORF amplification
tggaagtggttcaggaatgagttcttataggggcggcagt

SEQ ID NO: 16528 - DNA, 40 bp, Artificial Sequence
  PCR primer for ORF amplification
tggaagtggttcaggaatggacctagatctagccagtatc

SEQ ID NO: 16529 - DNA, 40 bp, Artificial Sequence
  PCR primer for ORF amplification
tggaagtggttcaggaatggcttacatcaagatcgcttta

SEQ ID NO: 16530 - DNA, 40 bp, Artificial Sequence
  PCR primer for ORF amplification
tggaagtggttcaggaatggctttaaggctatttcgaaaa

SEQ ID NO: 16531 - DNA, 40 bp, Artificial Sequence
  PCR primer for ORF amplification
tggaagtggttcaggaatgttagatttattaagattacaa

SEQ ID NO: 16532 - DNA, 40 bp, Artificial Sequence
  PCR primer for ORF amplification
tggaagtggttcaggaatgggtaaaggtaagccaagaggt

SEQ ID NO: 16533 - DNA, 40 bp, Artificial Sequence
  PCR primer for ORF amplification
tggaagtggttcaggaatgaatccgtttagaatcttaggt

SEQ ID NO: 16534 - DNA, 40 bp, Artificial Sequence
  PCR primer for ORF amplification
tggaagtggttcaggaatggctgccgcatgcatttgtcaa

SEQ ID NO: 16535 - DNA, 40 bp, Artificial Sequence
  PCR primer for ORF amplification
tggaagtggttcaggaatgggcttttatgaaggcgatgac

SEQ ID NO: 16536 - DNA, 40 bp, Artificial Sequence
  PCR primer for ORF amplification
tggaagtggttcaggaatggtcgaagattccagagttaga

SEQ ID NO: 16537 - DNA, 40 bp, Artificial Sequence
  PCR primer for ORF amplification
tggaagtggttcaggaatgtcgggtgctgctgctgcatct

SEQ ID NO: 16538 - DNA, 40 bp, Artificial Sequence
  PCR primer for ORF amplification
tggaagtggttcaggaatggaaaatagcatgatgtttata

SEQ ID NO: 16539 - DNA, 40 bp, Artificial Sequence
  PCR primer for ORF amplification
tggaagtggttcaggaatggattatagtaactttggaaac

SEQ ID NO: 16540 - DNA, 40 bp, Artificial Sequence
  PCR primer for ORF amplification
tggaagtggttcaggaatgggtatgtggacgattaggaat

SEQ ID NO: 16541 - DNA, 40 bp, Artificial Sequence
  PCR primer for ORF amplification
tggaagtggttcaggaatgtactttgatgaagaacaattg

SEQ ID NO: 16542 - DNA, 40 bp, Artificial Sequence
  PCR primer for ORF amplification
tggaagtggttcaggaatgttattagatgaccagctgaag

SEQ ID NO: 16543 - DNA, 40 bp, Artificial Sequence
  PCR primer for ORF amplification
tggaagtggttcaggaatgttgaagctagctcgtccattt

SEQ ID NO: 16544 - DNA, 40 bp, Artificial Sequence
  PCR primer for ORF amplification
tggaagtggttcaggaatggcccaacgtgttactttcaga

SEQ ID NO: 16545 - DNA, 40 bp, Artificial Sequence
  PCR primer for ORF amplification
tggaagtggttcaggaatggccggtttgaaagacgttgtc

SEQ ID NO: 16546 - DNA, 40 bp, Artificial Sequence
  PCR primer for ORF amplification
tggaagtggttcaggaatgaatggaattcaagtggacatc

SEQ ID NO: 16547 - DNA, 40 bp, Artificial Sequence
  PCR primer for ORF amplification
tggaagtggttcaggaatgattagtaaagagtatgaattt

SEQ ID NO: 16548 - DNA, 40 bp, Artificial Sequence
  PCR primer for ORF amplification
tggaagtggttcaggaatgaaggcctgttccatattattt

SEQ ID NO: 16549 - DNA, 40 bp, Artificial Sequence
  PCR primer for ORF amplification
tggaagtggttcaggaatgagtatcgctgaattcgcttac

SEQ ID NO: 16550 - DNA, 40 bp, Artificial Sequence
  PCR primer for ORF amplification
tggaagtggttcaggaatgagtggttacgatagagctttg

SEQ ID NO: 16551 - DNA, 40 bp, Artificial Sequence
  PCR primer for ORF amplification
tggaagtggttcaggaatgcgtcaaaagagggctaagtca

SEQ ID NO: 16552 - DNA, 40 bp, Artificial Sequence
  PCR primer for ORF amplification
tggaagtggttcaggaatggcttacactaagatcgcttta

SEQ ID NO: 16553 - DNA, 40 bp, Artificial Sequence
  PCR primer for ORF amplification
tggaagtggttcaggaatgggtaaagttattttagttaca

SEQ ID NO: 16554 - DNA, 40 bp, Artificial Sequence
  PCR primer for ORF amplification
tggaagtggttcaggaatggttagagttgtcatagagagt

SEQ ID NO: 16555 - DNA, 40 bp, Artificial Sequence
  PCR primer for ORF amplification
tggaagtggttcaggaatgtctctgaaaaagcagatacca

SEQ ID NO: 16556 - DNA, 40 bp, Artificial Sequence
  PCR primer for ORF amplification
tggaagtggttcaggaatgtctgctccagaagctcaacaa

SEQ ID NO: 16557 - DNA, 40 bp, Artificial Sequence
  PCR primer for ORF amplification
tggaagtggttcaggaatgttgactatcacgaaaagactg

SEQ ID NO: 16558 - DNA, 40 bp, Artificial Sequence
  PCR primer for ORF amplification
tggaagtggttcaggaatgaccgttaagacaggtatgtga

SEQ ID NO: 16559 - DNA, 40 bp, Artificial Sequence
  PCR primer for ORF amplification
tggaagtggttcaggaatgagatcatctcttctaaccctt

SEQ ID NO: 16560 - DNA, 40 bp, Artificial Sequence
  PCR primer for ORF amplification
tggaagtggttcaggaatgagtttgtttgagtgggtattt

SEQ ID NO: 16561 - DNA, 40 bp, Artificial Sequence
  PCR primer for ORF amplification
tggaagtggttcaggaatggatgaatcggtggatcctgtg

SEQ ID NO: 16562 - DNA, 40 bp, Artificial Sequence
  PCR primer for ORF amplification
tggaagtggttcaggaatggatgtgttgaagctgggttat

SEQ ID NO: 16563 - DNA, 40 bp, Artificial Sequence
  PCR primer for ORF amplification
tggaagtggttcaggaatggctgtcggaaagaataagaga

SEQ ID NO: 16564 - DNA, 40 bp, Artificial Sequence
  PCR primer for ORF amplification
tggaagtggttcaggaatggctgttggtaagaataagaga

SEQ ID NO: 16565 - DNA, 40 bp, Artificial Sequence
  PCR primer for ORF amplification
tggaagtggttcaggaatgggcaaatttgagcaaaaagaa

SEQ ID NO: 16566 - DNA, 40 bp, Artificial Sequence
  PCR primer for ORF amplification
tggaagtggttcaggaatggtatgtagagatgaatataca

SEQ ID NO: 16567 - DNA, 40 bp, Artificial Sequence
  PCR primer for ORF amplification
tggaagtggttcaggaatggtgaaattacaaaggtttagc

SEQ ID NO: 16568 - DNA, 40 bp, Artificial Sequence
  PCR primer for ORF amplification
tggaagtggttcaggaatgttgcgaccactgagaaaaagc

SEQ ID NO: 16569 - DNA, 40 bp, Artificial Sequence
  PCR primer for ORF amplification
tggaagtggttcaggaatgaatacttcatcaagaataact

SEQ ID NO: 16570 - DNA, 40 bp, Artificial Sequence
  PCR primer for ORF amplification
tggaagtggttcaggaatgacaaacatggctgccaagaat

SEQ ID NO: 16571 - DNA, 40 bp, Artificial Sequence
  PCR primer for ORF amplification
tggaagtggttcaggaatgagtgttcgcttatcatacggc

SEQ ID NO: 16572 - DNA, 40 bp, Artificial Sequence
  PCR primer for ORF amplification
tggaagtggttcaggaatggatttcacaaaaccagaaact

SEQ ID NO: 16573 - DNA, 40 bp, Artificial Sequence
  PCR primer for ORF amplification
tggaagtggttcaggaatggccccaggtaagaaagtcgct

SEQ ID NO: 16574 - DNA, 40 bp, Artificial Sequence
  PCR primer for ORF amplification
tggaagtggttcaggaatggctccaggtaagaaagttgct

SEQ ID NO: 16575 - DNA, 40 bp, Artificial Sequence
  PCR primer for ORF amplification
tggaagtggttcaggaatgtctggtaatagagagcaagtc

SEQ ID NO: 16576 - DNA, 40 bp, Artificial Sequence
  PCR primer for ORF amplification
tggaagtggttcaggaatgtggtcgaaaaagtttacatta

SEQ ID NO: 16577 - DNA, 40 bp, Artificial Sequence
  PCR primer for ORF amplification
tggaagtggttcaggaatgttcaaatcagtggctaaattg

SEQ ID NO: 16578 - DNA, 40 bp, Artificial Sequence
  PCR primer for ORF amplification
tggaagtggttcaggaatgtttaatttaattttatggccc

SEQ ID NO: 16579 - DNA, 40 bp, Artificial Sequence
  PCR primer for ORF amplification
tggaagtggttcaggaatgtttgtggtggattggagcgtg

SEQ ID NO: 16580 - DNA, 40 bp, Artificial Sequence
  PCR primer for ORF amplification
tggaagtggttcaggaatgaaaagaagtgaaaaaaaatcg

SEQ ID NO: 16581 - DNA, 40 bp, Artificial Sequence
  PCR primer for ORF amplification
tggaagtggttcaggaatgaactctacaaccccatcgatt

SEQ ID NO: 16582 - DNA, 40 bp, Artificial Sequence
  PCR primer for ORF amplification
tggaagtggttcaggaatgtcacggaaattatgcacacta

SEQ ID NO: 16583 - DNA, 40 bp, Artificial Sequence
  PCR primer for ORF amplification
tggaagtggttcaggaatgtccactggtattacttatgat

SEQ ID NO: 16584 - DNA, 40 bp, Artificial Sequence
  PCR primer for ORF amplification
tggaagtggttcaggaatgtttgttgattattccggactg

SEQ ID NO: 16585 - DNA, 40 bp, Artificial Sequence
  PCR primer for ORF amplification
tggaagtggttcaggaatgaagaagacgttcgagcagttt

SEQ ID NO: 16586 - DNA, 40 bp, Artificial Sequence
  PCR primer for ORF amplification
tggaagtggttcaggaatgcaaaaaattttcagaccattc

SEQ ID NO: 16587 - DNA, 40 bp, Artificial Sequence
  PCR primer for ORF amplification
tggaagtggttcaggaatggatgacgatcacgaacagttg

SEQ ID NO: 16588 - DNA, 40 bp, Artificial Sequence
  PCR primer for ORF amplification
tggaagtggttcaggaatggcacccaagaaatccactacc

SEQ ID NO: 16589 - DNA, 40 bp, Artificial Sequence
  PCR primer for ORF amplification
tggaagtggttcaggaatggctgccggtgtcccaaaaatt

SEQ ID NO: 16590 - DNA, 40 bp, Artificial Sequence
  PCR primer for ORF amplification
tggaagtggttcaggaatgggcagtagatcggagaatgtg

SEQ ID NO: 16591 - DNA, 40 bp, Artificial Sequence
  PCR primer for ORF amplification
tggaagtggttcaggaatgggttccagaagatacgattcc

SEQ ID NO: 16592 - DNA, 40 bp, Artificial Sequence
  PCR primer for ORF amplification
tggaagtggttcaggaatgttagaagcaaaatttgaagaa

SEQ ID NO: 16593 - DNA, 40 bp, Artificial Sequence
  PCR primer for ORF amplification
tggaagtggttcaggaatgagctacaattatttgaaggca

SEQ ID NO: 16594 - DNA, 40 bp, Artificial Sequence
  PCR primer for ORF amplification
tggaagtggttcaggaatgaggtatgtttgataagatata

SEQ ID NO: 16595 - DNA, 40 bp, Artificial Sequence
  PCR primer for ORF amplification
tggaagtggttcaggaatggacggatattgggatgttgta

SEQ ID NO: 16596 - DNA, 40 bp, Artificial Sequence
  PCR primer for ORF amplification
tggaagtggttcaggaatggagccagagagcataggcgat

SEQ ID NO: 16597 - DNA, 40 bp, Artificial Sequence
  PCR primer for ORF amplification
tggaagtggttcaggaatgttcagaaagagattagtgaac

SEQ ID NO: 16598 - DNA, 40 bp, Artificial Sequence
  PCR primer for ORF amplification
tggaagtggttcaggaatgtttaatttattaaatacatat

SEQ ID NO: 16599 - DNA, 40 bp, Artificial Sequence
  PCR primer for ORF amplification
tggaagtggttcaggaatgattttcaaaatattgtgtagt

SEQ ID NO: 16600 - DNA, 40 bp, Artificial Sequence
  PCR primer for ORF amplification
tggaagtggttcaggaatgctttgtcgcaatactgccaga

SEQ ID NO: 16601 - DNA, 40 bp, Artificial Sequence
  PCR primer for ORF amplification
tggaagtggttcaggaatggtgtcgttagacgatatacta

SEQ ID NO: 16602 - DNA, 40 bp, Artificial Sequence
  PCR primer for ORF amplification
tggaagtggttcaggaatgttcttaactagaagtgaatat

SEQ ID NO: 16603 - DNA, 40 bp, Artificial Sequence
  PCR primer for ORF amplification
tggaagtggttcaggaatgtttgtactgatagataatgtc

SEQ ID NO: 16604 - DNA, 40 bp, Artificial Sequence
  PCR primer for ORF amplification
tggaagtggttcaggaatgaagacctatcatttgaataat

SEQ ID NO: 16605 - DNA, 40 bp, Artificial Sequence
  PCR primer for ORF amplification
tggaagtggttcaggaatgacaaaggaagaaggtcgtacg

SEQ ID NO: 16606 - DNA, 40 bp, Artificial Sequence
  PCR primer for ORF amplification
tggaagtggttcaggaatgacgaagtttattggttgtata

SEQ ID NO: 16607 - DNA, 40 bp, Artificial Sequence
  PCR primer for ORF amplification
tggaagtggttcaggaatgacgcaagaattcattgataaa

SEQ ID NO: 16608 - DNA, 40 bp, Artificial Sequence
  PCR primer for ORF amplification
tggaagtggttcaggaatgagtgaaacacgagaatctaat

SEQ ID NO: 16609 - DNA, 40 bp, Artificial Sequence
  PCR primer for ORF amplification
tggaagtggttcaggaatgcctcaaaacgattatatcgag

SEQ ID NO: 16610 - DNA, 40 bp, Artificial Sequence
  PCR primer for ORF amplification
tggaagtggttcaggaatgctgggtttgggccaatctgct

SEQ ID NO: 16611 - DNA, 40 bp, Artificial Sequence
  PCR primer for ORF amplification
tggaagtggttcaggaatggcaccaagtatagcaacggta

SEQ ID NO: 16612 - DNA, 40 bp, Artificial Sequence
  PCR primer for ORF amplification
tggaagtggttcaggaatggcaggtttatcgttcgacaat

SEQ ID NO: 16613 - DNA, 40 bp, Artificial Sequence
  PCR primer for ORF amplification
tggaagtggttcaggaatgtcaaataccgtaagagccatt

SEQ ID NO: 16614 - DNA, 40 bp, Artificial Sequence
  PCR primer for ORF amplification
tggaagtggttcaggaatgtcaactatgtcaacgcctgcc

SEQ ID NO: 16615 - DNA, 40 bp, Artificial Sequence
  PCR primer for ORF amplification
tggaagtggttcaggaatgtcagatatagaatcattggga

SEQ ID NO: 16616 - DNA, 40 bp, Artificial Sequence
  PCR primer for ORF amplification
tggaagtggttcaggaatgtctgcaaaacagcaactacgt

SEQ ID NO: 16617 - DNA, 40 bp, Artificial Sequence
  PCR primer for ORF amplification
tggaagtggttcaggaatgtttagtagaatttgtagcgct

SEQ ID NO: 16618 - DNA, 40 bp, Artificial Sequence
  PCR primer for ORF amplification
tggaagtggttcaggaatgaattggaagtcgtacgttttt

SEQ ID NO: 16619 - DNA, 40 bp, Artificial Sequence
  PCR primer for ORF amplification
tggaagtggttcaggaatggactttttgaatgatgatgaa

SEQ ID NO: 16620 - DNA, 40 bp, Artificial Sequence
  PCR primer for ORF amplification
tggaagtggttcaggaatgtgtggcatttttggctattgc

SEQ ID NO: 16621 - DNA, 40 bp, Artificial Sequence
  PCR primer for ORF amplification
tggaagtggttcaggaatgaggaattttttcacgttattt

SEQ ID NO: 16622 - DNA, 40 bp, Artificial Sequence
  PCR primer for ORF amplification
tggaagtggttcaggaatgatcgctacctccagagccgta

SEQ ID NO: 16623 - DNA, 40 bp, Artificial Sequence
  PCR primer for ORF amplification
tggaagtggttcaggaatgccacgattgacggttggaacg

SEQ ID NO: 16624 - DNA, 40 bp, Artificial Sequence
  PCR primer for ORF amplification
tggaagtggttcaggaatggaaggtgaacaaattatggag

SEQ ID NO: 16625 - DNA, 40 bp, Artificial Sequence
  PCR primer for ORF amplification
tggaagtggttcaggaatgggcaaggttattttgattaca

SEQ ID NO: 16626 - DNA, 40 bp, Artificial Sequence
  PCR primer for ORF amplification
tggaagtggttcaggaatgaagatacaaacaaatgctgta

SEQ ID NO: 16627 - DNA, 40 bp, Artificial Sequence
  PCR primer for ORF amplification
tggaagtggttcaggaatggctaaatttttgaaagcaggt

SEQ ID NO: 16628 - DNA, 40 bp, Artificial Sequence
  PCR primer for ORF amplification
tggaagtggttcaggaatgtcgtcactgcttaaattacat

SEQ ID NO: 16629 - DNA, 40 bp, Artificial Sequence
  PCR primer for ORF amplification
tggaagtggttcaggaatgaaccaaaatggtgataagaac

SEQ ID NO: 16630 - DNA, 40 bp, Artificial Sequence
  PCR primer for ORF amplification
tggaagtggttcaggaatgagtggcacgaggtgtttgcta

SEQ ID NO: 16631 - DNA, 40 bp, Artificial Sequence
  PCR primer for ORF amplification
tggaagtggttcaggaatgagttgggaaggttttaagaaa

SEQ ID NO: 16632 - DNA, 40 bp, Artificial Sequence
  PCR primer for ORF amplification
tggaagtggttcaggaatgcagccaatttcaataaaagat

SEQ ID NO: 16633 - DNA, 40 bp, Artificial Sequence
  PCR primer for ORF amplification
tggaagtggttcaggaatggattataaggaagaacagaag

SEQ ID NO: 16634 - DNA, 40 bp, Artificial Sequence
  PCR primer for ORF amplification
tggaagtggttcaggaatggcaaaccaaaagcaaatgaga

SEQ ID NO: 16635 - DNA, 40 bp, Artificial Sequence
  PCR primer for ORF amplification
tggaagtggttcaggaatggtgttcggtcagctgtatgcc

SEQ ID NO: 16636 - DNA, 40 bp, Artificial Sequence
  PCR primer for ORF amplification
tggaagtggttcaggaatgtcagcagacgaaacggatgcg

SEQ ID NO: 16637 - DNA, 40 bp, Artificial Sequence
  PCR primer for ORF amplification
tggaagtggttcaggaatgtctctttcggtcgccgaaaag

SEQ ID NO: 16638 - DNA, 40 bp, Artificial Sequence
  PCR primer for ORF amplification
tggaagtggttcaggaatgtcttgggacgacgaagctatc

SEQ ID NO: 16639 - DNA, 40 bp, Artificial Sequence
  PCR primer for ORF amplification
tggaagtggttcaggaatggtatgtgaaagagatattaaa

SEQ ID NO: 16640 - DNA, 40 bp, Artificial Sequence
  PCR primer for ORF amplification
tggaagtggttcaggaatgaactatttagaaggcgttggg

SEQ ID NO: 16641 - DNA, 40 bp, Artificial Sequence
  PCR primer for ORF amplification
tggaagtggttcaggaatgaatcacgatcctttcagttgg

SEQ ID NO: 16642 - DNA, 40 bp, Artificial Sequence
  PCR primer for ORF amplification
tggaagtggttcaggaatgagtgaaaagaagaaagttcta

SEQ ID NO: 16643 - DNA, 40 bp, Artificial Sequence
  PCR primer for ORF amplification
tggaagtggttcaggaatgcttgttttcaaaaggggtatt

SEQ ID NO: 16644 - DNA, 40 bp, Artificial Sequence
  PCR primer for ORF amplification
tggaagtggttcaggaatggcattgcatcagtatttatca

SEQ ID NO: 16645 - DNA, 40 bp, Artificial Sequence
  PCR primer for ORF amplification
tggaagtggttcaggaatgttcttaagaagcgttaaccgt

SEQ ID NO: 16646 - DNA, 40 bp, Artificial Sequence
  PCR primer for ORF amplification
tggaagtggttcaggaatgttgaacgtgctattgagaagg

SEQ ID NO: 16647 - DNA, 40 bp, Artificial Sequence; identical to SEQ ID NO: 16532
  PCR primer for ORF amplification

SEQ ID NO: 16648 - DNA, 40 bp, Artificial Sequence
  PCR primer for ORF amplification
tggaagtggttcaggaatgagcatcgaatactctgttatc

SEQ ID NO: 16649 - DNA, 40 bp, Artificial Sequence
  PCR primer for ORF amplification
tggaagtggttcaggaatgagctgcctggtgttgccatta

SEQ ID NO: 16650 - DNA, 40 bp, Artificial Sequence
  PCR primer for ORF amplification
tggaagtggttcaggaatggatatggaaatcgaagattca

SEQ ID NO: 16651 - DNA, 40 bp, Artificial Sequence
  PCR primer for ORF amplification
tggaagtggttcaggaatggatgtcgatgagaggttgcat

SEQ ID NO: 16652 - DNA, 40 bp, Artificial Sequence
  PCR primer for ORF amplification
tggaagtggttcaggaatggccttgaacgataatcctata

SEQ ID NO: 16653 - DNA, 40 bp, Artificial Sequence
  PCR primer for ORF amplification
tggaagtggttcaggaatgtcaaccagtcgtgaagattct

SEQ ID NO: 16654 - DNA, 40 bp, Artificial Sequence
  PCR primer for ORF amplification
tggaagtggttcaggaatgtcccaaggtagaaaagctgca

SEQ ID NO: 16655 - DNA, 40 bp, Artificial Sequence
  PCR primer for ORF amplification
tggaagtggttcaggaatgtcgaaagctacatataaggaa

SEQ ID NO: 16656 - DNA, 40 bp, Artificial Sequence
  PCR primer for ORF amplification
tggaagtggttcaggaatgacattgttaaataccctcagc

SEQ ID NO: 16657 - DNA, 40 bp, Artificial Sequence
  PCR primer for ORF amplification
tggaagtggttcaggaatgaagccgaacaatcgaacttgt

SEQ ID NO: 16658 - DNA, 40 bp, Artificial Sequence
  PCR primer for ORF amplification
tggaagtggttcaggaatgactagtttagatgacagtgtg

SEQ ID NO: 16659 - DNA, 40 bp, Artificial Sequence
  PCR primer for ORF amplification
tggaagtggttcaggaatgctgatagtattattcttaaca

SEQ ID NO: 16660 - DNA, 40 bp, Artificial Sequence
  PCR primer for ORF amplification
tggaagtggttcaggaatgggtttacctgaagttaacttt

SEQ ID NO: 16661 - DNA, 40 bp, Artificial Sequence
  PCR primer for ORF amplification
tggaagtggttcaggaatggtattggaagctacagtgtta

SEQ ID NO: 16662 - DNA, 40 bp, Artificial Sequence
  PCR primer for ORF amplification
tggaagtggttcaggaatgtcctctacacatagtaataat

SEQ ID NO: 16663 - DNA, 40 bp, Artificial Sequence
  PCR primer for ORF amplification
tggaagtggttcaggaatgtctagtagtaaattcgaagag

SEQ ID NO: 16664 - DNA, 40 bp, Artificial Sequence
  PCR primer for ORF amplification
tggaagtggttcaggaatggtatgttaatatggactaaag

SEQ ID NO: 16665 - DNA, 40 bp, Artificial Sequence
  PCR primer for ORF amplification
tggaagtggttcaggaatgaaaagcattttcaaggttaga

SEQ ID NO: 16666 - DNA, 40 bp, Artificial Sequence
  PCR primer for ORF amplification
tggaagtggttcaggaatgaagacagaaggaataaaaagc

SEQ ID NO: 16667 - DNA, 40 bp, Artificial Sequence
  PCR primer for ORF amplification
tggaagtggttcaggaatgaagtggttgttgtttccggca

SEQ ID NO: 16668 - DNA, 40 bp, Artificial Sequence
  PCR primer for ORF amplification
tggaagtggttcaggaatgacacatttagaaagaagtaga

SEQ ID NO: 16669 - DNA, 40 bp, Artificial Sequence
  PCR primer for ORF amplification
tggaagtggttcaggaatgggttggttttgggcagatcaa

SEQ ID NO: 16670 - DNA, 40 bp, Artificial Sequence
  PCR primer for ORF amplification
tggaagtggttcaggaatggtgcttagtgattcgttgaag

SEQ ID NO: 16671 - DNA, 40 bp, Artificial Sequence
  PCR primer for ORF amplification
tggaagtggttcaggaatgtccactgaattaaccgttcaa

SEQ ID NO: 16672 - DNA, 40 bp, Artificial Sequence
  PCR primer for ORF amplification
tggaagtggttcaggaatgtcgaagttcctacagggatca

SEQ ID NO: 16673 - DNA, 40 bp, Artificial Sequence
  PCR primer for ORF amplification
tggaagtggttcaggaatgtctttcactaaaatcgctgcc

SEQ ID NO: 16674 - DNA, 40 bp, Artificial Sequence
  PCR primer for ORF amplification
tggaagtggttcaggaatgacgatgcgaacaaataagaaa

SEQ ID NO: 16675 - DNA, 40 bp, Artificial Sequence
  PCR primer for ORF amplification
tggaagtggttcaggaatgagtaaccaacacagccctcag

SEQ ID NO: 16676 - DNA, 40 bp, Artificial Sequence
  PCR primer for ORF amplification
tggaagtggttcaggaatggcaacacacacgagcaagaga

SEQ ID NO: 16677 - DNA, 40 bp, Artificial Sequence
  PCR primer for ORF amplification
tggaagtggttcaggaatggctatcgaaaatatatacatt

SEQ ID NO: 16678 - DNA, 40 bp, Artificial Sequence
  PCR primer for ORF amplification
tggaagtggttcaggaatgtccagaactattccatttcta

SEQ ID NO: 16679 - DNA, 40 bp, Artificial Sequence
  PCR primer for ORF amplification
tggaagtggttcaggaatgtccaccgattctattgtcaag

SEQ ID NO: 16680 - DNA, 40 bp, Artificial Sequence
  PCR primer for ORF amplification
tggaagtggttcaggaatgtccactgattctattgttaaa

SEQ ID NO: 16681 - DNA, 40 bp, Artificial Sequence; identical to SEQ ID NO: 15460
  PCR primer for ORF amplification

SEQ ID NO: 16682 - DNA, 40 bp, Artificial Sequence
  PCR primer for ORF amplification
tggaagtggttcaggaatgagcagtcgtgtgtgctaccat

SEQ ID NO: 16683 - DNA, 40 bp, Artificial Sequence
  PCR primer for ORF amplification
tggaagtggttcaggaatgccttcgctaacccccagatgt

SEQ ID NO: 16684 - DNA, 40 bp, Artificial Sequence
  PCR primer for ORF amplification
tggaagtggttcaggaatgctctctcatatcgttgagtat

SEQ ID NO: 16685 - DNA, 40 bp, Artificial Sequence
  PCR primer for ORF amplification
tggaagtggttcaggaatgggtttggcagctacaagaacc

SEQ ID NO: 16686 - DNA, 40 bp, Artificial Sequence
  PCR primer for ORF amplification
tggaagtggttcaggaatggtatcgaagacttggatatgt

SEQ ID NO: 16687 - DNA, 40 bp, Artificial Sequence
  PCR primer for ORF amplification
tggaagtggttcaggaatggtgagctatggaagtcatagt

SEQ ID NO: 16688 - DNA, 40 bp, Artificial Sequence
  PCR primer for ORF amplification
tggaagtggttcaggaatgtctcgagttgcacagctcgac

SEQ ID NO: 16689 - DNA, 40 bp, Artificial Sequence
  PCR primer for ORF amplification
tggaagtggttcaggaatgtcttttgatattaattggagt

SEQ ID NO: 16690 - DNA, 40 bp, Artificial Sequence
  PCR primer for ORF amplification
tggaagtggttcaggaatggtatgtcgaacttgtactgaa

SEQ ID NO: 16691 - DNA, 40 bp, Artificial Sequence
  PCR primer for ORF amplification
tggaagtggttcaggaatgagaaacaggcagaatcaaaag

SEQ ID NO: 16692 - DNA, 40 bp, Artificial Sequence
  PCR primer for ORF amplification
tggaagtggttcaggaatgagagactataaattagtagta

SEQ ID NO: 16693 - DNA, 40 bp, Artificial Sequence
  PCR primer for ORF amplification
tggaagtggttcaggaatgatattcaatctacctgttagt

SEQ ID NO: 16694 - DNA, 40 bp, Artificial Sequence
  PCR primer for ORF amplification
tggaagtggttcaggaatggttaaaacgactgaagtagta

SEQ ID NO: 16695 - DNA, 40 bp, Artificial Sequence
  PCR primer for ORF amplification
tggaagtggttcaggaatgtctcgcgttggtgtcatggta

SEQ ID NO: 16696 - DNA, 40 bp, Artificial Sequence
  PCR primer for ORF amplification
tggaagtggttcaggaatgcaaatgtatgcaccatatcca

SEQ ID NO: 16697 - DNA, 40 bp, Artificial Sequence
  PCR primer for ORF amplification
tggaagtggttcaggaatgaccgttcccaggaatcgtccc

SEQ ID NO: 16698 - DNA, 40 bp, Artificial Sequence
  PCR primer for ORF amplification
tggaagtggttcaggaatgcctagattagaagagattgac

SEQ ID NO: 16699 - DNA, 40 bp, Artificial Sequence
  PCR primer for ORF amplification
tggaagtggttcaggaatggctgcgcagaatgcctttgaa

SEQ ID NO: 16700 - DNA, 40 bp, Artificial Sequence
  PCR primer for ORF amplification
tggaagtggttcaggaatgggtagtgttcaacgacaagat

SEQ ID NO: 16701 - DNA, 40 bp, Artificial Sequence
  PCR primer for ORF amplification
tggaagtggttcaggaatgtatgtttctaatgggaaagac

SEQ ID NO: 16702 - DNA, 40 bp, Artificial Sequence
  PCR primer for ORF amplification
tggaagtggttcaggaatgtcatatttgccgacttattcc

SEQ ID NO: 16703 - DNA, 40 bp, Artificial Sequence
  PCR primer for ORF amplification
tggaagtggttcaggaatgtccaacccatttgatttgtta

SEQ ID NO: 16704 - DNA, 40 bp, Artificial Sequence
  PCR primer for ORF amplification
tggaagtggttcaggaatgtcccaaactcgtgaagattct

SEQ ID NO: 16705 - DNA, 40 bp, Artificial Sequence
  PCR primer for ORF amplification
tggaagtggttcaggaatgttgattactgagacctttcat

SEQ ID NO: 16706 - DNA, 40 bp, Artificial Sequence
  PCR primer for ORF amplification
tggaagtggttcaggaatgtttggagtcaaggatgctata

SEQ ID NO: 16707 - DNA, 40 bp, Artificial Sequence
  PCR primer for ORF amplification
tggaagtggttcaggaatggtatgtttgatcgccggaggc

SEQ ID NO: 16708 - DNA, 40 bp, Artificial Sequence
  PCR primer for ORF amplification
tggaagtggttcaggaatgagggaaggtgattctaattca

SEQ ID NO: 16709 - DNA, 40 bp, Artificial Sequence
  PCR primer for ORF amplification
tggaagtggttcaggaatgagtgaagttgcaccagaggag

SEQ ID NO: 16710 - DNA, 40 bp, Artificial Sequence
  PCR primer for ORF amplification
tggaagtggttcaggaatgatacgtcagctcaattattgg

SEQ ID NO: 16711 - DNA, 40 bp, Artificial Sequence
  PCR primer for ORF amplification
tggaagtggttcaggaatgatctctgtcatggcggatgag

SEQ ID NO: 16712 - DNA, 40 bp, Artificial Sequence
  PCR primer for ORF amplification
tggaagtggttcaggaatgcaggttaaatcgattaaaatg

SEQ ID NO: 16713 - DNA, 40 bp, Artificial Sequence
  PCR primer for ORF amplification
tggaagtggttcaggaatgccaggtgtttccgttaggtac

SEQ ID NO: 16714 - DNA, 40 bp, Artificial Sequence
  PCR primer for ORF amplification
tggaagtggttcaggaatgccctcgttagccgaattgacc

SEQ ID NO: 16715 - DNA, 40 bp, Artificial Sequence
  PCR primer for ORF amplification
tggaagtggttcaggaatggaggagagtaagacaaaaaga

SEQ ID NO: 16716 - DNA, 40 bp, Artificial Sequence
  PCR primer for ORF amplification
tggaagtggttcaggaatggattttaaagcaagtgggaca

SEQ ID NO: 16717 - DNA, 40 bp, Artificial Sequence
  PCR primer for ORF amplification
tggaagtggttcaggaatggcaagaagacctgataaccaa

SEQ ID NO: 16718 - DNA, 40 bp, Artificial Sequence
  PCR primer for ORF amplification
tggaagtggttcaggaatggctaacggtacgtgaaagggg

SEQ ID NO: 16719 - DNA, 40 bp, Artificial Sequence
  PCR primer for ORF amplification
tggaagtggttcaggaatggtcaaatcgctacagctagcc

SEQ ID NO: 16720 - DNA, 40 bp, Artificial Sequence
  PCR primer for ORF amplification
tggaagtggttcaggaatggtgaaagtaactgcagcttgt

SEQ ID NO: 16721 - DNA, 40 bp, Artificial Sequence
  PCR primer for ORF amplification
tggaagtggttcaggaatggttgagtcaaatgatattata

SEQ ID NO: 16722 - DNA, 40 bp, Artificial Sequence
  PCR primer for ORF amplification
tggaagtggttcaggaatggttgcgcctactgctttgaaa

SEQ ID NO: 16723 - DNA, 40 bp, Artificial Sequence
  PCR primer for ORF amplification
tggaagtggttcaggaatgtcagccgtaggtccaggtagc

SEQ ID NO: 16724 - DNA, 40 bp, Artificial Sequence
  PCR primer for ORF amplification
tggaagtggttcaggaatgtcggcggctatcgaaaaagaa

SEQ ID NO: 16725 - DNA, 40 bp, Artificial Sequence
  PCR primer for ORF amplification
tggaagtggttcaggaatgacatcgtctgcttcttctcca

SEQ ID NO: 16726 - DNA, 40 bp, Artificial Sequence
  PCR primer for ORF amplification
tggaagtggttcaggaatgccaccgctagtatttgacata

SEQ ID NO: 16727 - DNA, 40 bp, Artificial Sequence
  PCR primer for ORF amplification
tggaagtggttcaggaatgtcacgtcctgaggagttggca

SEQ ID NO: 16728 - DNA, 40 bp, Artificial Sequence
  PCR primer for ORF amplification
tggaagtggttcaggaatgtctagtcgtaaaaaagtcaga

SEQ ID NO: 16729 - DNA, 40 bp, Artificial Sequence
  PCR primer for ORF amplification
tggaagtggttcaggaatgtctgaaaaaccacaacaagag

SEQ ID NO: 16730 - DNA, 40 bp, Artificial Sequence
  PCR primer for ORF amplification
tggaagtggttcaggaatgcgtttacaaagaaattccatc

SEQ ID NO: 16731 - DNA, 40 bp, Artificial Sequence
  PCR primer for ORF amplification
tggaagtggttcaggaatggctaaacaatcattaggtatg

SEQ ID NO: 16732 - DNA, 40 bp, Artificial Sequence
  PCR primer for ORF amplification
tggaagtggttcaggaatgggtactagcatagtaaatcta

SEQ ID NO: 16733 - DNA, 40 bp, Artificial Sequence
  PCR primer for ORF amplification
tggaagtggttcaggaatggttgaatcagatgaagatttc

SEQ ID NO: 16734 - DNA, 40 bp, Artificial Sequence
  PCR primer for ORF amplification
tggaagtggttcaggaatgggtatgttataaccataattc

SEQ ID NO: 16735 - DNA, 40 bp, Artificial Sequence
  PCR primer for ORF amplification
tggaagtggttcaggaatgaaattgcacggctttttattt

SEQ ID NO: 16736 - DNA, 40 bp, Artificial Sequence
  PCR primer for ORF amplification
tggaagtggttcaggaatgaataaagaagaattattgggt

SEQ ID NO: 16737 - DNA, 40 bp, Artificial Sequence
  PCR primer for ORF amplification
tggaagtggttcaggaatgataccaaagcttatagttttt

SEQ ID NO: 16738 - DNA, 40 bp, Artificial Sequence
  PCR primer for ORF amplification
tggaagtggttcaggaatgcagtgtaacacaagtatagaa

SEQ ID NO: 16739 - DNA, 40 bp, Artificial Sequence
  PCR primer for ORF amplification
tggaagtggttcaggaatggcttactctttaacaaggaaa

SEQ ID NO: 16740 - DNA, 40 bp, Artificial Sequence
  PCR primer for ORF amplification
tggaagtggttcaggaatgggtttacctaaatcggcatat

SEQ ID NO: 16741 - DNA, 40 bp, Artificial Sequence
  PCR primer for ORF amplification
tggaagtggttcaggaatggttggtatttacagaatactt

SEQ ID NO: 16742 - DNA, 40 bp, Artificial Sequence
  PCR primer for ORF amplification
tggaagtggttcaggaatgagagcaccaccttcaccgaga

SEQ ID NO: 16743 - DNA, 40 bp, Artificial Sequence
  PCR primer for ORF amplification
tggaagtggttcaggaatgagtgtattaagatctacatgc

SEQ ID NO: 16744 - DNA, 40 bp, Artificial Sequence
  PCR primer for ORF amplification
tggaagtggttcaggaatgcattatttgcctgttgcgata

SEQ ID NO: 16745 - DNA, 40 bp, Artificial Sequence
  PCR primer for ORF amplification
tggaagtggttcaggaatggagacctccaactttgttaaa

SEQ ID NO: 16746 - DNA, 40 bp, Artificial Sequence
  PCR primer for ORF amplification
tggaagtggttcaggaatggcgaagactatcaaagttatc

SEQ ID NO: 16747 - DNA, 40 bp, Artificial Sequence
  PCR primer for ORF amplification
tggaagtggttcaggaatgtcgcaagagtttgtggaagac

SEQ ID NO: 16748 - DNA, 40 bp, Artificial Sequence
  PCR primer for ORF amplification
tggaagtggttcaggaatgtctgaaagaaaagctattaac

SEQ ID NO: 16749 - DNA, 40 bp, Artificial Sequence
  PCR primer for ORF amplification
tggaagtggttcaggaatgtttagtgcattaggtaaatgg

SEQ ID NO: 16750 - DNA, 40 bp, Artificial Sequence
  PCR primer for ORF amplification
tggaagtggttcaggaatgttttcaaggctttctttgttt

SEQ ID NO: 16751 - DNA, 40 bp, Artificial Sequence
  PCR primer for ORF amplification
tggaagtggttcaggaatggctcaacgtgttactttcaga

SEQ ID NO: 16752 - DNA, 40 bp, Artificial Sequence
  PCR primer for ORF amplification
tggaagtggttcaggaatgaacgccaactctaccacgaca

SEQ ID NO: 16753 - DNA, 40 bp, Artificial Sequence
  PCR primer for ORF amplification
tggaagtggttcaggaatgcagggcacttttaaaaggttt

SEQ ID NO: 16754 - DNA, 40 bp, Artificial Sequence
  PCR primer for ORF amplification
tggaagtggttcaggaatggagataaaccaagcggctgaa

SEQ ID NO: 16755 - DNA, 40 bp, Artificial Sequence
  PCR primer for ORF amplification
tggaagtggttcaggaatggataaagaggtaagtgaattg

SEQ ID NO: 16756 - DNA, 40 bp, Artificial Sequence
  PCR primer for ORF amplification
tggaagtggttcaggaatggatagaactcaaacgtttatt

SEQ ID NO: 16757 - DNA, 40 bp, Artificial Sequence
  PCR primer for ORF amplification
tggaagtggttcaggaatggtagagttgacaattacgggt

SEQ ID NO: 16758 - DNA, 40 bp, Artificial Sequence
  PCR primer for ORF amplification
tggaagtggttcaggaatggtagctgtatgttcgttaatc

SEQ ID NO: 16759 - DNA, 40 bp, Artificial Sequence
  PCR primer for ORF amplification
tggaagtggttcaggaatgtcaattgtttcactgttaggc

SEQ ID NO: 16760 - DNA, 40 bp, Artificial Sequence
  PCR primer for ORF amplification
tggaagtggttcaggaatgtcatcaagacccgctaataac

SEQ ID NO: 16761 - DNA, 40 bp, Artificial Sequence
  PCR primer for ORF amplification
tggaagtggttcaggaatgtgtgaatacagcaaggctctt

SEQ ID NO: 16762 - DNA, 40 bp, Artificial Sequence
  PCR primer for ORF amplification
tggaagtggttcaggaatgtctttagttgtacaagaacaa

SEQ ID NO: 16763 - DNA, 40 bp, Artificial Sequence
  PCR primer for ORF amplification
tggaagtggttcaggaatgaaatccaaaacgtggattttc

SEQ ID NO: 16764 - DNA, 40 bp, Artificial Sequence
  PCR primer for ORF amplification
tggaagtggttcaggaatgaaggcgctagttgaagagatt

SEQ ID NO: 16765 - DNA, 40 bp, Artificial Sequence
  PCR primer for ORF amplification
tggaagtggttcaggaatgacaagatctccctggaagcgc

SEQ ID NO: 16766 - DNA, 40 bp, Artificial Sequence
  PCR primer for ORF amplification
tggaagtggttcaggaatgactgttgaatatactgcatcc

SEQ ID NO: 16767 - DNA, 40 bp, Artificial Sequence
  PCR primer for ORF amplification
tggaagtggttcaggaatgagcgatagagatcagatagaa

SEQ ID NO: 16768 - DNA, 40 bp, Artificial Sequence
  PCR primer for ORF amplification
tggaagtggttcaggaatggaaccagaagatacccagctg

SEQ ID NO: 16769 - DNA, 40 bp, Artificial Sequence
  PCR primer for ORF amplification
tggaagtggttcaggaatggctccatctggtatgtgaact

SEQ ID NO: 16770 - DNA, 40 bp, Artificial Sequence
  PCR primer for ORF amplification
tggaagtggttcaggaatgggaaatatgataaagaaggca

SEQ ID NO: 16771 - DNA, 40 bp, Artificial Sequence
  PCR primer for ORF amplification
tggaagtggttcaggaatgtcgcaagaaattaggcaaaat

SEQ ID NO: 16772 - DNA, 40 bp, Artificial Sequence
  PCR primer for ORF amplification
tggaagtggttcaggaatgaaagctaggaaatcgcagaga

SEQ ID NO: 16773 - DNA, 40 bp, Artificial Sequence
  PCR primer for ORF amplification
tggaagtggttcaggaatgaagaaaacaatttacaaagtc

SEQ ID NO: 16774 - DNA, 40 bp, Artificial Sequence
  PCR primer for ORF amplification
tggaagtggttcaggaatgaaggtaaatttaatgttgaaa

SEQ ID NO: 16775 - DNA, 40 bp, Artificial Sequence
  PCR primer for ORF amplification
tggaagtggttcaggaatgagtaatcattctgaaatctta

SEQ ID NO: 16776 - DNA, 40 bp, Artificial Sequence
  PCR primer for ORF amplification
tggaagtggttcaggaatgcaagtcatcggacgtggtggg

SEQ ID NO: 16777 - DNA, 40 bp, Artificial Sequence
  PCR primer for ORF amplification
tggaagtggttcaggaatggcactacgatttttcaacgat

SEQ ID NO: 16778 - DNA, 40 bp, Artificial Sequence
  PCR primer for ORF amplification
tggaagtggttcaggaatgggtttatatcaagcaaagaat

SEQ ID NO: 16779 - DNA, 40 bp, Artificial Sequence
  PCR primer for ORF amplification
tggaagtggttcaggaatgtccgaatatcagccaagttta

SEQ ID NO: 16780 - DNA, 40 bp, Artificial Sequence
  PCR primer for ORF amplification
tggaagtggttcaggaatgaacgtttgcaagttgaaagaa

SEQ ID NO: 16781 - DNA, 40 bp, Artificial Sequence
  PCR primer for ORF amplification
tggaagtggttcaggaatgagtattgacaacaagttgttt

SEQ ID NO: 16782 - DNA, 40 bp, Artificial Sequence
  PCR primer for ORF amplification
tggaagtggttcaggaatggatccaagtttagttttagag

SEQ ID NO: 16783 - DNA, 40 bp, Artificial Sequence
  PCR primer for ORF amplification
tggaagtggttcaggaatggctgaatcccatagatgtatg

SEQ ID NO: 16784 - DNA, 40 bp, Artificial Sequence
  PCR primer for ORF amplification
tggaagtggttcaggaatggtagcagacttaactaaaggt

SEQ ID NO: 16785 - DNA, 40 bp, Artificial Sequence
  PCR primer for ORF amplification
tggaagtggttcaggaatggttcctaagttttacaaactt

SEQ ID NO: 16786 - DNA, 40 bp, Artificial Sequence
  PCR primer for ORF amplification
tggaagtggttcaggaatgtctgacagagaacaaagcagc

SEQ ID NO: 16787 - DNA, 40 bp, Artificial Sequence
  PCR primer for ORF amplification
tggaagtggttcaggaatggctgaatcccatagacgtatg

SEQ ID NO: 16788 - DNA, 40 bp, Artificial Sequence
  PCR primer for ORF amplification
tggaagtggttcaggaatgaaccagatactaaatgcacaa

SEQ ID NO: 16789 - DNA, 40 bp, Artificial Sequence
  PCR primer for ORF amplification
tggaagtggttcaggaatgaatagtaaccgatgccaaacg

SEQ ID NO: 16790 - DNA, 40 bp, Artificial Sequence
  PCR primer for ORF amplification
tggaagtggttcaggaatgattcaaatggtgcccatttat

SEQ ID NO: 16791 - DNA, 40 bp, Artificial Sequence
  PCR primer for ORF amplification
tggaagtggttcaggaatgccaggacacgaattggaagac

SEQ ID NO: 16792 - DNA, 40 bp, Artificial Sequence
  PCR primer for ORF amplification
tggaagtggttcaggaatggttcaagctatcaaattaaat

SEQ ID NO: 16793 - DNA, 40 bp, Artificial Sequence
  PCR primer for ORF amplification
tggaagtggttcaggaatgtcctttttcgacatcgaagca

SEQ ID NO: 16794 - DNA, 40 bp, Artificial Sequence
  PCR primer for ORF amplification
tggaagtggttcaggaatgtctcaaagaataattcaacca

SEQ ID NO: 16795 - DNA, 40 bp, Artificial Sequence
  PCR primer for ORF amplification
tggaagtggttcaggaatgtctcctccagtttacagcgat

SEQ ID NO: 16796 - DNA, 40 bp, Artificial Sequence
  PCR primer for ORF amplification
tggaagtggttcaggaatgtctgaatcatctatttcttct

SEQ ID NO: 16797 - DNA, 40 bp, Artificial Sequence
  PCR primer for ORF amplification
tggaagtggttcaggaatgtctgacaaggaacaaacgagc

SEQ ID NO: 16798 - DNA, 40 bp, Artificial Sequence
  PCR primer for ORF amplification
tggaagtggttcaggaatgttactaaagtgtgtttgcaga

SEQ ID NO: 16799 - DNA, 40 bp, Artificial Sequence
  PCR primer for ORF amplification
tggaagtggttcaggaatggtatgtttgagatgaacaaaa

SEQ ID NO: 16800 - DNA, 40 bp, Artificial Sequence
  PCR primer for ORF amplification
tggaagtggttcaggaatgctttactccagagaatcaagg

SEQ ID NO: 16801 - DNA, 40 bp, Artificial Sequence
  PCR primer for ORF amplification
tggaagtggttcaggaatgaatactttttttctttccttg

SEQ ID NO: 16802 - DNA, 40 bp, Artificial Sequence
  PCR primer for ORF amplification
tggaagtggttcaggaatgacaggatctttaaacagacac

SEQ ID NO: 16803 - DNA, 40 bp, Artificial Sequence
  PCR primer for ORF amplification
tggaagtggttcaggaatgactccttccaccccaccaagg

SEQ ID NO: 16804 - DNA, 40 bp, Artificial Sequence
  PCR primer for ORF amplification
tggaagtggttcaggaatgatagcggattcatcagttttg

SEQ ID NO: 16805 - DNA, 40 bp, Artificial Sequence
  PCR primer for ORF amplification
tggaagtggttcaggaatggctattgatgctcaaaagctt

SEQ ID NO: 16806 - DNA, 40 bp, Artificial Sequence
  PCR primer for ORF amplification
tggaagtggttcaggaatgtcgaatactattgtgatagtc

SEQ ID NO: 16807 - DNA, 40 bp, Artificial Sequence
  PCR primer for ORF amplification
tggaagtggttcaggaatgtctgtccaagatactaaagcg

SEQ ID NO: 16808 - DNA, 40 bp, Artificial Sequence
  PCR primer for ORF amplification
tggaagtggttcaggaatgttgtggaaagtttctaagatg

SEQ ID NO: 16809 - DNA, 40 bp, Artificial Sequence
  PCR primer for ORF amplification
tggaagtggttcaggaatgaaaatcaatgtatcccgtcca

SEQ ID NO: 16810 - DNA, 40 bp, Artificial Sequence
  PCR primer for ORF amplification
tggaagtggttcaggaatgaagtttttactgcagcaaata

SEQ ID NO: 16811 - DNA, 40 bp, Artificial Sequence
  PCR primer for ORF amplification
tggaagtggttcaggaatgcgttcttcggtatatagtgag

SEQ ID NO: 16812 - DNA, 40 bp, Artificial Sequence
  PCR primer for ORF amplification
tggaagtggttcaggaatgctatccgtagtagcgatcccg

SEQ ID NO: 16813 - DNA, 40 bp, Artificial Sequence
  PCR primer for ORF amplification
tggaagtggttcaggaatggagctaagttcaccatcaaaa

SEQ ID NO: 16814 - DNA, 40 bp, Artificial Sequence
  PCR primer for ORF amplification
tggaagtggttcaggaatggatgctgatgaattggaattg

SEQ ID NO: 16815 - DNA, 40 bp, Artificial Sequence
  PCR primer for ORF amplification
tggaagtggttcaggaatgtcctccgatttagctgctgag

SEQ ID NO: 16816 - DNA, 40 bp, Artificial Sequence
  PCR primer for ORF amplification
tggaagtggttcaggaatgtctgaattaacagaggcggaa

SEQ ID NO: 16817 - DNA, 40 bp, Artificial Sequence
  PCR primer for ORF amplification
tggaagtggttcaggaatgtgggctcaattatcatatact

SEQ ID NO: 16818 - DNA, 40 bp, Artificial Sequence
  PCR primer for ORF amplification
tggaagtggttcaggaatgtgttcttttcaggttccatct

SEQ ID NO: 16819 - DNA, 40 bp, Artificial Sequence
  PCR primer for ORF amplification
tggaagtggttcaggaatgaaagccaagccactaagccaa

SEQ ID NO: 16820 - DNA, 40 bp, Artificial Sequence
  PCR primer for ORF amplification
tggaagtggttcaggaatgacttacacattggcaatttta

SEQ ID NO: 16821 - DNA, 40 bp, Artificial Sequence
  PCR primer for ORF amplification
tggaagtggttcaggaatgcaattcttcaaaacacttgcg

SEQ ID NO: 16822 - DNA, 40 bp, Artificial Sequence
  PCR primer for ORF amplification
tggaagtggttcaggaatgcagaatgaaccaatgtttcag

SEQ ID NO: 16823 - DNA, 40 bp, Artificial Sequence
  PCR primer for ORF amplification
tggaagtggttcaggaatggaaacggatagtggtatacct

SEQ ID NO: 16824 - DNA, 40 bp, Artificial Sequence
  PCR primer for ORF amplification
tggaagtggttcaggaatggctaagcaatctctaggtatg

SEQ ID NO: 16825 - DNA, 40 bp, Artificial Sequence
  PCR primer for ORF amplification
tggaagtggttcaggaatggctagatacggtgctacttcc

SEQ ID NO: 16826 - DNA, 40 bp, Artificial Sequence
  PCR primer for ORF amplification
tggaagtggttcaggaatggttattaaagaggactgtatc

SEQ ID NO: 16827 - DNA, 40 bp, Artificial Sequence
  PCR primer for ORF amplification
tggaagtggttcaggaatgtcagacatcgaagaaggtacg

SEQ ID NO: 16828 - DNA, 40 bp, Artificial Sequence
  PCR primer for ORF amplification
tggaagtggttcaggaatgtcgaatgcagaggccagcaga

SEQ ID NO: 16829 - DNA, 40 bp, Artificial Sequence
  PCR primer for ORF amplification
tggaagtggttcaggaatgtcgattgttggaaggaatgct

SEQ ID NO: 16830 - DNA, 40 bp, Artificial Sequence
  PCR primer for ORF amplification
tggaagtggttcaggaatgacctacactaccagacaaatt

SEQ ID NO: 16831 - DNA, 40 bp, Artificial Sequence
  PCR primer for ORF amplification
tggaagtggttcaggaatgcaagctattgccgatagtttc

SEQ ID NO: 16832 - DNA, 40 bp, Artificial Sequence
  PCR primer for ORF amplification
tggaagtggttcaggaatgcattacaagaaagcatttcta

SEQ ID NO: 16833 - DNA, 40 bp, Artificial Sequence
  PCR primer for ORF amplification
tggaagtggttcaggaatggtactgtcaaatgttaaaatc

SEQ ID NO: 16834 - DNA, 40 bp, Artificial Sequence
  PCR primer for ORF amplification
tggaagtggttcaggaatgtctaattctgccaaacttatc

SEQ ID NO: 16835 - DNA, 40 bp, Artificial Sequence
  PCR primer for ORF amplification
tggaagtggttcaggaatgtctgatgctcaattcgatgct

SEQ ID NO: 16836 - DNA, 40 bp, Artificial Sequence
  PCR primer for ORF amplification
tggaagtggttcaggaatgtctgccgtcccaagtgtccaa

SEQ ID NO: 16837 - DNA, 40 bp, Artificial Sequence
  PCR primer for ORF amplification
tggaagtggttcaggaatggaaattgaaaacgaacgtacg

SEQ ID NO: 16838 - DNA, 40 bp, Artificial Sequence
  PCR primer for ORF amplification
tggaagtggttcaggaatgacatcaattggtactggttac

SEQ ID NO: 16839 - DNA, 40 bp, Artificial Sequence
  PCR primer for ORF amplification
tggaagtggttcaggaatgactgccgacaacaatagtatg

SEQ ID NO: 16840 - DNA, 40 bp, Artificial Sequence
  PCR primer for ORF amplification
tggaagtggttcaggaatgagcagagctattactagagca

SEQ ID NO: 16841 - DNA, 40 bp, Artificial Sequence
  PCR primer for ORF amplification
tggaagtggttcaggaatgatggtacccaggattagtgct

SEQ ID NO: 16842 - DNA, 40 bp, Artificial Sequence
  PCR primer for ORF amplification
tggaagtggttcaggaatgcccagtgtctgccatacaagc

SEQ ID NO: 16843 - DNA, 40 bp, Artificial Sequence
  PCR primer for ORF amplification
tggaagtggttcaggaatggaagagtgtcctatttgtttg

SEQ ID NO: 16844 - DNA, 40 bp, Artificial Sequence
  PCR primer for ORF amplification
tggaagtggttcaggaatggcatcaagaaaactgcgtgac

SEQ ID NO: 16845 - DNA, 40 bp, Artificial Sequence
  PCR primer for ORF amplification
tggaagtggttcaggaatgtcggaagacgaattttttggt

SEQ ID NO: 16846 - DNA, 40 bp, Artificial Sequence
  PCR primer for ORF amplification
tggaagtggttcaggaatgcttgttattgttctgcagggc

SEQ ID NO: 16847 - DNA, 40 bp, Artificial Sequence
  PCR primer for ORF amplification
tggaagtggttcaggaatgaacagagtttcgtttattaaa

SEQ ID NO: 16848 - DNA, 40 bp, Artificial Sequence
  PCR primer for ORF amplification
tggaagtggttcaggaatgacagaacaagttaacaatgac

SEQ ID NO: 16849 - DNA, 40 bp, Artificial Sequence
  PCR primer for ORF amplification
tggaagtggttcaggaatggcgaggcctcaaaatcatcgc

SEQ ID NO: 16850 - DNA, 40 bp, Artificial Sequence
  PCR primer for ORF amplification
tggaagtggttcaggaatggctctctcttcaaactggcag

SEQ ID NO: 16851 - DNA, 40 bp, Artificial Sequence
  PCR primer for ORF amplification
tggaagtggttcaggaatggtttcccaatttgctattgag

SEQ ID NO: 16852 - DNA, 40 bp, Artificial Sequence
  PCR primer for ORF amplification
tggaagtggttcaggaatgtctgctcccactatgagatcc

SEQ ID NO: 16853 - DNA, 40 bp, Artificial Sequence
  PCR primer for ORF amplification
tggaagtggttcaggaatgggtaaatcgtatgtcatttaa

SEQ ID NO: 16854 - DNA, 40 bp, Artificial Sequence
  PCR primer for ORF amplification
tggaagtggttcaggaatggcaagatacggtgctacttca

SEQ ID NO: 16855 - DNA, 40 bp, Artificial Sequence
  PCR primer for ORF amplification
tggaagtggttcaggaatgagttataataatccgtaccag

SEQ ID NO: 16856 - DNA, 40 bp, Artificial Sequence
  PCR primer for ORF amplification
tggaagtggttcaggaatgcgtggtttcagtggtcaacca

SEQ ID NO: 16857 - DNA, 40 bp, Artificial Sequence
  PCR primer for ORF amplification
tggaagtggttcaggaatgctaagaagacaagcccgtgaa

SEQ ID NO: 16858 - DNA, 40 bp, Artificial Sequence
  PCR primer for ORF amplification
tggaagtggttcaggaatggaaaagctattacagtggtct

SEQ ID NO: 16859 - DNA, 40 bp, Artificial Sequence
  PCR primer for ORF amplification
tggaagtggttcaggaatggaattcatatctgcagactat

SEQ ID NO: 16860 - DNA, 40 bp, Artificial Sequence
  PCR primer for ORF amplification
tggaagtggttcaggaatggggaccgaagatgccattgcc

SEQ ID NO: 16861 - DNA, 40 bp, Artificial Sequence
  PCR primer for ORF amplification
tggaagtggttcaggaatgtcaaatatcattgcaagattt

SEQ ID NO: 16862 - DNA, 40 bp, Artificial Sequence
  PCR primer for ORF amplification
tggaagtggttcaggaatgtcagtttaccatttaccaacg

SEQ ID NO: 16863 - DNA, 40 bp, Artificial Sequence
  PCR primer for ORF amplification
tggaagtggttcaggaatgtccgaaaatcacgttcctgcc

SEQ ID NO: 16864 - DNA, 40 bp, Artificial Sequence
  PCR primer for ORF amplification
tggaagtggttcaggaatgtgtgataagtcaaaaacggta

SEQ ID NO: 16865 - DNA, 40 bp, Artificial Sequence
  PCR primer for ORF amplification
tggaagtggttcaggaatgttggtaagaaataggtatctg

SEQ ID NO: 16866 - DNA, 40 bp, Artificial Sequence
  PCR primer for ORF amplification
tggaagtggttcaggaatggtatgttaaaaagtgctcaga

SEQ ID NO: 16867 - DNA, 40 bp, Artificial Sequence
  PCR primer for ORF amplification
tggaagtggttcaggaatgaactctattttagacagaaat

SEQ ID NO: 16868 - DNA, 40 bp, Artificial Sequence
  PCR primer for ORF amplification
tggaagtggttcaggaatgaatacactattatttaagcga

SEQ ID NO: 16869 - DNA, 40 bp, Artificial Sequence
  PCR primer for ORF amplification
tggaagtggttcaggaatgactcgctcttccgttttagct

SEQ ID NO: 16870 - DNA, 40 bp, Artificial Sequence
  PCR primer for ORF amplification
tggaagtggttcaggaatgagcaataaaagcaaccgcagg

SEQ ID NO: 16871 - DNA, 40 bp, Artificial Sequence
  PCR primer for ORF amplification
tggaagtggttcaggaatgagtgcttcgaagattctttca

SEQ ID NO: 16872 - DNA, 40 bp, Artificial Sequence
  PCR primer for ORF amplification
tggaagtggttcaggaatgagttttagacatttcaagagg

SEQ ID NO: 16873 - DNA, 40 bp, Artificial Sequence
  PCR primer for ORF amplification
tggaagtggttcaggaatgcctaaaactagttatttaaac

SEQ ID NO: 16874 - DNA, 40 bp, Artificial Sequence
  PCR primer for ORF amplification
tggaagtggttcaggaatggagctaagaagtagacggagc

SEQ ID NO: 16875 - DNA, 40 bp, Artificial Sequence
  PCR primer for ORF amplification
tggaagtggttcaggaatggcacccagaaaacgctttagg

SEQ ID NO: 16876 - DNA, 40 bp, Artificial Sequence
  PCR primer for ORF amplification
tggaagtggttcaggaatgggcaagaagaagagtaagaac

SEQ ID NO: 16877 - DNA, 40 bp, Artificial Sequence
  PCR primer for ORF amplification
tggaagtggttcaggaatgtctaatccagatgatttagat

SEQ ID NO: 16878 - DNA, 40 bp, Artificial Sequence
  PCR primer for ORF amplification
tggaagtggttcaggaatgtcttctatctacaaagccctc

SEQ ID NO: 16879 - DNA, 40 bp, Artificial Sequence
  PCR primer for ORF amplification
tggaagtggttcaggaatgtctttagttgtccaagaacaa

SEQ ID NO: 16880 - DNA, 40 bp, Artificial Sequence
  PCR primer for ORF amplification
tggaagtggttcaggaatgaatacagcaaacactttggac

SEQ ID NO: 16881 - DNA, 40 bp, Artificial Sequence
  PCR primer for ORF amplification
tggaagtggttcaggaatgacatcactgaatatcatggga

SEQ ID NO: 16882 - DNA, 40 bp, Artificial Sequence
  PCR primer for ORF amplification
tggaagtggttcaggaatgcaaaggttttcactagtcact

SEQ ID NO: 16883 - DNA, 40 bp, Artificial Sequence
  PCR primer for ORF amplification
tggaagtggttcaggaatggaggacagtaaaaagaaagga

SEQ ID NO: 16884 - DNA, 40 bp, Artificial Sequence
  PCR primer for ORF amplification
tggaagtggttcaggaatggattctgcaagcaaagaggaa

SEQ ID NO: 16885 - DNA, 40 bp, Artificial Sequence
  PCR primer for ORF amplification
tggaagtggttcaggaatggcatgcaattttcagtttcca

SEQ ID NO: 16886 - DNA, 40 bp, Artificial Sequence
  PCR primer for ORF amplification
tggaagtggttcaggaatggtattaacgaggcaagtacta

SEQ ID NO: 16887 - DNA, 40 bp, Artificial Sequence
  PCR primer for ORF amplification
tggaagtggttcaggaatgtcatattacaacaggtatagg

SEQ ID NO: 16888 - DNA, 40 bp, Artificial Sequence
  PCR primer for ORF amplification
tggaagtggttcaggaatgtccgcagaaccattattaccc

SEQ ID NO: 16889 - DNA, 40 bp, Artificial Sequence
  PCR primer for ORF amplification
tggaagtggttcaggaatgttgaaggatttggttagagaa

SEQ ID NO: 16890 - DNA, 40 bp, Artificial Sequence
  PCR primer for ORF amplification
tggaagtggttcaggaatgtatgaagtaatacagaaaagg

SEQ ID NO: 16891 - DNA, 40 bp, Artificial Sequence
  PCR primer for ORF amplification
tggaagtggttcaggaatgaaggcttctagtaaagctatt

SEQ ID NO: 16892 - DNA, 40 bp, Artificial Sequence
  PCR primer for ORF amplification
tggaagtggttcaggaatgcatatgcaactcaggaaaaga

SEQ ID NO: 16893 - DNA, 40 bp, Artificial Sequence
  PCR primer for ORF amplification
tggaagtggttcaggaatgctggtagatttgaatgtaccg

SEQ ID NO: 16894 - DNA, 40 bp, Artificial Sequence
  PCR primer for ORF amplification
tggaagtggttcaggaatggaaagcacatcaggagaacgt

SEQ ID NO: 16895 - DNA, 40 bp, Artificial Sequence
  PCR primer for ORF amplification
tggaagtggttcaggaatggaggaacaggagataggcgtt

SEQ ID NO: 16896 - DNA, 40 bp, Artificial Sequence
  PCR primer for ORF amplification
tggaagtggttcaggaatggcacaagaaatcactcaccca

SEQ ID NO: 16897 - DNA, 40 bp, Artificial Sequence
  PCR primer for ORF amplification
tggaagtggttcaggaatggcatctgtgaacaattaccag

SEQ ID NO: 16898 - DNA, 40 bp, Artificial Sequence
  PCR primer for ORF amplification
tggaagtggttcaggaatggcgtcccaggttaacgcctta

SEQ ID NO: 16899 - DNA, 40 bp, Artificial Sequence
  PCR primer for ORF amplification
tggaagtggttcaggaatgtccaatgatgagataaaccag

SEQ ID NO: 16900 - DNA, 40 bp, Artificial Sequence
  PCR primer for ORF amplification
tggaagtggttcaggaatgaaattcgacaatgacagtgag

SEQ ID NO: 16901 - DNA, 40 bp, Artificial Sequence
  PCR primer for ORF amplification
tggaagtggttcaggaatgaacacgaatcagtccaatccg

SEQ ID NO: 16902 - DNA, 40 bp, Artificial Sequence
  PCR primer for ORF amplification
tggaagtggttcaggaatgaaggctactttactgttgaag

SEQ ID NO: 16903 - DNA, 40 bp, Artificial Sequence
  PCR primer for ORF amplification
tggaagtggttcaggaatgaatgacattaaacaattactt

SEQ ID NO: 16904 - DNA, 40 bp, Artificial Sequence
  PCR primer for ORF amplification
tggaagtggttcaggaatgactttaatggtacctttcaaa

SEQ ID NO: 16905 - DNA, 40 bp, Artificial Sequence
  PCR primer for ORF amplification
tggaagtggttcaggaatgcatttcaaagatttaggattg

SEQ ID NO: 16906 - DNA, 40 bp, Artificial Sequence
  PCR primer for ORF amplification
tggaagtggttcaggaatggacattaacatagacgatatt

SEQ ID NO: 16907 - DNA, 40 bp, Artificial Sequence
  PCR primer for ORF amplification
tggaagtggttcaggaatggataattttgaaagtactgct

SEQ ID NO: 16908 - DNA, 40 bp, Artificial Sequence
  PCR primer for ORF amplification
tggaagtggttcaggaatggcaaaaccgcgtggaagaaaa

SEQ ID NO: 16909 - DNA, 40 bp, Artificial Sequence
  PCR primer for ORF amplification
tggaagtggttcaggaatgtcaggtaacggtgctcaaggt

SEQ ID NO: 16910 - DNA, 40 bp, Artificial Sequence
  PCR primer for ORF amplification
tggaagtggttcaggaatgtcggtaagcgaacaagatcct

SEQ ID NO: 16911 - DNA, 40 bp, Artificial Sequence
  PCR primer for ORF amplification
tggaagtggttcaggaatgtctgctgaaattgaagaagct

SEQ ID NO: 16912 - DNA, 40 bp, Artificial Sequence
  PCR primer for ORF amplification
tggaagtggttcaggaatggactttactgcgaagataaag

SEQ ID NO: 16913 - DNA, 40 bp, Artificial Sequence
  PCR primer for ORF amplification
tggaagtggttcaggaatgaacggttactggaaacctgcg

SEQ ID NO: 16914 - DNA, 40 bp, Artificial Sequence
  PCR primer for ORF amplification
tggaagtggttcaggaatgaacgtgacaccgttggatgaa

SEQ ID NO: 16915 - DNA, 40 bp, Artificial Sequence
  PCR primer for ORF amplification
tggaagtggttcaggaatgaccattgatctagcttctatc

SEQ ID NO: 16916 - DNA, 40 bp, Artificial Sequence
  PCR primer for ORF amplification
tggaagtggttcaggaatgagcaacgctaatccttatgag

SEQ ID NO: 16917 - DNA, 40 bp, Artificial Sequence
  PCR primer for ORF amplification
tggaagtggttcaggaatgagtagtcgcaaaagcaccgct

SEQ ID NO: 16918 - DNA, 40 bp, Artificial Sequence
  PCR primer for ORF amplification
tggaagtggttcaggaatgagtttgagaacgccgaagaga

SEQ ID NO: 16919 - DNA, 40 bp, Artificial Sequence
  PCR primer for ORF amplification
tggaagtggttcaggaatgcctgtttatgaacacttattg

SEQ ID NO: 16920 - DNA, 40 bp, Artificial Sequence
  PCR primer for ORF amplification
tggaagtggttcaggaatgctgaagttgtcaagaagtgcc

SEQ ID NO: 16921 - DNA, 40 bp, Artificial Sequence
  PCR primer for ORF amplification
tggaagtggttcaggaatggacctcctaaaattcagttct

SEQ ID NO: 16922 - DNA, 40 bp, Artificial Sequence
  PCR primer for ORF amplification
tggaagtggttcaggaatggctacgttcaacccacaaaac

SEQ ID NO: 16923 - DNA, 40 bp, Artificial Sequence
  PCR primer for ORF amplification
tggaagtggttcaggaatggctctcggtaatgagataaac

SEQ ID NO: 16924 - DNA, 40 bp, Artificial Sequence
  PCR primer for ORF amplification
tggaagtggttcaggaatgggggaaagcttggatagatgt

SEQ ID NO: 16925 - DNA, 40 bp, Artificial Sequence
  PCR primer for ORF amplification
tggaagtggttcaggaatgtcactcagagcagtcccagga

SEQ ID NO: 16926 - DNA, 40 bp, Artificial Sequence
  PCR primer for ORF amplification
tggaagtggttcaggaatgtccgcctcagctcaacatagc

SEQ ID NO: 16927 - DNA, 40 bp, Artificial Sequence
  PCR primer for ORF amplification
tggaagtggttcaggaatgttaatgcaaataaaaatggac

SEQ ID NO: 16928 - DNA, 40 bp, Artificial Sequence
  PCR primer for ORF amplification
tggaagtggttcaggaatgatgagtgaccaagaaaacgag

SEQ ID NO: 16929 - DNA, 40 bp, Artificial Sequence
  PCR primer for ORF amplification
tggaagtggttcaggaatgtctgttgaaccagttgttgtc

SEQ ID NO: 16930 - DNA, 40 bp, Artificial Sequence
  PCR primer for ORF amplification
tggaagtggttcaggaatgaaactaaaaagggagtatgat

SEQ ID NO: 16931 - DNA, 40 bp, Artificial Sequence
  PCR primer for ORF amplification
tggaagtggttcaggaatgaagctgatcccaattattttg

SEQ ID NO: 16932 - DNA, 40 bp, Artificial Sequence
  PCR primer for ORF amplification
tggaagtggttcaggaatgaataggcagagcggtgtgaat

SEQ ID NO: 16933 - DNA, 40 bp, Artificial Sequence
  PCR primer for ORF amplification
tggaagtggttcaggaatggacgacattgaaacagccaag

SEQ ID NO: 16934 - DNA, 40 bp, Artificial Sequence
  PCR primer for ORF amplification
tggaagtggttcaggaatggactctcttgaagctagatta

SEQ ID NO: 16935 - DNA, 40 bp, Artificial Sequence
  PCR primer for ORF amplification
tggaagtggttcaggaatggattactttaatatcaagcag

SEQ ID NO: 16936 - DNA, 40 bp, Artificial Sequence
  PCR primer for ORF amplification
tggaagtggttcaggaatggcaagagatatcacatttttg

SEQ ID NO: 16937 - DNA, 40 bp, Artificial Sequence
  PCR primer for ORF amplification
tggaagtggttcaggaatgactggagaagactttaagatc

SEQ ID NO: 16938 - DNA, 40 bp, Artificial Sequence
  PCR primer for ORF amplification
tggaagtggttcaggaatgcctatcaaagaaactgataaa

SEQ ID NO: 16939 - DNA, 40 bp, Artificial Sequence
  PCR primer for ORF amplification
tggaagtggttcaggaatggatttggtgaaccatctaacc

SEQ ID NO: 16940 - DNA, 40 bp, Artificial Sequence
  PCR primer for ORF amplification
tggaagtggttcaggaatggctttccaaaaagacgctaag

SEQ ID NO: 16941 - DNA, 40 bp, Artificial Sequence
  PCR primer for ORF amplification
tggaagtggttcaggaatgggtattgaagacattagcgcc

SEQ ID NO: 16942 - DNA, 40 bp, Artificial Sequence
  PCR primer for ORF amplification
tggaagtggttcaggaatggtcgtcatagctaatgcgcac

SEQ ID NO: 16943 - DNA, 40 bp, Artificial Sequence
  PCR primer for ORF amplification
tggaagtggttcaggaatgtcaggtcctccacctccttac

SEQ ID NO: 16944 - DNA, 40 bp, Artificial Sequence
  PCR primer for ORF amplification
tggaagtggttcaggaatgtcgcatcaaatggcgccatgg

SEQ ID NO: 16945 - DNA, 40 bp, Artificial Sequence
  PCR primer for ORF amplification
tggaagtggttcaggaatgtcggagttacagtcacaacct

SEQ ID NO: 16946 - DNA, 40 bp, Artificial Sequence
  PCR primer for ORF amplification
tggaagtggttcaggaatgtctggaagctatcaacattta

SEQ ID NO: 16947 - DNA, 40 bp, Artificial Sequence
  PCR primer for ORF amplification
tggaagtggttcaggaatgtcagaattcaaggttaaaact

SEQ ID NO: 16948 - DNA, 40 bp, Artificial Sequence
  PCR primer for ORF amplification
tggaagtggttcaggaatgaaagtatttataactggtgct

SEQ ID NO: 16949 - DNA, 40 bp, Artificial Sequence
  PCR primer for ORF amplification
tggaagtggttcaggaatgagcggtgaattagcaaattac

SEQ ID NO: 16950 - DNA, 40 bp, Artificial Sequence
  PCR primer for ORF amplification
tggaagtggttcaggaatgatgaataaagtagatcaaatc

SEQ ID NO: 16951 - DNA, 40 bp, Artificial Sequence
  PCR primer for ORF amplification
tggaagtggttcaggaatggtcgcaatctcaatgatttgg

SEQ ID NO: 16952 - DNA, 40 bp, Artificial Sequence
  PCR primer for ORF amplification
tggaagtggttcaggaatgtcaaccaacgcaaaagagtct

SEQ ID NO: 16953 - DNA, 40 bp, Artificial Sequence
  PCR primer for ORF amplification
tggaagtggttcaggaatgtcgacgtcagtcccagtcaag

SEQ ID NO: 16954 - DNA, 40 bp, Artificial Sequence
  PCR primer for ORF amplification
tggaagtggttcaggaatgtcgcctcaataccatttttat

SEQ ID NO: 16955 - DNA, 40 bp, Artificial Sequence
  PCR primer for ORF amplification
tggaagtggttcaggaatgtctagaattagtatattagct

SEQ ID NO: 16956 - DNA, 40 bp, Artificial Sequence
  PCR primer for ORF amplification
tggaagtggttcaggaatgaaactttctaaattatcgatc

SEQ ID NO: 16957 - DNA, 40 bp, Artificial Sequence
  PCR primer for ORF amplification
tggaagtggttcaggaatgaagattcaggcgggccaattg

SEQ ID NO: 16958 - DNA, 40 bp, Artificial Sequence
  PCR primer for ORF amplification
tggaagtggttcaggaatgaaggttgttaaggaatttagt

SEQ ID NO: 16959 - DNA, 40 bp, Artificial Sequence
  PCR primer for ORF amplification
tggaagtggttcaggaatgacggatatagggagaaccaag

SEQ ID NO: 16960 - DNA, 40 bp, Artificial Sequence
  PCR primer for ORF amplification
tggaagtggttcaggaatggactgcaagatattggtgtta

SEQ ID NO: 16961 - DNA, 40 bp, Artificial Sequence
  PCR primer for ORF amplification
tggaagtggttcaggaatggccaatagaggagaaccggat

SEQ ID NO: 16962 - DNA, 40 bp, Artificial Sequence
  PCR primer for ORF amplification
tggaagtggttcaggaatgtccacaagcattacagtaaga

SEQ ID NO: 16963 - DNA, 40 bp, Artificial Sequence
  PCR primer for ORF amplification
tggaagtggttcaggaatgtccagtaaagctaccaaaagt

SEQ ID NO: 16964 - DNA, 40 bp, Artificial Sequence
  PCR primer for ORF amplification
tggaagtggttcaggaatgtctaccttttctgcttctgat

SEQ ID NO: 16965 - DNA, 40 bp, Artificial Sequence
  PCR primer for ORF amplification
tggaagtggttcaggaatgtccgactccgactccgactcc

SEQ ID NO: 16966 - DNA, 40 bp, Artificial Sequence
  PCR primer for ORF amplification
tggaagtggttcaggaatgaaacgctttaatggtatgtat

SEQ ID NO: 16967 - DNA, 40 bp, Artificial Sequence
  PCR primer for ORF amplification
tggaagtggttcaggaatgaattataatctatccaagtat

SEQ ID NO: 16968 - DNA, 40 bp, Artificial Sequence
  PCR primer for ORF amplification
tggaagtggttcaggaatgataagaatatgtcccattgtt

SEQ ID NO: 16969 - DNA, 40 bp, Artificial Sequence
  PCR primer for ORF amplification
tggaagtggttcaggaatgcctcataccgataagaaacaa

SEQ ID NO: 16970 - DNA, 40 bp, Artificial Sequence
  PCR primer for ORF amplification
tggaagtggttcaggaatgcgtttgtttgaaaatagtaaa

SEQ ID NO: 16971 - DNA, 40 bp, Artificial Sequence
  PCR primer for ORF amplification
tggaagtggttcaggaatgctttatttgatcggacttggt

SEQ ID NO: 16972 - DNA, 40 bp, Artificial Sequence
  PCR primer for ORF amplification
tggaagtggttcaggaatggaaaagtacaccaattggaga

SEQ ID NO: 16973 - DNA, 40 bp, Artificial Sequence
  PCR primer for ORF amplification
tggaagtggttcaggaatggagtccaataaacaaccacgt

SEQ ID NO: 16974 - DNA, 40 bp, Artificial Sequence
  PCR primer for ORF amplification
tggaagtggttcaggaatggttaataattcacagcatcct

SEQ ID NO: 16975 - DNA, 40 bp, Artificial Sequence
  PCR primer for ORF amplification
tggaagtggttcaggaatgtcaccgtgttatggacaaaac

SEQ ID NO: 16976 - DNA, 40 bp, Artificial Sequence
  PCR primer for ORF amplification
tggaagtggttcaggaatgtcgtattactttaaaaatctg

SEQ ID NO: 16977 - DNA, 40 bp, Artificial Sequence
  PCR primer for ORF amplification
tggaagtggttcaggaatgggtaaatcgtatgtccatata

SEQ ID NO: 16978 - DNA, 40 bp, Artificial Sequence
  PCR primer for ORF amplification
tggaagtggttcaggaatggtatgtttttaatttcgtttc

SEQ ID NO: 16979 - DNA, 40 bp, Artificial Sequence
  PCR primer for ORF amplification
tggaagtggttcaggaatgtctgaatttaagatgtatgct

SEQ ID NO: 16980 - DNA, 40 bp, Artificial Sequence
  PCR primer for ORF amplification
tggaagtggttcaggaatgaaaattttcaatacaatacaa

SEQ ID NO: 16981 - DNA, 40 bp, Artificial Sequence
  PCR primer for ORF amplification
tggaagtggttcaggaatgaaactgaaagttactggagca

SEQ ID NO: 16982 - DNA, 40 bp, Artificial Sequence
  PCR primer for ORF amplification
tggaagtggttcaggaatgctacaccataagttcgtatac

SEQ ID NO: 16983 - DNA, 40 bp, Artificial Sequence
  PCR primer for ORF amplification
tggaagtggttcaggaatggatgcttttgagaatatgtct

SEQ ID NO: 16984 - DNA, 40 bp, Artificial Sequence
  PCR primer for ORF amplification
tggaagtggttcaggaatgtccagtaatatagaacctcag

SEQ ID NO: 16985 - DNA, 40 bp, Artificial Sequence
  PCR primer for ORF amplification
tggaagtggttcaggaatgtcctacaaaaagtttgtgtac

SEQ ID NO: 16986 - DNA, 40 bp, Artificial Sequence
  PCR primer for ORF amplification
tggaagtggttcaggaatgttgaatagttcaagaaaatat

SEQ ID NO: 16987 - DNA, 40 bp, Artificial Sequence
  PCR primer for ORF amplification
tggaagtggttcaggaatgacctatccgaaaagaatacct

SEQ ID NO: 16988 - DNA, 40 bp, Artificial Sequence
  PCR primer for ORF amplification
tggaagtggttcaggaatgacctcaggatactataccgtc

SEQ ID NO: 16989 - DNA, 40 bp, Artificial Sequence
  PCR primer for ORF amplification
tggaagtggttcaggaatgactgttataaagacagaacca

SEQ ID NO: 16990 - DNA, 40 bp, Artificial Sequence
  PCR primer for ORF amplification
tggaagtggttcaggaatgagggaaaaaagaacaatttca

SEQ ID NO: 16991 - DNA, 40 bp, Artificial Sequence
  PCR primer for ORF amplification
tggaagtggttcaggaatgataaagttgcatgaagtgcct

SEQ ID NO: 16992 - DNA, 40 bp, Artificial Sequence
  PCR primer for ORF amplification
tggaagtggttcaggaatggttaaggtctggaatatagta

SEQ ID NO: 16993 - DNA, 40 bp, Artificial Sequence
  PCR primer for ORF amplification
tggaagtggttcaggaatgttttccagattatccagatct

SEQ ID NO: 16994 - DNA, 40 bp, Artificial Sequence
  PCR primer for ORF amplification
tggaagtggttcaggaatgactgttactgacacttttaaa

SEQ ID NO: 16995 - DNA, 40 bp, Artificial Sequence
  PCR primer for ORF amplification
tggaagtggttcaggaatgagtgtgataggtaggttcttg

SEQ ID NO: 16996 - DNA, 40 bp, Artificial Sequence
  PCR primer for ORF amplification
tggaagtggttcaggaatgagttctatagataatgacagc

SEQ ID NO: 16997 - DNA, 40 bp, Artificial Sequence
  PCR primer for ORF amplification
tggaagtggttcaggaatgccagaagtagagacaaagatt

SEQ ID NO: 16998 - DNA, 40 bp, Artificial Sequence
  PCR primer for ORF amplification
tggaagtggttcaggaatggacgaaaaagtcgaacttatt

SEQ ID NO: 16999 - DNA, 40 bp, Artificial Sequence
  PCR primer for ORF amplification
tggaagtggttcaggaatgggtatgtcagcaccgtgattt

SEQ ID NO: 17000 - DNA, 40 bp, Artificial Sequence
  PCR primer for ORF amplification
tggaagtggttcaggaatgtccacaactgattcggggttc

SEQ ID NO: 17001 - DNA, 40 bp, Artificial Sequence
  PCR primer for ORF amplification
tggaagtggttcaggaatgtctgttatcttagtatctgct

SEQ ID NO: 17002 - DNA, 40 bp, Artificial Sequence
  PCR primer for ORF amplification
tggaagtggttcaggaatgaagatgttgaggcgtacaaag

SEQ ID NO: 17003 - DNA, 40 bp, Artificial Sequence
  PCR primer for ORF amplification
tggaagtggttcaggaatgaatacttcagaactgtcaata

SEQ ID NO: 17004 - DNA, 40 bp, Artificial Sequence
  PCR primer for ORF amplification
tggaagtggttcaggaatgacaaaagatattagaacaggc

SEQ ID NO: 17005 - DNA, 40 bp, Artificial Sequence
  PCR primer for ORF amplification
tggaagtggttcaggaatgactatggacggaaaaaacaaa

SEQ ID NO: 17006 - DNA, 40 bp, Artificial Sequence
  PCR primer for ORF amplification
tggaagtggttcaggaatgactgcccaacaagtatgtgta

SEQ ID NO: 17007 - DNA, 40 bp, Artificial Sequence
  PCR primer for ORF amplification
tggaagtggttcaggaatgactgtaaaagagtatactaaa

SEQ ID NO: 17008 - DNA, 40 bp, Artificial Sequence
  PCR primer for ORF amplification
tggaagtggttcaggaatgatttctgactacgatgctctt

SEQ ID NO: 17009 - DNA, 40 bp, Artificial Sequence
  PCR primer for ORF amplification
tggaagtggttcaggaatgcaacaagcaactgggaacgaa

SEQ ID NO: 17010 - DNA, 40 bp, Artificial Sequence
  PCR primer for ORF amplification
tggaagtggttcaggaatgccattatttgatcttatttct

SEQ ID NO: 17011 - DNA, 40 bp, Artificial Sequence
  PCR primer for ORF amplification
tggaagtggttcaggaatggtcaccattgtatttgatcat

SEQ ID NO: 17012 - DNA, 40 bp, Artificial Sequence
  PCR primer for ORF amplification
tggaagtggttcaggaatgtccacttctcattgcagattt

SEQ ID NO: 17013 - DNA, 40 bp, Artificial Sequence
  PCR primer for ORF amplification
tggaagtggttcaggaatgtcgcagaaaatacagcagcat

SEQ ID NO: 17014 - DNA, 40 bp, Artificial Sequence
  PCR primer for ORF amplification
tggaagtggttcaggaatgcttgtatgttacaataatctt

SEQ ID NO: 17015 - DNA, 40 bp, Artificial Sequence
  PCR primer for ORF amplification
tggaagtggttcaggaatggccaaagacattgagatatcc

SEQ ID NO: 17016 - DNA, 40 bp, Artificial Sequence
  PCR primer for ORF amplification
tggaagtggttcaggaatggttgaggaaaattccagagtt

SEQ ID NO: 17017 - DNA, 40 bp, Artificial Sequence
  PCR primer for ORF amplification
tggaagtggttcaggaatgtccggtaacggtgctcaaggt

SEQ ID NO: 17018 - DNA, 40 bp, Artificial Sequence
  PCR primer for ORF amplification
tggaagtggttcaggaatgtcctctgtccaatccaagatc

SEQ ID NO: 17019 - DNA, 40 bp, Artificial Sequence
  PCR primer for ORF amplification
tggaagtggttcaggaatgtcggagtttaatattacagaa

SEQ ID NO: 17020 - DNA, 40 bp, Artificial Sequence
  PCR primer for ORF amplification
tggaagtggttcaggaatgtcttcgaacgattcgaacgat

SEQ ID NO: 17021 - DNA, 40 bp, Artificial Sequence
  PCR primer for ORF amplification
tggaagtggttcaggaatgaatcaaatctggtctacaggt

SEQ ID NO: 17022 - DNA, 40 bp, Artificial Sequence
  PCR primer for ORF amplification
tggaagtggttcaggaatgaattataactgcgaaatacaa

SEQ ID NO: 17023 - DNA, 40 bp, Artificial Sequence
  PCR primer for ORF amplification
tggaagtggttcaggaatgacctcaattgaagatctgata

SEQ ID NO: 17024 - DNA, 40 bp, Artificial Sequence
  PCR primer for ORF amplification
tggaagtggttcaggaatgagttcagtagagagaataaaa

SEQ ID NO: 17025 - DNA, 40 bp, Artificial Sequence
  PCR primer for ORF amplification
tggaagtggttcaggaatgatgaaaaaaaaaccaaagtgc

SEQ ID NO: 17026 - DNA, 40 bp, Artificial Sequence
  PCR primer for ORF amplification
tggaagtggttcaggaatgcagttgagcaaggctgctgag

SEQ ID NO: 17027 - DNA, 40 bp, Artificial Sequence
  PCR primer for ORF amplification
tggaagtggttcaggaatgctgtggcatcctgatggttac

SEQ ID NO: 17028 - DNA, 40 bp, Artificial Sequence
  PCR primer for ORF amplification
tggaagtggttcaggaatggaacgactacagagattgatg

SEQ ID NO: 17029 - DNA, 40 bp, Artificial Sequence
  PCR primer for ORF amplification
tggaagtggttcaggaatgtcaattacgaagactgaactg

SEQ ID NO: 17030 - DNA, 40 bp, Artificial Sequence
  PCR primer for ORF amplification
tggaagtggttcaggaatgtccgacgaaattgtttggcaa

SEQ ID NO: 17031 - DNA, 40 bp, Artificial Sequence
  PCR primer for ORF amplification
tggaagtggttcaggaatgaccggcatggaatcaggagag

SEQ ID NO: 17032 - DNA, 40 bp, Artificial Sequence
  PCR primer for ORF amplification
tggaagtggttcaggaatgactagtaaattaaaacgggtt

SEQ ID NO: 17033 - DNA, 40 bp, Artificial Sequence
  PCR primer for ORF amplification
tggaagtggttcaggaatgactagtttggacgatacaata

SEQ ID NO: 17034 - DNA, 40 bp, Artificial Sequence
  PCR primer for ORF amplification
tggaagtggttcaggaatgactgagcaagcaactaagcca

SEQ ID NO: 17035 - DNA, 40 bp, Artificial Sequence
  PCR primer for ORF amplification
tggaagtggttcaggaatgagtagcgacgctaagcaacaa

SEQ ID NO: 17036 - DNA, 40 bp, Artificial Sequence
  PCR primer for ORF amplification
tggaagtggttcaggaatggtaccccccacggtagaagca

SEQ ID NO: 17037 - DNA, 40 bp, Artificial Sequence
  PCR primer for ORF amplification
tggaagtggttcaggaatggttcagcaactaagccttttt

SEQ ID NO: 17038 - DNA, 40 bp, Artificial Sequence
  PCR primer for ORF amplification
tggaagtggttcaggaatgtcatcagactcaaacgcaaag

SEQ ID NO: 17039 - DNA, 40 bp, Artificial Sequence
  PCR primer for ORF amplification
tggaagtggttcaggaatgtctgaagaatttccatctcct

SEQ ID NO: 17040 - DNA, 40 bp, Artificial Sequence
  PCR primer for ORF amplification
tggaagtggttcaggaatgttcaagaggcaattatcgact

SEQ ID NO: 17041 - DNA, 40 bp, Artificial Sequence
  PCR primer for ORF amplification
tggaagtggttcaggaatgttgatttcttcacggatcgtt

SEQ ID NO: 17042 - DNA, 40 bp, Artificial Sequence
  PCR primer for ORF amplification
tggaagtggttcaggaatgaagagcttttttctttatctt

SEQ ID NO: 17043 - DNA, 40 bp, Artificial Sequence
  PCR primer for ORF amplification
tggaagtggttcaggaatgatggacttagataagattata

SEQ ID NO: 17044 - DNA, 40 bp, Artificial Sequence
  PCR primer for ORF amplification
tggaagtggttcaggaatgcaacttgtgccgctagaattg

SEQ ID NO: 17045 - DNA, 40 bp, Artificial Sequence
  PCR primer for ORF amplification
tggaagtggttcaggaatggtacgcaagaataaaataaat

SEQ ID NO: 17046 - DNA, 40 bp, Artificial Sequence
  PCR primer for ORF amplification
tggaagtggttcaggaatgtcaaactacgaagccttgctg

SEQ ID NO: 17047 - DNA, 40 bp, Artificial Sequence
  PCR primer for ORF amplification
tggaagtggttcaggaatgggtgaaaaacgtaaccgtaat

SEQ ID NO: 17048 - DNA, 40 bp, Artificial Sequence; identical to SEQ ID NO: 16205
  PCR primer for ORF amplification

SEQ ID NO: 17049 - DNA, 40 bp, Artificial Sequence
  PCR primer for ORF amplification
tggaagtggttcaggaatgaaaatcttccatactgtcgaa

SEQ ID NO: 17050 - DNA, 40 bp, Artificial Sequence
  PCR primer for ORF amplification
tggaagtggttcaggaatgaacttccacacggcaagaata

SEQ ID NO: 17051 - DNA, 40 bp, Artificial Sequence
  PCR primer for ORF amplification
tggaagtggttcaggaatgattttcaaaaggttcgttaat

SEQ ID NO: 17052 - DNA, 40 bp, Artificial Sequence
  PCR primer for ORF amplification
tggaagtggttcaggaatgcagggaaataaatcaactata

SEQ ID NO: 17053 - DNA, 40 bp, Artificial Sequence
  PCR primer for ORF amplification
tggaagtggttcaggaatgcctcttcaactttttggcagg

SEQ ID NO: 17054 - DNA, 40 bp, Artificial Sequence
  PCR primer for ORF amplification
tggaagtggttcaggaatgctgagatcgttattgcaaagc

SEQ ID NO: 17055 - DNA, 40 bp, Artificial Sequence
  PCR primer for ORF amplification
tggaagtggttcaggaatggatagtaaggaagtactggta

SEQ ID NO: 17056 - DNA, 40 bp, Artificial Sequence
  PCR primer for ORF amplification
tggaagtggttcaggaatggcaagtatgtattagtgctag

SEQ ID NO: 17057 - DNA, 40 bp, Artificial Sequence
  PCR primer for ORF amplification
tggaagtggttcaggaatggccagttcgtcacataaccct

SEQ ID NO: 17058 - DNA, 40 bp, Artificial Sequence
  PCR primer for ORF amplification
tggaagtggttcaggaatggcgagtgtaccaagtctatgc

SEQ ID NO: 17059 - DNA, 40 bp, Artificial Sequence
  PCR primer for ORF amplification
tggaagtggttcaggaatgtcaaagtttgttatcacctgc

SEQ ID NO: 17060 - DNA, 40 bp, Artificial Sequence
  PCR primer for ORF amplification
tggaagtggttcaggaatgtcagaagaccagcgtgtaatt

SEQ ID NO: 17061 - DNA, 40 bp, Artificial Sequence
  PCR primer for ORF amplification
tggaagtggttcaggaatgtctcacacagaaacacagact

SEQ ID NO: 17062 - DNA, 40 bp, Artificial Sequence
  PCR primer for ORF amplification
tggaagtggttcaggaatgtctgccgttttcaacaacgct

SEQ ID NO: 17063 - DNA, 40 bp, Artificial Sequence
  PCR primer for ORF amplification
tggaagtggttcaggaatgttctggaaaaaggatcccacc

SEQ ID NO: 17064 - DNA, 40 bp, Artificial Sequence
  PCR primer for ORF amplification
tggaagtggttcaggaatgttttcaaatctatctaaacgt

SEQ ID NO: 17065 - DNA, 40 bp, Artificial Sequence
  PCR primer for ORF amplification
tggaagtggttcaggaatgaatagatcacctggtgagttc

SEQ ID NO: 17066 - DNA, 40 bp, Artificial Sequence
  PCR primer for ORF amplification
tggaagtggttcaggaatgaatttattacgaatgaatgct

SEQ ID NO: 17067 - DNA, 40 bp, Artificial Sequence
  PCR primer for ORF amplification
tggaagtggttcaggaatgacaaccagcatactcgatact

SEQ ID NO: 17068 - DNA, 40 bp, Artificial Sequence
  PCR primer for ORF amplification
tggaagtggttcaggaatgacatctatagataatagacct

SEQ ID NO: 17069 - DNA, 40 bp, Artificial Sequence
  PCR primer for ORF amplification
tggaagtggttcaggaatgagtacaaatacggaaatcata

SEQ ID NO: 17070 - DNA, 40 bp, Artificial Sequence
  PCR primer for ORF amplification
tggaagtggttcaggaatgatctctgaaaaggctgctacc

SEQ ID NO: 17071 - DNA, 40 bp, Artificial Sequence
  PCR primer for ORF amplification
tggaagtggttcaggaatgattagatctacactaagtagt

SEQ ID NO: 17072 - DNA, 40 bp, Artificial Sequence
  PCR primer for ORF amplification
tggaagtggttcaggaatgccgtccaataatagcagtttt

SEQ ID NO: 17073 - DNA, 40 bp, Artificial Sequence
  PCR primer for ORF amplification
tggaagtggttcaggaatgcctatcaccataaaaagccgc

SEQ ID NO: 17074 - DNA, 40 bp, Artificial Sequence
  PCR primer for ORF amplification
tggaagtggttcaggaatgcgtttaatcagtaaagttttg

SEQ ID NO: 17075 - DNA, 40 bp, Artificial Sequence
  PCR primer for ORF amplification
tggaagtggttcaggaatggaattcttttatgaagaacaa

SEQ ID NO: 17076 - DNA, 40 bp, Artificial Sequence
  PCR primer for ORF amplification
tggaagtggttcaggaatgggtaagagcagcaaagataaa

SEQ ID NO: 17077 - DNA, 40 bp, Artificial Sequence
  PCR primer for ORF amplification
tggaagtggttcaggaatggtaagtgattggaaaaatttt

SEQ ID NO: 17078 - DNA, 40 bp, Artificial Sequence
  PCR primer for ORF amplification
tggaagtggttcaggaatgtcgtcaaataataggaagaaa

SEQ ID NO: 17079 - DNA, 40 bp, Artificial Sequence
  PCR primer for ORF amplification
tggaagtggttcaggaatgtcttacagaggacctattgga

SEQ ID NO: 17080 - DNA, 40 bp, Artificial Sequence
  PCR primer for ORF amplification
tggaagtggttcaggaatgactgcaagcacaccatccaat

SEQ ID NO: 17081 - DNA, 40 bp, Artificial Sequence
  PCR primer for ORF amplification
tggaagtggttcaggaatgagtgatatcttgaacgtaagt

SEQ ID NO: 17082 - DNA, 40 bp, Artificial Sequence
  PCR primer for ORF amplification
tggaagtggttcaggaatgctacgtataactgtcaaaact

SEQ ID NO: 17083 - DNA, 40 bp, Artificial Sequence
  PCR primer for ORF amplification
tggaagtggttcaggaatggaaaaagcttccttgaacatt

SEQ ID NO: 17084 - DNA, 40 bp, Artificial Sequence
  PCR primer for ORF amplification
tggaagtggttcaggaatggcggttcaacaaagaaagaag

SEQ ID NO: 17085 - DNA, 40 bp, Artificial Sequence
  PCR primer for ORF amplification
tggaagtggttcaggaatggtatctagaggccccgacgaa

SEQ ID NO: 17086 - DNA, 40 bp, Artificial Sequence
  PCR primer for ORF amplification
tggaagtggttcaggaatggtcgatcaccagtggacgcca

SEQ ID NO: 17087 - DNA, 40 bp, Artificial Sequence
  PCR primer for ORF amplification
tggaagtggttcaggaatgtctgtgtctgctgctcctgct

SEQ ID NO: 17088 - DNA, 40 bp, Artificial Sequence
  PCR primer for ORF amplification
tggaagtggttcaggaatgttgtcaagaattgtatcaaac

SEQ ID NO: 17089 - DNA, 40 bp, Artificial Sequence
  PCR primer for ORF amplification
tggaagtggttcaggaatgaatataatgaaaagacaatta

SEQ ID NO: 17090 - DNA, 40 bp, Artificial Sequence
  PCR primer for ORF amplification
tggaagtggttcaggaatgactgctcaacaaggtgtacca

SEQ ID NO: 17091 - DNA, 40 bp, Artificial Sequence
  PCR primer for ORF amplification
tggaagtggttcaggaatgagaatacaactaaatacaatt

SEQ ID NO: 17092 - DNA, 40 bp, Artificial Sequence
  PCR primer for ORF amplification
tggaagtggttcaggaatgcctcgtctcttggccacgcag

SEQ ID NO: 17093 - DNA, 40 bp, Artificial Sequence
  PCR primer for ORF amplification
tggaagtggttcaggaatgcctgctacgttaaagaattct

SEQ ID NO: 17094 - DNA, 40 bp, Artificial Sequence
  PCR primer for ORF amplification
tggaagtggttcaggaatgcctgctactttacatgattct

SEQ ID NO: 17095 - DNA, 40 bp, Artificial Sequence
  PCR primer for ORF amplification
tggaagtggttcaggaatggataattgtaatgcctgggac

SEQ ID NO: 17096 - DNA, 40 bp, Artificial Sequence
  PCR primer for ORF amplification
tggaagtggttcaggaatgggaggcattcgtgaaaagaaa

SEQ ID NO: 17097 - DNA, 40 bp, Artificial Sequence
  PCR primer for ORF amplification
tggaagtggttcaggaatgggccgtacaacttctgaggga

SEQ ID NO: 17098 - DNA, 40 bp, Artificial Sequence
  PCR primer for ORF amplification
tggaagtggttcaggaatggttcctgctgaatctaatgct

SEQ ID NO: 17099 - DNA, 40 bp, Artificial Sequence
  PCR primer for ORF amplification
tggaagtggttcaggaatggtttcattgactacaatagag

SEQ ID NO: 17100 - DNA, 40 bp, Artificial Sequence
  PCR primer for ORF amplification
tggaagtggttcaggaatgtcaaaagaagacatagaagga

SEQ ID NO: 17101 - DNA, 40 bp, Artificial Sequence
  PCR primer for ORF amplification
tggaagtggttcaggaatgtcatttcaccaacagttcttt

SEQ ID NO: 17102 - DNA, 40 bp, Artificial Sequence
  PCR primer for ORF amplification
tggaagtggttcaggaatgtcgatagtagagacatgcata

SEQ ID NO: 17103 - DNA, 40 bp, Artificial Sequence
  PCR primer for ORF amplification
tggaagtggttcaggaatgtgcattttaatggccacaagg

SEQ ID NO: 17104 - DNA, 40 bp, Artificial Sequence
  PCR primer for ORF amplification
tggaagtggttcaggaatgttaattggtgtaagtggtacg

SEQ ID NO: 17105 - DNA, 40 bp, Artificial Sequence
  PCR primer for ORF amplification
tggaagtggttcaggaatgttgttaagatctagatttttg

SEQ ID NO: 17106 - DNA, 40 bp, Artificial Sequence
  PCR primer for ORF amplification
tggaagtggttcaggaatgtttagtaaatacctcgtaact

SEQ ID NO: 17107 - DNA, 40 bp, Artificial Sequence
  PCR primer for ORF amplification
tggaagtggttcaggaatgaagtttttgggtgtaatactg

SEQ ID NO: 17108 - DNA, 40 bp, Artificial Sequence
  PCR primer for ORF amplification
tggaagtggttcaggaatgaataaacttgttgatgcccac

SEQ ID NO: 17109 - DNA, 40 bp, Artificial Sequence
  PCR primer for ORF amplification
tggaagtggttcaggaatgatgcgtcgcacgctattacat

SEQ ID NO: 17110 - DNA, 40 bp, Artificial Sequence
  PCR primer for ORF amplification
tggaagtggttcaggaatgccactggtgctttttacggga

SEQ ID NO: 17111 - DNA, 40 bp, Artificial Sequence
  PCR primer for ORF amplification
tggaagtggttcaggaatgcgtttctctactacactcgct

SEQ ID NO: 17112 - DNA, 40 bp, Artificial Sequence
  PCR primer for ORF amplification
tggaagtggttcaggaatgctgagtagcagtagcaataga

SEQ ID NO: 17113 - DNA, 40 bp, Artificial Sequence
  PCR primer for ORF amplification
tggaagtggttcaggaatggctccgtatccatacaaagtg

SEQ ID NO: 17114 - DNA, 40 bp, Artificial Sequence
  PCR primer for ORF amplification
tggaagtggttcaggaatgggaaaaggtaaaaataagatg

SEQ ID NO: 17115 - DNA, 40 bp, Artificial Sequence
  PCR primer for ORF amplification
tggaagtggttcaggaatgacagccagtttaactaccaag

SEQ ID NO: 17116 - DNA, 40 bp, Artificial Sequence
  PCR primer for ORF amplification
tggaagtggttcaggaatgactgaaggaaagaggctgcaa

SEQ ID NO: 17117 - DNA, 40 bp, Artificial Sequence
  PCR primer for ORF amplification
tggaagtggttcaggaatgatgcggttaatacgtacattg

SEQ ID NO: 17118 - DNA, 40 bp, Artificial Sequence
  PCR primer for ORF amplification
tggaagtggttcaggaatgccatctaccactaatactgct

SEQ ID NO: 17119 - DNA, 40 bp, Artificial Sequence
  PCR primer for ORF amplification
tggaagtggttcaggaatgcctcgaatatctacatcattg

SEQ ID NO: 17120 - DNA, 40 bp, Artificial Sequence
  PCR primer for ORF amplification
tggaagtggttcaggaatggaacaactgtgtaagaggtac

SEQ ID NO: 17121 - DNA, 40 bp, Artificial Sequence
  PCR primer for ORF amplification
tggaagtggttcaggaatggtagaaaactcgtcgagtaat

SEQ ID NO: 17122 - DNA, 40 bp, Artificial Sequence
  PCR primer for ORF amplification
tggaagtggttcaggaatgtcttataatccgtacgcatat

SEQ ID NO: 17123 - DNA, 40 bp, Artificial Sequence
  PCR primer for ORF amplification
tggaagtggttcaggaatgttcaaagaggaggactcgtta

SEQ ID NO: 17124 - DNA, 40 bp, Artificial Sequence
  PCR primer for ORF amplification
tggaagtggttcaggaatgagtgcccaaaaagtatgttcc

SEQ ID NO: 17125 - DNA, 40 bp, Artificial Sequence
  PCR primer for ORF amplification
tggaagtggttcaggaatgaaatcctcagagccagcgcca

SEQ ID NO: 17126 - DNA, 40 bp, Artificial Sequence
  PCR primer for ORF amplification
tggaagtggttcaggaatgactacgacggtacccaagata

SEQ ID NO: 17127 - DNA, 40 bp, Artificial Sequence
  PCR primer for ORF amplification
tggaagtggttcaggaatgagtatgtaatagaatgtattg

SEQ ID NO: 17128 - DNA, 40 bp, Artificial Sequence
  PCR primer for ORF amplification
tggaagtggttcaggaatgctacaattctcaacatttcta

SEQ ID NO: 17129 - DNA, 40 bp, Artificial Sequence
  PCR primer for ORF amplification
tggaagtggttcaggaatggatgttttattgtcgcttcct

SEQ ID NO: 17130 - DNA, 40 bp, Artificial Sequence
  PCR primer for ORF amplification
tggaagtggttcaggaatgggaaggacatttattcatgct

SEQ ID NO: 17131 - DNA, 40 bp, Artificial Sequence
  PCR primer for ORF amplification
tggaagtggttcaggaatgttccagtttgttactcctgtg

SEQ ID NO: 17132 - DNA, 40 bp, Artificial Sequence
  PCR primer for ORF amplification
tggaagtggttcaggaatgagtatcaccactactagaaga

SEQ ID NO: 17133 - DNA, 40 bp, Artificial Sequence
  PCR primer for ORF amplification
tggaagtggttcaggaatgagtgaaaaagtaaatagtgac

SEQ ID NO: 17134 - DNA, 40 bp, Artificial Sequence
  PCR primer for ORF amplification
tggaagtggttcaggaatgctgaaagaggagtataatttg

SEQ ID NO: 17135 - DNA, 40 bp, Artificial Sequence
  PCR primer for ORF amplification
tggaagtggttcaggaatggaggagtacgattattcagac

SEQ ID NO: 17136 - DNA, 40 bp, Artificial Sequence
  PCR primer for ORF amplification
tggaagtggttcaggaatggcagctaattctgtagggaaa

SEQ ID NO: 17137 - DNA, 40 bp, Artificial Sequence
  PCR primer for ORF amplification
tggaagtggttcaggaatggcatttagtgattttgctgcc

SEQ ID NO: 17138 - DNA, 40 bp, Artificial Sequence
  PCR primer for ORF amplification
tggaagtggttcaggaatggcttttttgaatattttcaag

SEQ ID NO: 17139 - DNA, 40 bp, Artificial Sequence
  PCR primer for ORF amplification
tggaagtggttcaggaatgggaatatttcgttggaactat

SEQ ID NO: 17140 - DNA, 40 bp, Artificial Sequence
  PCR primer for ORF amplification
tggaagtggttcaggaatggtgtctacacataacagagat

SEQ ID NO: 17141 - DNA, 40 bp, Artificial Sequence
  PCR primer for ORF amplification
tggaagtggttcaggaatggttaagaaaaactttatcccg

SEQ ID NO: 17142 - DNA, 40 bp, Artificial Sequence
  PCR primer for ORF amplification
tggaagtggttcaggaatgtcatctacggacatctggata

SEQ ID NO: 17143 - DNA, 40 bp, Artificial Sequence
  PCR primer for ORF amplification
tggaagtggttcaggaatgttaaagaggttagccaatcgt

SEQ ID NO: 17144 - DNA, 40 bp, Artificial Sequence
  PCR primer for ORF amplification
tggaagtggttcaggaatgaaaaccattattatttcagat

SEQ ID NO: 17145 - DNA, 40 bp, Artificial Sequence
  PCR primer for ORF amplification
tggaagtggttcaggaatgaaacgagttactggagttttc

SEQ ID NO: 17146 - DNA, 40 bp, Artificial Sequence
  PCR primer for ORF amplification
tggaagtggttcaggaatgaatttttccctttcaaagcaa

SEQ ID NO: 17147 - DNA, 40 bp, Artificial Sequence
  PCR primer for ORF amplification
tggaagtggttcaggaatgaccagtacattacatacgaca

SEQ ID NO: 17148 - DNA, 40 bp, Artificial Sequence
  PCR primer for ORF amplification
tggaagtggttcaggaatgagcagcacgaggaagttcaaa

SEQ ID NO: 17149 - DNA, 40 bp, Artificial Sequence
  PCR primer for ORF amplification
tggaagtggttcaggaatgagtggaatgatagaaaatggg

SEQ ID NO: 17150 - DNA, 40 bp, Artificial Sequence
  PCR primer for ORF amplification
tggaagtggttcaggaatgctgttcagctggccttatcca

SEQ ID NO: 17151 - DNA, 40 bp, Artificial Sequence
  PCR primer for ORF amplification
tggaagtggttcaggaatggaggacagtagcaatacaatc

SEQ ID NO: 17152 - DNA, 40 bp, Artificial Sequence
  PCR primer for ORF amplification
tggaagtggttcaggaatggatcaagattttgacagttta

SEQ ID NO: 17153 - DNA, 40 bp, Artificial Sequence
  PCR primer for ORF amplification
tggaagtggttcaggaatggcaaaagacggcttcgagtta

SEQ ID NO: 17154 - DNA, 40 bp, Artificial Sequence
  PCR primer for ORF amplification
tggaagtggttcaggaatgtatgtttaacagtgatactaa

SEQ ID NO: 17155 - DNA, 40 bp, Artificial Sequence
  PCR primer for ORF amplification
tggaagtggttcaggaatgtcaactttattagaaaggact

SEQ ID NO: 17156 - DNA, 40 bp, Artificial Sequence
  PCR primer for ORF amplification
tggaagtggttcaggaatgtcgtgctcaaacggcatctgg

SEQ ID NO: 17157 - DNA, 40 bp, Artificial Sequence
  PCR primer for ORF amplification
tggaagtggttcaggaatgacagtaatcaccattgccaag

SEQ ID NO: 17158 - DNA, 40 bp, Artificial Sequence
  PCR primer for ORF amplification
tggaagtggttcaggaatgagtgaagaaggtcctcaagtt

SEQ ID NO: 17159 - DNA, 40 bp, Artificial Sequence
  PCR primer for ORF amplification
tggaagtggttcaggaatgggaaaggctgcgaaaaagaag

SEQ ID NO: 17160 - DNA, 40 bp, Artificial Sequence
  PCR primer for ORF amplification
tggaagtggttcaggaatggggaaaggtgcggccaagtat

SEQ ID NO: 17161 - DNA, 40 bp, Artificial Sequence
  PCR primer for ORF amplification
tggaagtggttcaggaatgtctacaaacagtattaagttg

SEQ ID NO: 17162 - DNA, 40 bp, Artificial Sequence
  PCR primer for ORF amplification
tggaagtggttcaggaatgtcttccaacgcccaagtcaaa

SEQ ID NO: 17163 - DNA, 40 bp, Artificial Sequence
  PCR primer for ORF amplification
tggaagtggttcaggaatgtggagactaaccagaaaaatc

SEQ ID NO: 17164 - DNA, 40 bp, Artificial Sequence
  PCR primer for ORF amplification
tggaagtggttcaggaatgtggttgaaatccttgctgctc

SEQ ID NO: 17165 - DNA, 40 bp, Artificial Sequence
  PCR primer for ORF amplification
tggaagtggttcaggaatgttatttcttaatattattaag

SEQ ID NO: 17166 - DNA, 40 bp, Artificial Sequence
  PCR primer for ORF amplification
tggaagtggttcaggaatgaaagtaccattggggttatgg

SEQ ID NO: 17167 - DNA, 40 bp, Artificial Sequence
  PCR primer for ORF amplification
tggaagtggttcaggaatgacgataaaaagaaatttggtg

SEQ ID NO: 17168 - DNA, 40 bp, Artificial Sequence
  PCR primer for ORF amplification
tggaagtggttcaggaatgactattctagaggagcttaat

SEQ ID NO: 17169 - DNA, 40 bp, Artificial Sequence
  PCR primer for ORF amplification
tggaagtggttcaggaatgagcgaggagtgtattgaaaat

SEQ ID NO: 17170 - DNA, 40 bp, Artificial Sequence
  PCR primer for ORF amplification
tggaagtggttcaggaatgatggggtttgaatggggtttt

SEQ ID NO: 17171 - DNA, 40 bp, Artificial Sequence
  PCR primer for ORF amplification
tggaagtggttcaggaatgctaaaatccgtacagggactg

SEQ ID NO: 17172 - DNA, 40 bp, Artificial Sequence
  PCR primer for ORF amplification
tggaagtggttcaggaatggttcacaacaaagttactatc

SEQ ID NO: 17173 - DNA, 40 bp, Artificial Sequence
  PCR primer for ORF amplification
tggaagtggttcaggaatgtggaagagatcgttccactcc

SEQ ID NO: 17174 - DNA, 40 bp, Artificial Sequence
  PCR primer for ORF amplification
tggaagtggttcaggaatgccttccagattcactaagact

SEQ ID NO: 17175 - DNA, 40 bp, Artificial Sequence
  PCR primer for ORF amplification
tggaagtggttcaggaatgaagtttacgttagaagaccaa

SEQ ID NO: 17176 - DNA, 40 bp, Artificial Sequence
  PCR primer for ORF amplification
tggaagtggttcaggaatgatacgttcaatatttataccg

SEQ ID NO: 17177 - DNA, 40 bp, Artificial Sequence
  PCR primer for ORF amplification
tggaagtggttcaggaatgattttagtgtacaatcgtatc

SEQ ID NO: 17178 - DNA, 40 bp, Artificial Sequence
  PCR primer for ORF amplification
tggaagtggttcaggaatgccaacaaattccatcaaatta

SEQ ID NO: 17179 - DNA, 40 bp, Artificial Sequence
  PCR primer for ORF amplification
tggaagtggttcaggaatggacagtgaagcaagtgacatt

SEQ ID NO: 17180 - DNA, 40 bp, Artificial Sequence
  PCR primer for ORF amplification
tggaagtggttcaggaatgggtgatataagaacttttgtt

SEQ ID NO: 17181 - DNA, 40 bp, Artificial Sequence
  PCR primer for ORF amplification
tggaagtggttcaggaatgtcgaagcctggtcgtactatt

SEQ ID NO: 17182 - DNA, 40 bp, Artificial Sequence
  PCR primer for ORF amplification
tggaagtggttcaggaatgtctacctttgaaactttaatt

SEQ ID NO: 17183 - DNA, 40 bp, Artificial Sequence
  PCR primer for ORF amplification
tggaagtggttcaggaatgtctgaccaacccgagactcct

SEQ ID NO: 17184 - DNA, 40 bp, Artificial Sequence
  PCR primer for ORF amplification
tggaagtggttcaggaatgttgggaaaagaagaagaacag

SEQ ID NO: 17185 - DNA, 40 bp, Artificial Sequence
  PCR primer for ORF amplification
tggaagtggttcaggaatgggtatgtctactataaaataa

SEQ ID NO: 17186 - DNA, 40 bp, Artificial Sequence
  PCR primer for ORF amplification
tggaagtggttcaggaatgacaacaaccgtacctaaagtg

SEQ ID NO: 17187 - DNA, 40 bp, Artificial Sequence
  PCR primer for ORF amplification
tggaagtggttcaggaatgactatcgctaaagattacaga

SEQ ID NO: 17188 - DNA, 40 bp, Artificial Sequence
  PCR primer for ORF amplification
tggaagtggttcaggaatgactcgtcccccattggttcgt

SEQ ID NO: 17189 - DNA, 40 bp, Artificial Sequence
  PCR primer for ORF amplification
tggaagtggttcaggaatgagtatccccgctgacattgca

SEQ ID NO: 17190 - DNA, 40 bp, Artificial Sequence
  PCR primer for ORF amplification
tggaagtggttcaggaatgatttgcataacgtgcatgcgg

SEQ ID NO: 17191 - DNA, 40 bp, Artificial Sequence
  PCR primer for ORF amplification
tggaagtggttcaggaatgccagagcaagaactacttata

SEQ ID NO: 17192 - DNA, 40 bp, Artificial Sequence
  PCR primer for ORF amplification
tggaagtggttcaggaatgcttatggatgagtatgaggaa

SEQ ID NO: 17193 - DNA, 40 bp, Artificial Sequence
  PCR primer for ORF amplification
tggaagtggttcaggaatgcttcgctttactggtgctcgc

SEQ ID NO: 17194 - DNA, 40 bp, Artificial Sequence
  PCR primer for ORF amplification
tggaagtggttcaggaatggacagaggaaggtgcgccaat

SEQ ID NO: 17195 - DNA, 40 bp, Artificial Sequence
  PCR primer for ORF amplification
tggaagtggttcaggaatggttgaaattgtgggccacaga

SEQ ID NO: 17196 - DNA, 40 bp, Artificial Sequence
  PCR primer for ORF amplification
tggaagtggttcaggaatggttgacgctaggggtagtacg

SEQ ID NO: 17197 - DNA, 40 bp, Artificial Sequence
  PCR primer for ORF amplification
tggaagtggttcaggaatgttgttgttagcattaagtgat

SEQ ID NO: 17198 - DNA, 40 bp, Artificial Sequence
  PCR primer for ORF amplification
tggaagtggttcaggaatgaaaccgacacaggattcacaa

SEQ ID NO: 17199 - DNA, 40 bp, Artificial Sequence
  PCR primer for ORF amplification
tggaagtggttcaggaatgaaagcggaaaggcaaacagga

SEQ ID NO: 17200 - DNA, 40 bp, Artificial Sequence
  PCR primer for ORF amplification
tggaagtggttcaggaatgcctttgaacaagtcgaacata

SEQ ID NO: 17201 - DNA, 40 bp, Artificial Sequence
  PCR primer for ORF amplification
tggaagtggttcaggaatggaaatgactgattttgaacta

SEQ ID NO: 17202 - DNA, 40 bp, Artificial Sequence
  PCR primer for ORF amplification
tggaagtggttcaggaatggatcctctcagctcagtacag

SEQ ID NO: 17203 - DNA, 40 bp, Artificial Sequence
  PCR primer for ORF amplification
tggaagtggttcaggaatggcgatcaagaaaagaaataaa

SEQ ID NO: 17204 - DNA, 40 bp, Artificial Sequence
  PCR primer for ORF amplification
tggaagtggttcaggaatgtccattgtagcactaaagaac

SEQ ID NO: 17205 - DNA, 40 bp, Artificial Sequence
  PCR primer for ORF amplification
tggaagtggttcaggaatgtctatggagcctcctgtgggg

SEQ ID NO: 17206 - DNA, 40 bp, Artificial Sequence
  PCR primer for ORF amplification
tggaagtggttcaggaatgtctcaaaaaaagaaggcttcc

SEQ ID NO: 17207 - DNA, 40 bp, Artificial Sequence
  PCR primer for ORF amplification
tggaagtggttcaggaatgtcttcaactcaagacagtaaa

SEQ ID NO: 17208 - DNA, 40 bp, Artificial Sequence
  PCR primer for ORF amplification
tggaagtggttcaggaatgttttgtacctgggatagctgg

SEQ ID NO: 17209 - DNA, 40 bp, Artificial Sequence
  PCR primer for ORF amplification
tggaagtggttcaggaatgaataaagaagagcaagaagac

SEQ ID NO: 17210 - DNA, 40 bp, Artificial Sequence
  PCR primer for ORF amplification
tggaagtggttcaggaatgacggtaaacttagatccggat

SEQ ID NO: 17211 - DNA, 40 bp, Artificial Sequence
  PCR primer for ORF amplification
tggaagtggttcaggaatgcctagcacgtttgaatcccag

SEQ ID NO: 17212 - DNA, 40 bp, Artificial Sequence
  PCR primer for ORF amplification
tggaagtggttcaggaatggctaagttcttgaaagctggt

SEQ ID NO: 17213 - DNA, 40 bp, Artificial Sequence
  PCR primer for ORF amplification
tggaagtggttcaggaatgtccaaaactttatctttgcaa

SEQ ID NO: 17214 - DNA, 40 bp, Artificial Sequence
  PCR primer for ORF amplification
tggaagtggttcaggaatgtcggggagcttctggacatct

SEQ ID NO: 17215 - DNA, 40 bp, Artificial Sequence
  PCR primer for ORF amplification
tggaagtggttcaggaatgtctgctccacaagccaagatt

SEQ ID NO: 17216 - DNA, 40 bp, Artificial Sequence
  PCR primer for ORF amplification
tggaagtggttcaggaatgaagcgcattccaatcaaagaa

SEQ ID NO: 17217 - DNA, 40 bp, Artificial Sequence
  PCR primer for ORF amplification
tggaagtggttcaggaatgcgtataggtatggaagagctt

SEQ ID NO: 17218 - DNA, 40 bp, Artificial Sequence
  PCR primer for ORF amplification
tggaagtggttcaggaatggatagagacactaaattagct

SEQ ID NO: 17219 - DNA, 40 bp, Artificial Sequence
  PCR primer for ORF amplification
tggaagtggttcaggaatgtcatctgacaactctaaacaa

SEQ ID NO: 17220 - DNA, 40 bp, Artificial Sequence
  PCR primer for ORF amplification
tggaagtggttcaggaatgtcagctgtcccaagtgttcaa

SEQ ID NO: 17221 - DNA, 40 bp, Artificial Sequence
  PCR primer for ORF amplification
tggaagtggttcaggaatgaaatttaatttttctacaatt

SEQ ID NO: 17222 - DNA, 40 bp, Artificial Sequence
  PCR primer for ORF amplification
tggaagtggttcaggaatgagttttacaggttcattagcg

SEQ ID NO: 17223 - DNA, 40 bp, Artificial Sequence
  PCR primer for ORF amplification
tggaagtggttcaggaatgatgccgaatgttgctccaaac

SEQ ID NO: 17224 - DNA, 40 bp, Artificial Sequence
  PCR primer for ORF amplification
tggaagtggttcaggaatgattgaagagaatttgaaacag

SEQ ID NO: 17225 - DNA, 40 bp, Artificial Sequence
  PCR primer for ORF amplification
tggaagtggttcaggaatgcaatataaaaagccattagtc

SEQ ID NO: 17226 - DNA, 40 bp, Artificial Sequence
  PCR primer for ORF amplification
tggaagtggttcaggaatgctgccatcattaaggaaggga

SEQ ID NO: 17227 - DNA, 40 bp, Artificial Sequence
  PCR primer for ORF amplification
tggaagtggttcaggaatggcacgtcttcctctaaagcag

SEQ ID NO: 17228 - DNA, 40 bp, Artificial Sequence
  PCR primer for ORF amplification
tggaagtggttcaggaatgtcaggatctcttacgctactt

SEQ ID NO: 17229 - DNA, 40 bp, Artificial Sequence
  PCR primer for ORF amplification
tggaagtggttcaggaatgtccttcttcaacttcaagtat

SEQ ID NO: 17230 - DNA, 40 bp, Artificial Sequence
  PCR primer for ORF amplification
tggaagtggttcaggaatgtctactaactttgaaaaacat

SEQ ID NO: 17231 - DNA, 40 bp, Artificial Sequence
  PCR primer for ORF amplification
tggaagtggttcaggaatgaaaaatgataataaagctaat

SEQ ID NO: 17232 - DNA, 40 bp, Artificial Sequence
  PCR primer for ORF amplification
tggaagtggttcaggaatgaaattcacatcagtgctagca

SEQ ID NO: 17233 - DNA, 40 bp, Artificial Sequence
  PCR primer for ORF amplification
tggaagtggttcaggaatgaattcagagtctcgagaagat

SEQ ID NO: 17234 - DNA, 40 bp, Artificial Sequence
  PCR primer for ORF amplification
tggaagtggttcaggaatgattgttcccacttatggagac

SEQ ID NO: 17235 - DNA, 40 bp, Artificial Sequence
  PCR primer for ORF amplification
tggaagtggttcaggaatggaagataagcggaaaagacga

SEQ ID NO: 17236 - DNA, 40 bp, Artificial Sequence
  PCR primer for ORF amplification
tggaagtggttcaggaatggcagaagtactgaccgtcctc

SEQ ID NO: 17237 - DNA, 40 bp, Artificial Sequence
  PCR primer for ORF amplification
tggaagtggttcaggaatgtcacaagtaaaaagagccaat

SEQ ID NO: 17238 - DNA, 40 bp, Artificial Sequence
  PCR primer for ORF amplification
tggaagtggttcaggaatgtccactgatagtacacgctat

SEQ ID NO: 17239 - DNA, 40 bp, Artificial Sequence
  PCR primer for ORF amplification
tggaagtggttcaggaatgtcgtttaatgccttcgccagc

SEQ ID NO: 17240 - DNA, 40 bp, Artificial Sequence
  PCR primer for ORF amplification
tggaagtggttcaggaatgtctgctacctctactgctact

SEQ ID NO: 17241 - DNA, 40 bp, Artificial Sequence
  PCR primer for ORF amplification
tggaagtggttcaggaatgtccactgaattaactgttcaa

SEQ ID NO: 17242 - DNA, 40 bp, Artificial Sequence
  PCR primer for ORF amplification
tggaagtggttcaggaatgagctccagtgaagacgaagac

SEQ ID NO: 17243 - DNA, 40 bp, Artificial Sequence
  PCR primer for ORF amplification
tggaagtggttcaggaatgagtgagaccaatggtggcaat

SEQ ID NO: 17244 - DNA, 40 bp, Artificial Sequence
  PCR primer for ORF amplification
tggaagtggttcaggaatgcatagaacggcaatatttcta

SEQ ID NO: 17245 - DNA, 40 bp, Artificial Sequence
  PCR primer for ORF amplification
tggaagtggttcaggaatggcatcatcagtcccagggccc

SEQ ID NO: 17246 - DNA, 40 bp, Artificial Sequence
  PCR primer for ORF amplification
tggaagtggttcaggaatggctattcaaaaggttagtaac

SEQ ID NO: 17247 - DNA, 40 bp, Artificial Sequence
  PCR primer for ORF amplification
tggaagtggttcaggaatgggccctgaaactctacatatt

SEQ ID NO: 17248 - DNA, 40 bp, Artificial Sequence
  PCR primer for ORF amplification
tggaagtggttcaggaatggttaaaggtagtgtgcattta

SEQ ID NO: 17249 - DNA, 40 bp, Artificial Sequence
  PCR primer for ORF amplification
tggaagtggttcaggaatgtcaattgcacaagataggggt

SEQ ID NO: 17250 - DNA, 40 bp, Artificial Sequence
  PCR primer for ORF amplification
tggaagtggttcaggaatgtcattcagaccaggtagcaga

SEQ ID NO: 17251 - DNA, 40 bp, Artificial Sequence
  PCR primer for ORF amplification
tggaagtggttcaggaatgtcttcactggttactcttaat

SEQ ID NO: 17252 - DNA, 40 bp, Artificial Sequence
  PCR primer for ORF amplification
tggaagtggttcaggaatgtcttcagacacttcattatca

SEQ ID NO: 17253 - DNA, 40 bp, Artificial Sequence
  PCR primer for ORF amplification
tggaagtggttcaggaatggcaggtgtttccgttaggtac

SEQ ID NO: 17254 - DNA, 40 bp, Artificial Sequence
  PCR primer for ORF amplification
tggaagtggttcaggaatgtcagcgtatgtatataccttg

SEQ ID NO: 17255 - DNA, 40 bp, Artificial Sequence
  PCR primer for ORF amplification
tggaagtggttcaggaatgactgagatactaccacatgta

SEQ ID NO: 17256 - DNA, 40 bp, Artificial Sequence
  PCR primer for ORF amplification
tggaagtggttcaggaatgagccaacagaatatactacat

SEQ ID NO: 17257 - DNA, 40 bp, Artificial Sequence
  PCR primer for ORF amplification
tggaagtggttcaggaatgagtaaaaacagggaccctcta

SEQ ID NO: 17258 - DNA, 40 bp, Artificial Sequence
  PCR primer for ORF amplification
tggaagtggttcaggaatgatagcaggtgcgactgctccg

SEQ ID NO: 17259 - DNA, 40 bp, Artificial Sequence
  PCR primer for ORF amplification
tggaagtggttcaggaatgcctgcccctcaagatccaagg

SEQ ID NO: 17260 - DNA, 40 bp, Artificial Sequence
  PCR primer for ORF amplification
tggaagtggttcaggaatgcctgttgttcattgttcgtcc

SEQ ID NO: 17261 - DNA, 40 bp, Artificial Sequence
  PCR primer for ORF amplification
tggaagtggttcaggaatggaaaaaaaacatgtcactgtg

SEQ ID NO: 17262 - DNA, 40 bp, Artificial Sequence
  PCR primer for ORF amplification
tggaagtggttcaggaatggagagaatcatacagcagact

SEQ ID NO: 17263 - DNA, 40 bp, Artificial Sequence
  PCR primer for ORF amplification
tggaagtggttcaggaatggcatccaccgatttctccaag

SEQ ID NO: 17264 - DNA, 40 bp, Artificial Sequence
  PCR primer for ORF amplification
tggaagtggttcaggaatgtcgagactagcgcataataaa

SEQ ID NO: 17265 - DNA, 40 bp, Artificial Sequence
  PCR primer for ORF amplification
tggaagtggttcaggaatgtcgaggtgtattcgccagtcc

SEQ ID NO: 17266 - DNA, 40 bp, Artificial Sequence
  PCR primer for ORF amplification
tggaagtggttcaggaatgttaactctagagtctgcatta

SEQ ID NO: 17267 - DNA, 40 bp, Artificial Sequence
  PCR primer for ORF amplification
tggaagtggttcaggaatgaaattttctaaagtctcacta

SEQ ID NO: 17268 - DNA, 40 bp, Artificial Sequence
  PCR primer for ORF amplification
tggaagtggttcaggaatgaccaccgtgtccatcaataag

SEQ ID NO: 17269 - DNA, 40 bp, Artificial Sequence
  PCR primer for ORF amplification
tggaagtggttcaggaatgagtgaagaatttcctacgccg

SEQ ID NO: 17270 - DNA, 40 bp, Artificial Sequence
  PCR primer for ORF amplification
tggaagtggttcaggaatgggctctatgaataaggaacag

SEQ ID NO: 17271 - DNA, 40 bp, Artificial Sequence
  PCR primer for ORF amplification
tggaagtggttcaggaatggtaagttcattcagtgttccc

SEQ ID NO: 17272 - DNA, 40 bp, Artificial Sequence
  PCR primer for ORF amplification
tggaagtggttcaggaatgtgcagtaggatactcttgtcc

SEQ ID NO: 17273 - DNA, 40 bp, Artificial Sequence
  PCR primer for ORF amplification
tggaagtggttcaggaatgttaagatctaccgtttcaaaa

SEQ ID NO: 17274 - DNA, 40 bp, Artificial Sequence
  PCR primer for ORF amplification
tggaagtggttcaggaatgacgccttctaatatggatgat

SEQ ID NO: 17275 - DNA, 40 bp, Artificial Sequence
  PCR primer for ORF amplification
tggaagtggttcaggaatgagttcaccagcgaacctattc

SEQ ID NO: 17276 - DNA, 40 bp, Artificial Sequence
  PCR primer for ORF amplification
tggaagtggttcaggaatggcgtctatcaatctgattaag

SEQ ID NO: 17277 - DNA, 40 bp, Artificial Sequence
  PCR primer for ORF amplification
tggaagtggttcaggaatggctagtaacgctgcaagggtt

SEQ ID NO: 17278 - DNA, 40 bp, Artificial Sequence
  PCR primer for ORF amplification
tggaagtggttcaggaatgggtattgatcacacttccaag

SEQ ID NO: 17279 - DNA, 40 bp, Artificial Sequence
  PCR primer for ORF amplification
tggaagtggttcaggaatgttagacccacgaatattgcca

SEQ ID NO: 17280 - DNA, 40 bp, Artificial Sequence
  PCR primer for ORF amplification
tggaagtggttcaggaatgggtcgtatgcacagtgccgta

SEQ ID NO: 17281 - DNA, 40 bp, Artificial Sequence
  PCR primer for ORF amplification
tggaagtggttcaggaatgtcagaccctgtagagttattg

SEQ ID NO: 17282 - DNA, 40 bp, Artificial Sequence
  PCR primer for ORF amplification
tggaagtggttcaggaatgaggtctattaaatgtgtgata

SEQ ID NO: 17283 - DNA, 40 bp, Artificial Sequence
  PCR primer for ORF amplification
tggaagtggttcaggaatgctgatgccaaagtcagttgca

SEQ ID NO: 17284 - DNA, 40 bp, Artificial Sequence
  PCR primer for ORF amplification
tggaagtggttcaggaatggttagagttgctattaacggt

SEQ ID NO: 17285 - DNA, 40 bp, Artificial Sequence
  PCR primer for ORF amplification
tggaagtggttcaggaatgaacgatacgctatcaagcttt

SEQ ID NO: 17286 - DNA, 40 bp, Artificial Sequence
  PCR primer for ORF amplification
tggaagtggttcaggaatgaagtggtgtagcacatacatt

SEQ ID NO: 17287 - DNA, 40 bp, Artificial Sequence
  PCR primer for ORF amplification
tggaagtggttcaggaatgagcggatacacgggaaataat

SEQ ID NO: 17288 - DNA, 40 bp, Artificial Sequence
  PCR primer for ORF amplification
tggaagtggttcaggaatgagtgagtaaatacctactaaa

SEQ ID NO: 17289 - DNA, 40 bp, Artificial Sequence
  PCR primer for ORF amplification
tggaagtggttcaggaatgatcagaattgctattaacggt

SEQ ID NO: 17290 - DNA, 40 bp, Artificial Sequence
  PCR primer for ORF amplification
tggaagtggttcaggaatgggtgtcatcaagaagaaaaga

SEQ ID NO: 17291 - DNA, 40 bp, Artificial Sequence
  PCR primer for ORF amplification
tggaagtggttcaggaatgtctactcaatccggtatagtc

SEQ ID NO: 17292 - DNA, 40 bp, Artificial Sequence
  PCR primer for ORF amplification
tggaagtggttcaggaatgccaagtacgtattagactata

SEQ ID NO: 17293 - DNA, 40 bp, Artificial Sequence
  PCR primer for ORF amplification
tggaagtggttcaggaatgaaagtgaatatggagtacaca

SEQ ID NO: 17294 - DNA, 40 bp, Artificial Sequence
  PCR primer for ORF amplification
tggaagtggttcaggaatgagttgtgtgtatgcgtttggg

SEQ ID NO: 17295 - DNA, 40 bp, Artificial Sequence
  PCR primer for ORF amplification
tggaagtggttcaggaatgagttttctttccaaactttcc

SEQ ID NO: 17296 - DNA, 40 bp, Artificial Sequence
  PCR primer for ORF amplification
tggaagtggttcaggaatggaaacaggacctcattacaac

SEQ ID NO: 17297 - DNA, 40 bp, Artificial Sequence
  PCR primer for ORF amplification
tggaagtggttcaggaatggctaaccaggtaagtagtaaa

SEQ ID NO: 17298 - DNA, 40 bp, Artificial Sequence
  PCR primer for ORF amplification
tggaagtggttcaggaatggctccgtcaatgattccgttc

SEQ ID NO: 17299 - DNA, 40 bp, Artificial Sequence
  PCR primer for ORF amplification
tggaagtggttcaggaatgggtatgttgaactgaagcaat

SEQ ID NO: 17300 - DNA, 40 bp, Artificial Sequence
  PCR primer for ORF amplification
tggaagtggttcaggaatgggtattacagtaataggttct

SEQ ID NO: 17301 - DNA, 40 bp, Artificial Sequence
  PCR primer for ORF amplification
tggaagtggttcaggaatgtcagaaccttcagagaaaaaa

SEQ ID NO: 17302 - DNA, 40 bp, Artificial Sequence
  PCR primer for ORF amplification
tggaagtggttcaggaatgaaatgtactataccagaacag

SEQ ID NO: 17303 - DNA, 40 bp, Artificial Sequence
  PCR primer for ORF amplification
tggaagtggttcaggaatgacaaaatcaagaaagcagaag

SEQ ID NO: 17304 - DNA, 40 bp, Artificial Sequence
  PCR primer for ORF amplification
tggaagtggttcaggaatgagagcgttgagattcctgatt

SEQ ID NO: 17305 - DNA, 40 bp, Artificial Sequence
  PCR primer for ORF amplification
tggaagtggttcaggaatggaaaaggacgcattggaggtt

SEQ ID NO: 17306 - DNA, 40 bp, Artificial Sequence
  PCR primer for ORF amplification
tggaagtggttcaggaatggccagcaagactttgagggtt

SEQ ID NO: 17307 - DNA, 40 bp, Artificial Sequence
  PCR primer for ORF amplification
tggaagtggttcaggaatgtgtgaagagaatgttcatgtt

SEQ ID NO: 17308 - DNA, 40 bp, Artificial Sequence
  PCR primer for ORF amplification
tggaagtggttcaggaatgttgtcaagagtagctaaacgt

SEQ ID NO: 17309 - DNA, 40 bp, Artificial Sequence
  PCR primer for ORF amplification
tggaagtggttcaggaatgaataatggagacaataaaacg

SEQ ID NO: 17310 - DNA, 40 bp, Artificial Sequence
  PCR primer for ORF amplification
tggaagtggttcaggaatgatgtcagtcaatagatttact

SEQ ID NO: 17311 - DNA, 40 bp, Artificial Sequence
  PCR primer for ORF amplification
tggaagtggttcaggaatgcactcacaccattcacactcc

SEQ ID NO: 17312 - DNA, 40 bp, Artificial Sequence
  PCR primer for ORF amplification
tggaagtggttcaggaatggaggccaagatagatgagctg

SEQ ID NO: 17313 - DNA, 40 bp, Artificial Sequence
  PCR primer for ORF amplification
tggaagtggttcaggaatggcagctgcaccatggtatatt

SEQ ID NO: 17314 - DNA, 40 bp, Artificial Sequence
  PCR primer for ORF amplification
tggaagtggttcaggaatggcattccaagatccaacttac

SEQ ID NO: 17315 - DNA, 40 bp, Artificial Sequence
  PCR primer for ORF amplification
tggaagtggttcaggaatgggtatcgatcacacttccaag

SEQ ID NO: 17316 - DNA, 40 bp, Artificial Sequence
  PCR primer for ORF amplification
tggaagtggttcaggaatggttaatgaaaaagtgaatcca

SEQ ID NO: 17317 - DNA, 40 bp, Artificial Sequence
  PCR primer for ORF amplification
tggaagtggttcaggaatgtcaaatattgtgggtattgaa

SEQ ID NO: 17318 - DNA, 40 bp, Artificial Sequence
  PCR primer for ORF amplification
tggaagtggttcaggaatgtctgaaccagctcaaaagaaa

SEQ ID NO: 17319 - DNA, 40 bp, Artificial Sequence
  PCR primer for ORF amplification
tggaagtggttcaggaatgtgtgcaaagaagctcaaatac

SEQ ID NO: 17320 - DNA, 40 bp, Artificial Sequence
  PCR primer for ORF amplification
tggaagtggttcaggaatgttgaggttatctttactgaga

SEQ ID NO: 17321 - DNA, 40 bp, Artificial Sequence
  PCR primer for ORF amplification
tggaagtggttcaggaatgaatgacaggctttcgttgaca

SEQ ID NO: 17322 - DNA, 40 bp, Artificial Sequence
  PCR primer for ORF amplification
tggaagtggttcaggaatggaggtacatgaagagcaggtc

SEQ ID NO: 17323 - DNA, 40 bp, Artificial Sequence
  PCR primer for ORF amplification
tggaagtggttcaggaatggccaggaaattgaagggtaag

SEQ ID NO: 17324 - DNA, 40 bp, Artificial Sequence
  PCR primer for ORF amplification
tggaagtggttcaggaatgggttcaataagtagatacctt

SEQ ID NO: 17325 - DNA, 40 bp, Artificial Sequence
  PCR primer for ORF amplification
tggaagtggttcaggaatgtcatggaatctactatttgtg

SEQ ID NO: 17326 - DNA, 40 bp, Artificial Sequence
  PCR primer for ORF amplification
tggaagtggttcaggaatgaaaatttccgcagctttaata

SEQ ID NO: 17327 - DNA, 40 bp, Artificial Sequence
  PCR primer for ORF amplification
tggaagtggttcaggaatgaacaggattaagaatacattt

SEQ ID NO: 17328 - DNA, 40 bp, Artificial Sequence
  PCR primer for ORF amplification
tggaagtggttcaggaatgaagaatgataataagttgcaa

SEQ ID NO: 17329 - DNA, 40 bp, Artificial Sequence
  PCR primer for ORF amplification
tggaagtggttcaggaatgagtcagtcttacgaagcagga

SEQ ID NO: 17330 - DNA, 40 bp, Artificial Sequence
  PCR primer for ORF amplification
tggaagtggttcaggaatgatggacaagcataagtatcgt

SEQ ID NO: 17331 - DNA, 40 bp, Artificial Sequence
  PCR primer for ORF amplification
tggaagtggttcaggaatgcattcaagaaagtcgaagagt

SEQ ID NO: 17332 - DNA, 40 bp, Artificial Sequence
  PCR primer for ORF amplification
tggaagtggttcaggaatgccgaccaagtcaacttttagt

SEQ ID NO: 17333 - DNA, 40 bp, Artificial Sequence
  PCR primer for ORF amplification
tggaagtggttcaggaatgtctgaattgaaaacaggtcat

SEQ ID NO: 17334 - DNA, 40 bp, Artificial Sequence
  PCR primer for ORF amplification
tggaagtggttcaggaatgttagcagaattgtctcataga

SEQ ID NO: 17335 - DNA, 40 bp, Artificial Sequence
  PCR primer for ORF amplification
tggaagtggttcaggaatgaaattatcaactgtcctatta

SEQ ID NO: 17336 - DNA, 40 bp, Artificial Sequence
  PCR primer for ORF amplification
tggaagtggttcaggaatgaatagcgtaaaaagagtaaag

SEQ ID NO: 17337 - DNA, 40 bp, Artificial Sequence
  PCR primer for ORF amplification
tggaagtggttcaggaatgaatgataaactccaagaagag

SEQ ID NO: 17338 - DNA, 40 bp, Artificial Sequence
  PCR primer for ORF amplification
tggaagtggttcaggaatgactttgagtaattgcgactct

SEQ ID NO: 17339 - DNA, 40 bp, Artificial Sequence
  PCR primer for ORF amplification
tggaagtggttcaggaatgattgcttcagaaatttttgaa

SEQ ID NO: 17340 - DNA, 40 bp, Artificial Sequence
  PCR primer for ORF amplification
tggaagtggttcaggaatgccatcaaatttgaatatagtg

SEQ ID NO: 17341 - DNA, 40 bp, Artificial Sequence
  PCR primer for ORF amplification
tggaagtggttcaggaatggataagaattcagttaacaaa

SEQ ID NO: 17342 - DNA, 40 bp, Artificial Sequence
  PCR primer for ORF amplification
tggaagtggttcaggaatggatgcaatatctgatccaacg

SEQ ID NO: 17343 - DNA, 40 bp, Artificial Sequence
  PCR primer for ORF amplification
tggaagtggttcaggaatggcaagatctttaagtcaatca

SEQ ID NO: 17344 - DNA, 40 bp, Artificial Sequence
  PCR primer for ORF amplification
tggaagtggttcaggaatgtcaaccacagcatccacgcct

SEQ ID NO: 17345 - DNA, 40 bp, Artificial Sequence
  PCR primer for ORF amplification
tggaagtggttcaggaatgtcaatacgtccagcaacacat

SEQ ID NO: 17346 - DNA, 40 bp, Artificial Sequence
  PCR primer for ORF amplification
tggaagtggttcaggaatgtctctacaacacgagaaagtt

SEQ ID NO: 17347 - DNA, 40 bp, Artificial Sequence
  PCR primer for ORF amplification
tggaagtggttcaggaatgcacagaacttactctttaaga

SEQ ID NO: 17348 - DNA, 40 bp, Artificial Sequence
  PCR primer for ORF amplification
tggaagtggttcaggaatgaatgaagatctattctacgat

SEQ ID NO: 17349 - DNA, 40 bp, Artificial Sequence
  PCR primer for ORF amplification
tggaagtggttcaggaatgacatcttggagggataaatcc

SEQ ID NO: 17350 - DNA, 40 bp, Artificial Sequence
  PCR primer for ORF amplification
tggaagtggttcaggaatgaggatggaaaaaacaacagac

SEQ ID NO: 17351 - DNA, 40 bp, Artificial Sequence
  PCR primer for ORF amplification
tggaagtggttcaggaatgccattacctccgtcaacattg

SEQ ID NO: 17352 - DNA, 40 bp, Artificial Sequence
  PCR primer for ORF amplification
tggaagtggttcaggaatggcgggaagtacatccagtttg

SEQ ID NO: 17353 - DNA, 40 bp, Artificial Sequence
  PCR primer for ORF amplification
tggaagtggttcaggaatgggaaccataacagtggtgatt

SEQ ID NO: 17354 - DNA, 40 bp, Artificial Sequence
  PCR primer for ORF amplification
tggaagtggttcaggaatgtcttcttcttcacagtatgta

SEQ ID NO: 17355 - DNA, 40 bp, Artificial Sequence
  PCR primer for ORF amplification
tggaagtggttcaggaatgtctacagacaagatcacattt

SEQ ID NO: 17356 - DNA, 40 bp, Artificial Sequence
  PCR primer for ORF amplification
tggaagtggttcaggaatgaaatatacgcaatacccgaac

SEQ ID NO: 17357 - DNA, 40 bp, Artificial Sequence
  PCR primer for ORF amplification
tggaagtggttcaggaatgaacataaaggatagaacttca

SEQ ID NO: 17358 - DNA, 40 bp, Artificial Sequence
  PCR primer for ORF amplification
tggaagtggttcaggaatgaccgcaccattggtagtattg

SEQ ID NO: 17359 - DNA, 40 bp, Artificial Sequence
  PCR primer for ORF amplification
tggaagtggttcaggaatgactgttagtaaaatacccata

SEQ ID NO: 17360 - DNA, 40 bp, Artificial Sequence
  PCR primer for ORF amplification
tggaagtggttcaggaatgatattaagtcagaggaggatg

SEQ ID NO: 17361 - DNA, 40 bp, Artificial Sequence
  PCR primer for ORF amplification
tggaagtggttcaggaatgattgatcgtaccgagttatcg

SEQ ID NO: 17362 - DNA, 40 bp, Artificial Sequence
  PCR primer for ORF amplification
tggaagtggttcaggaatggacgaaaacaaaataatcgac

SEQ ID NO: 17363 - DNA, 40 bp, Artificial Sequence
  PCR primer for ORF amplification
tggaagtggttcaggaatgtcgacaagtacagagaagagg

SEQ ID NO: 17364 - DNA, 40 bp, Artificial Sequence
  PCR primer for ORF amplification
tggaagtggttcaggaatggtcgctagaggtagaacagac

SEQ ID NO: 17365 - DNA, 40 bp, Artificial Sequence; identical to SEQ ID NO: 17347
  PCR primer for ORF amplification

SEQ ID NO: 17366 - DNA, 40 bp, Artificial Sequence
  PCR primer for ORF amplification
tggaagtggttcaggaatgaaaagaggagaaagccaggcg

SEQ ID NO: 17367 - DNA, 40 bp, Artificial Sequence
  PCR primer for ORF amplification
tggaagtggttcaggaatgagactgccagaaatctccatt

SEQ ID NO: 17368 - DNA, 40 bp, Artificial Sequence
  PCR primer for ORF amplification
tggaagtggttcaggaatgagtgacgtggtcagtaaagat

SEQ ID NO: 17369 - DNA, 40 bp, Artificial Sequence
  PCR primer for ORF amplification
tggaagtggttcaggaatgagtttagaggctacagattcc

SEQ ID NO: 17370 - DNA, 40 bp, Artificial Sequence
  PCR primer for ORF amplification
tggaagtggttcaggaatgcaatacaaaaaatcattagtt

SEQ ID NO: 17371 - DNA, 40 bp, Artificial Sequence
  PCR primer for ORF amplification
tggaagtggttcaggaatgcagatagtacaaattgagcag

SEQ ID NO: 17372 - DNA, 40 bp, Artificial Sequence
  PCR primer for ORF amplification
tggaagtggttcaggaatggcaggcccaaggaatgtgcgt

SEQ ID NO: 17373 - DNA, 40 bp, Artificial Sequence
  PCR primer for ORF amplification
tggaagtggttcaggaatggcagtaaaacataaatccgag

SEQ ID NO: 17374 - DNA, 40 bp, Artificial Sequence
  PCR primer for ORF amplification
tggaagtggttcaggaatgtcaaataataaggctggcggt

SEQ ID NO: 17375 - DNA, 40 bp, Artificial Sequence
  PCR primer for ORF amplification
tggaagtggttcaggaatgtctgaacaggagtctgatgaa

SEQ ID NO: 17376 - DNA, 40 bp, Artificial Sequence
  PCR primer for ORF amplification
tggaagtggttcaggaatgtctgttccaatccctggtatt

SEQ ID NO: 17377 - DNA, 40 bp, Artificial Sequence
  PCR primer for ORF amplification
tggaagtggttcaggaatgaaggtcgagaaatcatctaaa

SEQ ID NO: 17378 - DNA, 40 bp, Artificial Sequence
  PCR primer for ORF amplification
tggaagtggttcaggaatgaatgaaaacgagtacgataat

SEQ ID NO: 17379 - DNA, 40 bp, Artificial Sequence
  PCR primer for ORF amplification
tggaagtggttcaggaatgataaaacatatagtttcgcca

SEQ ID NO: 17380 - DNA, 40 bp, Artificial Sequence
  PCR primer for ORF amplification
tggaagtggttcaggaatgatgatactgggtaaagccggg

SEQ ID NO: 17381 - DNA, 40 bp, Artificial Sequence
  PCR primer for ORF amplification
tggaagtggttcaggaatgcaatatagttcgaggttccta

SEQ ID NO: 17382 - DNA, 40 bp, Artificial Sequence
  PCR primer for ORF amplification
tggaagtggttcaggaatgcatacagctgaatttttggaa

SEQ ID NO: 17383 - DNA, 40 bp, Artificial Sequence
  PCR primer for ORF amplification
tggaagtggttcaggaatgctacacttacaaccacaaaac

SEQ ID NO: 17384 - DNA, 40 bp, Artificial Sequence
  PCR primer for ORF amplification
tggaagtggttcaggaatggaagaaaataaacttagtgga

SEQ ID NO: 17385 - DNA, 40 bp, Artificial Sequence
  PCR primer for ORF amplification
tggaagtggttcaggaatggattctgagttgaaagggcag

SEQ ID NO: 17386 - DNA, 40 bp, Artificial Sequence
  PCR primer for ORF amplification
tggaagtggttcaggaatggttttagttaagcaggtaaga

SEQ ID NO: 17387 - DNA, 40 bp, Artificial Sequence
  PCR primer for ORF amplification
tggaagtggttcaggaatgtcaaatagtaacggtgataat

SEQ ID NO: 17388 - DNA, 40 bp, Artificial Sequence
  PCR primer for ORF amplification
tggaagtggttcaggaatgtcagttttcgtttcaggtgct

SEQ ID NO: 17389 - DNA, 40 bp, Artificial Sequence
  PCR primer for ORF amplification
tggaagtggttcaggaatgtccggattcgcaaaactcaag

SEQ ID NO: 17390 - DNA, 40 bp, Artificial Sequence
  PCR primer for ORF amplification
tggaagtggttcaggaatgtggaactcactaaaagcattc

SEQ ID NO: 17391 - DNA, 40 bp, Artificial Sequence
  PCR primer for ORF amplification
tggaagtggttcaggaatgtcttttctacaaaatttgtat

SEQ ID NO: 17392 - DNA, 40 bp, Artificial Sequence
  PCR primer for ORF amplification
tggaagtggttcaggaatgaaaatgcccagtattattcag

SEQ ID NO: 17393 - DNA, 40 bp, Artificial Sequence
  PCR primer for ORF amplification
tggaagtggttcaggaatgaagttttttagtttggcagat

SEQ ID NO: 17394 - DNA, 40 bp, Artificial Sequence
  PCR primer for ORF amplification
tggaagtggttcaggaatgagcgaagataaagctaaatta

SEQ ID NO: 17395 - DNA, 40 bp, Artificial Sequence
  PCR primer for ORF amplification
tggaagtggttcaggaatgagtaatgcaaacaatagtgct

SEQ ID NO: 17396 - DNA, 40 bp, Artificial Sequence
  PCR primer for ORF amplification
tggaagtggttcaggaatggtcaaagtcgcaattcttggc

SEQ ID NO: 17397 - DNA, 40 bp, Artificial Sequence
  PCR primer for ORF amplification
tggaagtggttcaggaatgtctgagccaaacacaccatta

SEQ ID NO: 17398 - DNA, 40 bp, Artificial Sequence
  PCR primer for ORF amplification
tggaagtggttcaggaatgaagataaaaattgacattata

SEQ ID NO: 17399 - DNA, 40 bp, Artificial Sequence
  PCR primer for ORF amplification
tggaagtggttcaggaatgacattggcagagttgcttgga

SEQ ID NO: 17400 - DNA, 40 bp, Artificial Sequence
  PCR primer for ORF amplification
tggaagtggttcaggaatgagtgcgggtatcggagaatca

SEQ ID NO: 17401 - DNA, 40 bp, Artificial Sequence
  PCR primer for ORF amplification
tggaagtggttcaggaatgatagtagattatgaaaaggac

SEQ ID NO: 17402 - DNA, 40 bp, Artificial Sequence
  PCR primer for ORF amplification
tggaagtggttcaggaatgattagaaccgtaaaacccaag

SEQ ID NO: 17403 - DNA, 40 bp, Artificial Sequence
  PCR primer for ORF amplification
tggaagtggttcaggaatgcattgcccaatttgccaccat

SEQ ID NO: 17404 - DNA, 40 bp, Artificial Sequence
  PCR primer for ORF amplification
tggaagtggttcaggaatggaaaaaaatacggcaccattt

SEQ ID NO: 17405 - DNA, 40 bp, Artificial Sequence
  PCR primer for ORF amplification
tggaagtggttcaggaatggccgatttcttattgagacca

SEQ ID NO: 17406 - DNA, 40 bp, Artificial Sequence
  PCR primer for ORF amplification
tggaagtggttcaggaatgtctaatacagttctagtttct

SEQ ID NO: 17407 - DNA, 40 bp, Artificial Sequence
  PCR primer for ORF amplification
tggaagtggttcaggaatgtctgattatgttgaactattg

SEQ ID NO: 17408 - DNA, 40 bp, Artificial Sequence
  PCR primer for ORF amplification
tggaagtggttcaggaatgtcttcttcagtagcctcaacc

SEQ ID NO: 17409 - DNA, 40 bp, Artificial Sequence
  PCR primer for ORF amplification
tggaagtggttcaggaatgtttaaatcattggctgctgtc

SEQ ID NO: 17410 - DNA, 40 bp, Artificial Sequence
  PCR primer for ORF amplification
tggaagtggttcaggaatgaacactaccacatctactgtt

SEQ ID NO: 17411 - DNA, 40 bp, Artificial Sequence
  PCR primer for ORF amplification
tggaagtggttcaggaatgaccatagataactacgacaac

SEQ ID NO: 17412 - DNA, 40 bp, Artificial Sequence
  PCR primer for ORF amplification
tggaagtggttcaggaatgagttacggcttaacaggtacc

SEQ ID NO: 17413 - DNA, 40 bp, Artificial Sequence
  PCR primer for ORF amplification
tggaagtggttcaggaatgatgactagggagagcatagat

SEQ ID NO: 17414 - DNA, 40 bp, Artificial Sequence
  PCR primer for ORF amplification
tggaagtggttcaggaatgccaccaaaaaagggaaaacag

SEQ ID NO: 17415 - DNA, 40 bp, Artificial Sequence
  PCR primer for ORF amplification
tggaagtggttcaggaatggaagcacataaccaatttttg

SEQ ID NO: 17416 - DNA, 40 bp, Artificial Sequence
  PCR primer for ORF amplification
tggaagtggttcaggaatggaaggcgtgtatttcaatatt

SEQ ID NO: 17417 - DNA, 40 bp, Artificial Sequence
  PCR primer for ORF amplification
tggaagtggttcaggaatggtgactggtgaagaaaatgtg

SEQ ID NO: 17418 - DNA, 40 bp, Artificial Sequence
  PCR primer for ORF amplification
tggaagtggttcaggaatgtacaactttttagaatttttc

SEQ ID NO: 17419 - DNA, 40 bp, Artificial Sequence
  PCR primer for ORF amplification
tggaagtggttcaggaatgtctactttacaacgtcgtaga

SEQ ID NO: 17420 - DNA, 40 bp, Artificial Sequence
  PCR primer for ORF amplification
tggaagtggttcaggaatgtctgtcgccgatttgaaaaac

SEQ ID NO: 17421 - DNA, 40 bp, Artificial Sequence
  PCR primer for ORF amplification
tggaagtggttcaggaatgttacgcaacatcatcaggttc

SEQ ID NO: 17422 - DNA, 40 bp, Artificial Sequence
  PCR primer for ORF amplification
tggaagtggttcaggaatgaacacagattcacacaacctt

SEQ ID NO: 17423 - DNA, 40 bp, Artificial Sequence
  PCR primer for ORF amplification
tggaagtggttcaggaatgaaggcgtcgcacatttgctct

SEQ ID NO: 17424 - DNA, 40 bp, Artificial Sequence
  PCR primer for ORF amplification
tggaagtggttcaggaatgacccttgatgatgacgactat

SEQ ID NO: 17425 - DNA, 40 bp, Artificial Sequence
  PCR primer for ORF amplification
tggaagtggttcaggaatgaccgaacctcaaggtcctttg

SEQ ID NO: 17426 - DNA, 40 bp, Artificial Sequence
  PCR primer for ORF amplification
tggaagtggttcaggaatgatgtctgatttaacaccaata

SEQ ID NO: 17427 - DNA, 40 bp, Artificial Sequence
  PCR primer for ORF amplification
tggaagtggttcaggaatgcagaagagcatattgctgact

SEQ ID NO: 17428 - DNA, 40 bp, Artificial Sequence
  PCR primer for ORF amplification
tggaagtggttcaggaatggaggacggtaaacaggccatc

SEQ ID NO: 17429 - DNA, 40 bp, Artificial Sequence
  PCR primer for ORF amplification
tggaagtggttcaggaatggatgaaatgcattcttcagac

SEQ ID NO: 17430 - DNA, 40 bp, Artificial Sequence
  PCR primer for ORF amplification
tggaagtggttcaggaatgtcagcatcaaaagaagaaatt

SEQ ID NO: 17431 - DNA, 40 bp, Artificial Sequence
  PCR primer for ORF amplification
tggaagtggttcaggaatgtcaggtgtaagctctgttatg

SEQ ID NO: 17432 - DNA, 40 bp, Artificial Sequence
  PCR primer for ORF amplification
tggaagtggttcaggaatggctagaggaccgtatgtttga

SEQ ID NO: 17433 - DNA, 40 bp, Artificial Sequence
  PCR primer for ORF amplification
tggaagtggttcaggaatgaacaggaaagtagctatcgta

SEQ ID NO: 17434 - DNA, 40 bp, Artificial Sequence
  PCR primer for ORF amplification
tggaagtggttcaggaatgaagatattctccacactctta

SEQ ID NO: 17435 - DNA, 40 bp, Artificial Sequence
  PCR primer for ORF amplification
tggaagtggttcaggaatgaaggctatcaaattaacaggt

SEQ ID NO: 17436 - DNA, 40 bp, Artificial Sequence
  PCR primer for ORF amplification
tggaagtggttcaggaatgaattcactcgttactcaatat

SEQ ID NO: 17437 - DNA, 40 bp, Artificial Sequence
  PCR primer for ORF amplification
tggaagtggttcaggaatgacaactttattacagctcttg

SEQ ID NO: 17438 - DNA, 40 bp, Artificial Sequence
  PCR primer for ORF amplification
tggaagtggttcaggaatgactactgataccactgttttc

SEQ ID NO: 17439 - DNA, 40 bp, Artificial Sequence
  PCR primer for ORF amplification
tggaagtggttcaggaatgacttttatgcaacagcttcaa

SEQ ID NO: 17440 - DNA, 40 bp, Artificial Sequence
  PCR primer for ORF amplification
tggaagtggttcaggaatgcccttcgctcagattgttatt

SEQ ID NO: 17441 - DNA, 40 bp, Artificial Sequence
  PCR primer for ORF amplification
tggaagtggttcaggaatggatatgaaagtagaaaaatta

SEQ ID NO: 17442 - DNA, 40 bp, Artificial Sequence
  PCR primer for ORF amplification
tggaagtggttcaggaatggttcaatatgtggtagaatgg

SEQ ID NO: 17443 - DNA, 40 bp, Artificial Sequence
  PCR primer for ORF amplification
tggaagtggttcaggaatggtttctgtggagtttttacag

SEQ ID NO: 17444 - DNA, 40 bp, Artificial Sequence
  PCR primer for ORF amplification
tggaagtggttcaggaatgtctcaaccagtcgttgttatt

SEQ ID NO: 17445 - DNA, 40 bp, Artificial Sequence
  PCR primer for ORF amplification
tggaagtggttcaggaatgactactgaaaaaaccgttgtt

SEQ ID NO: 17446 - DNA, 40 bp, Artificial Sequence
  PCR primer for ORF amplification
tggaagtggttcaggaatgagcaagacagccgtgaaagat

SEQ ID NO: 17447 - DNA, 40 bp, Artificial Sequence
  PCR primer for ORF amplification
tggaagtggttcaggaatgccaactctagtaaatggacca

SEQ ID NO: 17448 - DNA, 40 bp, Artificial Sequence
  PCR primer for ORF amplification
tggaagtggttcaggaatggcaaggcaagggaacttctac

SEQ ID NO: 17449 - DNA, 40 bp, Artificial Sequence
  PCR primer for ORF amplification
tggaagtggttcaggaatgtcacaatacaaaactggttta

SEQ ID NO: 17450 - DNA, 40 bp, Artificial Sequence
  PCR primer for ORF amplification
tggaagtggttcaggaatgtctatcccagaaactcaaaaa

SEQ ID NO: 17451 - DNA, 40 bp, Artificial Sequence
  PCR primer for ORF amplification
tggaagtggttcaggaatgtctattccagaaactcaaaaa

SEQ ID NO: 17452 - DNA, 40 bp, Artificial Sequence
  PCR primer for ORF amplification
tggaagtggttcaggaatgaacgtaacatcgaatgcaact

SEQ ID NO: 17453 - DNA, 40 bp, Artificial Sequence
  PCR primer for ORF amplification
tggaagtggttcaggaatgagtgcttccaaaatggccatg

SEQ ID NO: 17454 - DNA, 40 bp, Artificial Sequence
  PCR primer for ORF amplification
tggaagtggttcaggaatgcaaccatttgatagtgggcat

SEQ ID NO: 17455 - DNA, 40 bp, Artificial Sequence
  PCR primer for ORF amplification
tggaagtggttcaggaatgcccaagttggaacaatttgaa

SEQ ID NO: 17456 - DNA, 40 bp, Artificial Sequence
  PCR primer for ORF amplification
tggaagtggttcaggaatgtcaaagatagattcagtttta

SEQ ID NO: 17457 - DNA, 40 bp, Artificial Sequence
  PCR primer for ORF amplification
tggaagtggttcaggaatgtccccattgaacgtcggtata

SEQ ID NO: 17458 - DNA, 40 bp, Artificial Sequence
  PCR primer for ORF amplification
tggaagtggttcaggaatgtcgcagtacatcggtaaaact

SEQ ID NO: 17459 - DNA, 40 bp, Artificial Sequence
  PCR primer for ORF amplification
tggaagtggttcaggaatgaatatagactgtttgtgtcgt

SEQ ID NO: 17460 - DNA, 40 bp, Artificial Sequence
  PCR primer for ORF amplification
tggaagtggttcaggaatgaattggctgtttttggtctcg

SEQ ID NO: 17461 - DNA, 40 bp, Artificial Sequence
  PCR primer for ORF amplification
tggaagtggttcaggaatgaccgtttccaacattgggggg

SEQ ID NO: 17462 - DNA, 40 bp, Artificial Sequence
  PCR primer for ORF amplification
tggaagtggttcaggaatgagtaagaaaccaattgttttg

SEQ ID NO: 17463 - DNA, 40 bp, Artificial Sequence
  PCR primer for ORF amplification
tggaagtggttcaggaatggatcaaaaggcgtcatatttt

SEQ ID NO: 17464 - DNA, 40 bp, Artificial Sequence
  PCR primer for ORF amplification
tggaagtggttcaggaatgggtcttttttcaagaaaacgg

SEQ ID NO: 17465 - DNA, 40 bp, Artificial Sequence
  PCR primer for ORF amplification
tggaagtggttcaggaatggtcgtgaataacccaaataac

SEQ ID NO: 17466 - DNA, 40 bp, Artificial Sequence
  PCR primer for ORF amplification
tggaagtggttcaggaatgtctcaactgccaacagatttt

SEQ ID NO: 17467 - DNA, 40 bp, Artificial Sequence
  PCR primer for ORF amplification
tggaagtggttcaggaatggctagaggaccgtatgttgat

SEQ ID NO: 17468 - DNA, 40 bp, Artificial Sequence
  PCR primer for ORF amplification
tggaagtggttcaggaatgaactctctggcaaataataat

SEQ ID NO: 17469 - DNA, 40 bp, Artificial Sequence
  PCR primer for ORF amplification
tggaagtggttcaggaatgaagcaggagccacatagacaa

SEQ ID NO: 17470 - DNA, 40 bp, Artificial Sequence
  PCR primer for ORF amplification
tggaagtggttcaggaatgacacctacaaaccaatctagt

SEQ ID NO: 17471 - DNA, 40 bp, Artificial Sequence
  PCR primer for ORF amplification
tggaagtggttcaggaatgagtgttgatttgtttccaaat

SEQ ID NO: 17472 - DNA, 40 bp, Artificial Sequence
  PCR primer for ORF amplification
tggaagtggttcaggaatgcagaggtttgtcagtaagttt

SEQ ID NO: 17473 - DNA, 40 bp, Artificial Sequence
  PCR primer for ORF amplification
tggaagtggttcaggaatgccttcgcaagtcattcctgaa

SEQ ID NO: 17474 - DNA, 40 bp, Artificial Sequence
  PCR primer for ORF amplification
tggaagtggttcaggaatgttcaagagatttagcaaaaag

SEQ ID NO: 17475 - DNA, 40 bp, Artificial Sequence
  PCR primer for ORF amplification
tggaagtggttcaggaatgagtaaggataataggttagca

SEQ ID NO: 17476 - DNA, 40 bp, Artificial Sequence
  PCR primer for ORF amplification
tggaagtggttcaggaatgattggcaaacggtttttccaa

SEQ ID NO: 17477 - DNA, 40 bp, Artificial Sequence
  PCR primer for ORF amplification
tggaagtggttcaggaatggaatcaagtttacaaaaattg

SEQ ID NO: 17478 - DNA, 40 bp, Artificial Sequence
  PCR primer for ORF amplification
tggaagtggttcaggaatggcttcagaaaaagaaattagg

SEQ ID NO: 17479 - DNA, 40 bp, Artificial Sequence
  PCR primer for ORF amplification
tggaagtggttcaggaatggtcaaggagacaaaactttat

SEQ ID NO: 17480 - DNA, 40 bp, Artificial Sequence
  PCR primer for ORF amplification
tggaagtggttcaggaatgtcagattggaaagtggaccca

SEQ ID NO: 17481 - DNA, 40 bp, Artificial Sequence
  PCR primer for ORF amplification
tggaagtggttcaggaatgacgctgcaaagaattagtaaa

SEQ ID NO: 17482 - DNA, 40 bp, Artificial Sequence
  PCR primer for ORF amplification
tggaagtggttcaggaatgactacaaataatgacttctat

SEQ ID NO: 17483 - DNA, 40 bp, Artificial Sequence
  PCR primer for ORF amplification
tggaagtggttcaggaatgattcaatttaaaagtccaggt

SEQ ID NO: 17484 - DNA, 40 bp, Artificial Sequence
  PCR primer for ORF amplification
tggaagtggttcaggaatgccaaagagaattgtatacaat

SEQ ID NO: 17485 - DNA, 40 bp, Artificial Sequence
  PCR primer for ORF amplification
tggaagtggttcaggaatggaaagcagaaataccgtgctt

SEQ ID NO: 17486 - DNA, 40 bp, Artificial Sequence
  PCR primer for ORF amplification
tggaagtggttcaggaatgggttcccaagatttagctagt

SEQ ID NO: 17487 - DNA, 40 bp, Artificial Sequence
  PCR primer for ORF amplification
tggaagtggttcaggaatggtcgatacgcataaactagca

SEQ ID NO: 17488 - DNA, 40 bp, Artificial Sequence
  PCR primer for ORF amplification
tggaagtggttcaggaatgtcattaccacaatggtgtcca

SEQ ID NO: 17489 - DNA, 40 bp, Artificial Sequence
  PCR primer for ORF amplification
tggaagtggttcaggaatgtccaagttagaaaccgtttac

SEQ ID NO: 17490 - DNA, 40 bp, Artificial Sequence
  PCR primer for ORF amplification
tggaagtggttcaggaatgtcgacagcacagaaagctaag

SEQ ID NO: 17491 - DNA, 40 bp, Artificial Sequence
  PCR primer for ORF amplification
tggaagtggttcaggaatgtttgaagggtttggtccaaat

SEQ ID NO: 17492 - DNA, 40 bp, Artificial Sequence
  PCR primer for ORF amplification
tggaagtggttcaggaatgaaggtatgtaatatcacccaa

SEQ ID NO: 17493 - DNA, 40 bp, Artificial Sequence
  PCR primer for ORF amplification
tggaagtggttcaggaatgaagttccaagttgttttatct

SEQ ID NO: 17494 - DNA, 40 bp, Artificial Sequence
  PCR primer for ORF amplification
tggaagtggttcaggaatgatgaataacaacggcaaccaa

SEQ ID NO: 17495 - DNA, 40 bp, Artificial Sequence
  PCR primer for ORF amplification
tggaagtggttcaggaatggactatggctacttttttccc

SEQ ID NO: 17496 - DNA, 40 bp, Artificial Sequence
  PCR primer for ORF amplification
tggaagtggttcaggaatggatttaaccgtggaacctaat

SEQ ID NO: 17497 - DNA, 40 bp, Artificial Sequence
  PCR primer for ORF amplification
tggaagtggttcaggaatggggtttctttcggatcatccg

SEQ ID NO: 17498 - DNA, 40 bp, Artificial Sequence
  PCR primer for ORF amplification
tggaagtggttcaggaatggtacccgctgctgaaaaccta

SEQ ID NO: 17499 - DNA, 40 bp, Artificial Sequence
  PCR primer for ORF amplification
tggaagtggttcaggaatggtaccgaaccttcgttttaat

SEQ ID NO: 17500 - DNA, 40 bp, Artificial Sequence
  PCR primer for ORF amplification
tggaagtggttcaggaatgtcattgtgggtagataaatac

SEQ ID NO: 17501 - DNA, 40 bp, Artificial Sequence
  PCR primer for ORF amplification
tggaagtggttcaggaatgaatactgtaccatttacatct

SEQ ID NO: 17502 - DNA, 40 bp, Artificial Sequence
  PCR primer for ORF amplification
tggaagtggttcaggaatgactgccagcacatcagttgcg

SEQ ID NO: 17503 - DNA, 40 bp, Artificial Sequence
  PCR primer for ORF amplification
tggaagtggttcaggaatggatacggtaaacaattatagg

SEQ ID NO: 17504 - DNA, 40 bp, Artificial Sequence
  PCR primer for ORF amplification
tggaagtggttcaggaatggtactttgcaaattactgaca

SEQ ID NO: 17505 - DNA, 40 bp, Artificial Sequence
  PCR primer for ORF amplification
tggaagtggttcaggaatgtctactggaagcagtgataga

SEQ ID NO: 17506 - DNA, 40 bp, Artificial Sequence
  PCR primer for ORF amplification
tggaagtggttcaggaatgactgacttaactacacaagaa

SEQ ID NO: 17507 - DNA, 40 bp, Artificial Sequence
  PCR primer for ORF amplification
tggaagtggttcaggaatggtatgtgcacttcaaatgttc

SEQ ID NO: 17508 - DNA, 40 bp, Artificial Sequence
  PCR primer for ORF amplification
tggaagtggttcaggaatggttacagtatgttgttgcttt

SEQ ID NO: 17509 - DNA, 40 bp, Artificial Sequence
  PCR primer for ORF amplification
tggaagtggttcaggaatgtcagtatcttacaagggaaca

SEQ ID NO: 17510 - DNA, 40 bp, Artificial Sequence
  PCR primer for ORF amplification
tggaagtggttcaggaatgtccaaaagaaacactccaccg

SEQ ID NO: 17511 - DNA, 40 bp, Artificial Sequence
  PCR primer for ORF amplification
tggaagtggttcaggaatgtctagaatactagttatcggg

SEQ ID NO: 17512 - DNA, 40 bp, Artificial Sequence
  PCR primer for ORF amplification
tggaagtggttcaggaatgttaaaagttcctttgagtgat

SEQ ID NO: 17513 - DNA, 40 bp, Artificial Sequence
  PCR primer for ORF amplification
tggaagtggttcaggaatgtctcaaaatagtaaccctgca

SEQ ID NO: 17514 - DNA, 40 bp, Artificial Sequence
  PCR primer for ORF amplification
tggaagtggttcaggaatgacgcgagatagcccagattct

SEQ ID NO: 17515 - DNA, 40 bp, Artificial Sequence
  PCR primer for ORF amplification
tggaagtggttcaggaatgagcccaagtccatcagtgtcg

SEQ ID NO: 17516 - DNA, 40 bp, Artificial Sequence
  PCR primer for ORF amplification
tggaagtggttcaggaatgaggttagctgtggttgtgacc

SEQ ID NO: 17517 - DNA, 40 bp, Artificial Sequence
  PCR primer for ORF amplification
tggaagtggttcaggaatggaaaagaaggtaatatgtcaa

SEQ ID NO: 17518 - DNA, 40 bp, Artificial Sequence
  PCR primer for ORF amplification
tggaagtggttcaggaatggcattggaaagagaattattg

SEQ ID NO: 17519 - DNA, 40 bp, Artificial Sequence
  PCR primer for ORF amplification
tggaagtggttcaggaatgggcgatcataatctgccggat

SEQ ID NO: 17520 - DNA, 40 bp, Artificial Sequence
  PCR primer for ORF amplification
tggaagtggttcaggaatggttcgtgccttcaaaattaaa

SEQ ID NO: 17521 - DNA, 40 bp, Artificial Sequence
  PCR primer for ORF amplification
tggaagtggttcaggaatgtctgaacttaatgcattatta

SEQ ID NO: 17522 - DNA, 40 bp, Artificial Sequence
  PCR primer for ORF amplification
tggaagtggttcaggaatgtctgtttctaccgcctctaca

SEQ ID NO: 17523 - DNA, 40 bp, Artificial Sequence
  PCR primer for ORF amplification
tggaagtggttcaggaatgtgcagattcttgattttcaaa

SEQ ID NO: 17524 - DNA, 40 bp, Artificial Sequence
  PCR primer for ORF amplification
tggaagtggttcaggaatgtatgtgatgcagtgaataatg

SEQ ID NO: 17525 - DNA, 40 bp, Artificial Sequence
  PCR primer for ORF amplification
tggaagtggttcaggaatgagtagtgttggcgattttgaa

SEQ ID NO: 17526 - DNA, 40 bp, Artificial Sequence
  PCR primer for ORF amplification
tggaagtggttcaggaatggatgcaacatcgaggatggag

SEQ ID NO: 17527 - DNA, 40 bp, Artificial Sequence
  PCR primer for ORF amplification
tggaagtggttcaggaatgttgccagaaaagagactattg

SEQ ID NO: 17528 - DNA, 40 bp, Artificial Sequence
  PCR primer for ORF amplification
tggaagtggttcaggaatgagcactaaagttgttaatgtt

SEQ ID NO: 17529 - DNA, 40 bp, Artificial Sequence
  PCR primer for ORF amplification
tggaagtggttcaggaatggccttggtctctagaaggtcg

SEQ ID NO: 17530 - DNA, 40 bp, Artificial Sequence
  PCR primer for ORF amplification
tggaagtggttcaggaatgggtgttgaacaaatcttaaag

SEQ ID NO: 17531 - DNA, 40 bp, Artificial Sequence
  PCR primer for ORF amplification
tggaagtggttcaggaatgtccgaagttatcacaattacc

SEQ ID NO: 17532 - DNA, 40 bp, Artificial Sequence
  PCR primer for ORF amplification
tggaagtggttcaggaatgtcgtttactgctccttcagat

SEQ ID NO: 17533 - DNA, 40 bp, Artificial Sequence
  PCR primer for ORF amplification
tggaagtggttcaggaatgtggtgcatgagaagattgcca

SEQ ID NO: 17534 - DNA, 40 bp, Artificial Sequence
  PCR primer for ORF amplification
tggaagtggttcaggaatgaagctactaaccttcccaggt

SEQ ID NO: 17535 - DNA, 40 bp, Artificial Sequence
  PCR primer for ORF amplification
tggaagtggttcaggaatgcaagcggatatgcatggaaaa

SEQ ID NO: 17536 - DNA, 40 bp, Artificial Sequence
  PCR primer for ORF amplification
tggaagtggttcaggaatgcttaacagaacaattgctaag

SEQ ID NO: 17537 - DNA, 40 bp, Artificial Sequence
  PCR primer for ORF amplification
tggaagtggttcaggaatggatttaagtttcacgactaaa

SEQ ID NO: 17538 - DNA, 40 bp, Artificial Sequence
  PCR primer for ORF amplification
tggaagtggttcaggaatgtcctcacaagaatatacaact

SEQ ID NO: 17539 - DNA, 40 bp, Artificial Sequence
  PCR primer for ORF amplification
tggaagtggttcaggaatgtcgacattgttatctgaggta

SEQ ID NO: 17540 - DNA, 40 bp, Artificial Sequence
  PCR primer for ORF amplification
tggaagtggttcaggaatgtcgagctcctccaaggcttct

SEQ ID NO: 17541 - DNA, 40 bp, Artificial Sequence
  PCR primer for ORF amplification
tggaagtggttcaggaatgtcgatagtctacaataaaaca

SEQ ID NO: 17542 - DNA, 40 bp, Artificial Sequence
  PCR primer for ORF amplification
tggaagtggttcaggaatgtcttatcctgagaaatttgaa

SEQ ID NO: 17543 - DNA, 40 bp, Artificial Sequence
  PCR primer for ORF amplification
tggaagtggttcaggaatgaaaggtttaattttagtcggt

SEQ ID NO: 17544 - DNA, 40 bp, Artificial Sequence
  PCR primer for ORF amplification
tggaagtggttcaggaatgactactgctgttaggctttta

SEQ ID NO: 17545 - DNA, 40 bp, Artificial Sequence
  PCR primer for ORF amplification
tggaagtggttcaggaatgagcactcccaggaaggccgcc

SEQ ID NO: 17546 - DNA, 40 bp, Artificial Sequence
  PCR primer for ORF amplification
tggaagtggttcaggaatgatttctgctaattcattactt

SEQ ID NO: 17547 - DNA, 40 bp, Artificial Sequence
  PCR primer for ORF amplification
tggaagtggttcaggaatgcgctcctccatgtttagatgt

SEQ ID NO: 17548 - DNA, 40 bp, Artificial Sequence
  PCR primer for ORF amplification
tggaagtggttcaggaatgctttacccagaaaaatttcag

SEQ ID NO: 17549 - DNA, 40 bp, Artificial Sequence
  PCR primer for ORF amplification
tggaagtggttcaggaatgttttctggctttagttctttt

SEQ ID NO: 17550 - DNA, 40 bp, Artificial Sequence
  PCR primer for ORF amplification
tggaagtggttcaggaatgagatctttaaataccctttta

SEQ ID NO: 17551 - DNA, 40 bp, Artificial Sequence
  PCR primer for ORF amplification
tggaagtggttcaggaatgtcccgtccacaagttactgtt

SEQ ID NO: 17552 - DNA, 40 bp, Artificial Sequence; identical to SEQ ID NO: 17551
  PCR primer for ORF amplification

SEQ ID NO: 17553 - DNA, 40 bp, Artificial Sequence
  PCR primer for ORF amplification
tggaagtggttcaggaatgatcaataatcctaaggtagac

SEQ ID NO: 17554 - DNA, 40 bp, Artificial Sequence
  PCR primer for ORF amplification
tggaagtggttcaggaatgctggttccacctgctaacttt

SEQ ID NO: 17555 - DNA, 40 bp, Artificial Sequence
  PCR primer for ORF amplification
tggaagtggttcaggaatggagaaaagcgaaagtaattct

SEQ ID NO: 17556 - DNA, 40 bp, Artificial Sequence
  PCR primer for ORF amplification
tggaagtggttcaggaatgggtaactttccagctccaaaa

SEQ ID NO: 17557 - DNA, 40 bp, Artificial Sequence
  PCR primer for ORF amplification
tggaagtggttcaggaatgtctcgcaaatttgatttaaaa

SEQ ID NO: 17558 - DNA, 40 bp, Artificial Sequence
  PCR primer for ORF amplification
tggaagtggttcaggaatgaacggatctcccactcctaag

SEQ ID NO: 17559 - DNA, 40 bp, Artificial Sequence
  PCR primer for ORF amplification
tggaagtggttcaggaatgatgaatgaagaggattctaca

SEQ ID NO: 17560 - DNA, 40 bp, Artificial Sequence
  PCR primer for ORF amplification
tggaagtggttcaggaatgattgggtccgcgtccgactca

SEQ ID NO: 17561 - DNA, 40 bp, Artificial Sequence
  PCR primer for ORF amplification
tggaagtggttcaggaatgctagataacatgcaatttcat

SEQ ID NO: 17562 - DNA, 40 bp, Artificial Sequence
  PCR primer for ORF amplification
tggaagtggttcaggaatggagcaccaacaattgcggaag

SEQ ID NO: 17563 - DNA, 40 bp, Artificial Sequence
  PCR primer for ORF amplification
tggaagtggttcaggaatgggaatgaagtacgtattgcct

SEQ ID NO: 17564 - DNA, 40 bp, Artificial Sequence
  PCR primer for ORF amplification
tggaagtggttcaggaatgggagaggtatacgaaaaaaat

SEQ ID NO: 17565 - DNA, 40 bp, Artificial Sequence
  PCR primer for ORF amplification
tggaagtggttcaggaatggtatacacaacaccgcaacaa

SEQ ID NO: 17566 - DNA, 40 bp, Artificial Sequence
  PCR primer for ORF amplification
tggaagtggttcaggaatgtctccgaagaatataacaagg

SEQ ID NO: 17567 - DNA, 40 bp, Artificial Sequence
  PCR primer for ORF amplification
tggaagtggttcaggaatgtttactcgaaggtttattcca

SEQ ID NO: 17568 - DNA, 40 bp, Artificial Sequence
  PCR primer for ORF amplification
tggaagtggttcaggaatggttaagaaagttaataatccg

SEQ ID NO: 17569 - DNA, 40 bp, Artificial Sequence
  PCR primer for ORF amplification
tggaagtggttcaggaatgaatgatgaaattaatgagcca

SEQ ID NO: 17570 - DNA, 40 bp, Artificial Sequence
  PCR primer for ORF amplification
tggaagtggttcaggaatgatttctattgtattggaattg

SEQ ID NO: 17571 - DNA, 40 bp, Artificial Sequence
  PCR primer for ORF amplification
tggaagtggttcaggaatgcaaactgtgttgaaatatttg

SEQ ID NO: 17572 - DNA, 40 bp, Artificial Sequence
  PCR primer for ORF amplification
tggaagtggttcaggaatgccaagtacgtcgttaatcttc

SEQ ID NO: 17573 - DNA, 40 bp, Artificial Sequence
  PCR primer for ORF amplification
tggaagtggttcaggaatggctggaaatgcaaactcagta

SEQ ID NO: 17574 - DNA, 40 bp, Artificial Sequence
  PCR primer for ORF amplification
tggaagtggttcaggaatggtacaagaaatcgatttaggt

SEQ ID NO: 17575 - DNA, 40 bp, Artificial Sequence
  PCR primer for ORF amplification
tggaagtggttcaggaatgtctgcccctaagaagatcgtc

SEQ ID NO: 17576 - DNA, 40 bp, Artificial Sequence
  PCR primer for ORF amplification
tggaagtggttcaggaatgtctgttacaggaactgagatc

SEQ ID NO: 17577 - DNA, 40 bp, Artificial Sequence
  PCR primer for ORF amplification
tggaagtggttcaggaatgaaattatccgctctattagct

SEQ ID NO: 17578 - DNA, 40 bp, Artificial Sequence
  PCR primer for ORF amplification
tggaagtggttcaggaatgagtgatcttgacgaagaaagt

SEQ ID NO: 17579 - DNA, 40 bp, Artificial Sequence
  PCR primer for ORF amplification
tggaagtggttcaggaatgccacctctacccgtgctcaac

SEQ ID NO: 17580 - DNA, 40 bp, Artificial Sequence
  PCR primer for ORF amplification
tggaagtggttcaggaatggatttggtcttagaagtcgct

SEQ ID NO: 17581 - DNA, 40 bp, Artificial Sequence
  PCR primer for ORF amplification
tggaagtggttcaggaatggctcaaaattttggaaagatt

SEQ ID NO: 17582 - DNA, 40 bp, Artificial Sequence
  PCR primer for ORF amplification
tggaagtggttcaggaatggctggaaagaaaattgctggt

SEQ ID NO: 17583 - DNA, 40 bp, Artificial Sequence
  PCR primer for ORF amplification
tggaagtggttcaggaatgggaaagaaaaatagaaaggga

SEQ ID NO: 17584 - DNA, 40 bp, Artificial Sequence
  PCR primer for ORF amplification
tggaagtggttcaggaatggtattggctaaacaatgggtt

SEQ ID NO: 17585 - DNA, 40 bp, Artificial Sequence
  PCR primer for ORF amplification
tggaagtggttcaggaatgtcagacgagattgtaaccaac

SEQ ID NO: 17586 - DNA, 40 bp, Artificial Sequence
  PCR primer for ORF amplification
tggaagtggttcaggaatgtctttttttaatcgatcaaat

SEQ ID NO: 17587 - DNA, 40 bp, Artificial Sequence
  PCR primer for ORF amplification
tggaagtggttcaggaatgttgcttatgagacgctttgcc

SEQ ID NO: 17588 - DNA, 40 bp, Artificial Sequence
  PCR primer for ORF amplification
tggaagtggttcaggaatgaattacatggcttatgattat

SEQ ID NO: 17589 - DNA, 40 bp, Artificial Sequence
  PCR primer for ORF amplification
tggaagtggttcaggaatgacgtggatactaagtactggt

SEQ ID NO: 17590 - DNA, 40 bp, Artificial Sequence
  PCR primer for ORF amplification
tggaagtggttcaggaatgactgctgaagaatttgatttt

SEQ ID NO: 17591 - DNA, 40 bp, Artificial Sequence
  PCR primer for ORF amplification
tggaagtggttcaggaatgagtgatcgcaatacaagtaac

SEQ ID NO: 17592 - DNA, 40 bp, Artificial Sequence
  PCR primer for ORF amplification
tggaagtggttcaggaatgcaatcgagcttacctcaattt

SEQ ID NO: 17593 - DNA, 40 bp, Artificial Sequence
  PCR primer for ORF amplification
tggaagtggttcaggaatgctgtggaaaaattatgttcta

SEQ ID NO: 17594 - DNA, 40 bp, Artificial Sequence
  PCR primer for ORF amplification
tggaagtggttcaggaatggcggtgttgtgtggtgtatgc

SEQ ID NO: 17595 - DNA, 40 bp, Artificial Sequence
  PCR primer for ORF amplification
tggaagtggttcaggaatggcgtcagtaacagaacaattc

SEQ ID NO: 17596 - DNA, 40 bp, Artificial Sequence
  PCR primer for ORF amplification
tggaagtggttcaggaatgtaccatgttcctgaaatgagg

SEQ ID NO: 17597 - DNA, 40 bp, Artificial Sequence
  PCR primer for ORF amplification
tggaagtggttcaggaatgtctgaaaaatcagctagcaat

SEQ ID NO: 17598 - DNA, 40 bp, Artificial Sequence
  PCR primer for ORF amplification
tggaagtggttcaggaatgttttccagactgccaacatca

SEQ ID NO: 17599 - DNA, 40 bp, Artificial Sequence
  PCR primer for ORF amplification
tggaagtggttcaggaatgatattaatattattaataata

SEQ ID NO: 17600 - DNA, 40 bp, Artificial Sequence
  PCR primer for ORF amplification
tggaagtggttcaggaatgcaacgcaatagtttagtaaat

SEQ ID NO: 17601 - DNA, 40 bp, Artificial Sequence
  PCR primer for ORF amplification
tggaagtggttcaggaatgcacacaatgcatattccatcc

SEQ ID NO: 17602 - DNA, 40 bp, Artificial Sequence
  PCR primer for ORF amplification
tggaagtggttcaggaatgcacataaatgtgagaggaact

SEQ ID NO: 17603 - DNA, 40 bp, Artificial Sequence
  PCR primer for ORF amplification
tggaagtggttcaggaatgccgcgaattactcaagagata

SEQ ID NO: 17604 - DNA, 40 bp, Artificial Sequence
  PCR primer for ORF amplification
tggaagtggttcaggaatgccttcgacacctagctttgtt

SEQ ID NO: 17605 - DNA, 40 bp, Artificial Sequence
  PCR primer for ORF amplification
tggaagtggttcaggaatggcattcaagttatggctactg

SEQ ID NO: 17606 - DNA, 40 bp, Artificial Sequence
  PCR primer for ORF amplification
tggaagtggttcaggaatgtcaatatcatcaaagataaga

SEQ ID NO: 17607 - DNA, 40 bp, Artificial Sequence
  PCR primer for ORF amplification
tggaagtggttcaggaatgtcatcttccgcccccaaatac

SEQ ID NO: 17608 - DNA, 40 bp, Artificial Sequence
  PCR primer for ORF amplification
tggaagtggttcaggaatgttacgaagatctattcatacc

SEQ ID NO: 17609 - DNA, 40 bp, Artificial Sequence
  PCR primer for ORF amplification
tggaagtggttcaggaatgaaggtatgatttatgatacta

SEQ ID NO: 17610 - DNA, 40 bp, Artificial Sequence
  PCR primer for ORF amplification
tggaagtggttcaggaatgaaactggatagtatagacatt

SEQ ID NO: 17611 - DNA, 40 bp, Artificial Sequence
  PCR primer for ORF amplification
tggaagtggttcaggaatgaaagccggaattgagcttata

SEQ ID NO: 17612 - DNA, 40 bp, Artificial Sequence
  PCR primer for ORF amplification
tggaagtggttcaggaatgaactcatggaacctgagttct

SEQ ID NO: 17613 - DNA, 40 bp, Artificial Sequence
  PCR primer for ORF amplification
tggaagtggttcaggaatgaaggctgtcgtcattgaagac

SEQ ID NO: 17614 - DNA, 40 bp, Artificial Sequence
  PCR primer for ORF amplification
tggaagtggttcaggaatgaatcctaaatcctctacacct

SEQ ID NO: 17615 - DNA, 40 bp, Artificial Sequence
  PCR primer for ORF amplification
tggaagtggttcaggaatgccaggccagataatcagcatt

SEQ ID NO: 17616 - DNA, 40 bp, Artificial Sequence
  PCR primer for ORF amplification
tggaagtggttcaggaatggaattggacgaatgtttagaa

SEQ ID NO: 17617 - DNA, 40 bp, Artificial Sequence
  PCR primer for ORF amplification
tggaagtggttcaggaatggcaagagcgttgagggatata

SEQ ID NO: 17618 - DNA, 40 bp, Artificial Sequence
  PCR primer for ORF amplification
tggaagtggttcaggaatggctagaaccataacttttgat

SEQ ID NO: 17619 - DNA, 40 bp, Artificial Sequence
  PCR primer for ORF amplification
tggaagtggttcaggaatgggtattatcgacaaaatcaaa

SEQ ID NO: 17620 - DNA, 40 bp, Artificial Sequence
  PCR primer for ORF amplification
tggaagtggttcaggaatgtgtggtaggtttgccttagct

SEQ ID NO: 17621 - DNA, 40 bp, Artificial Sequence
  PCR primer for ORF amplification
tggaagtggttcaggaatgttgtcagcagctagattgcaa

SEQ ID NO: 17622 - DNA, 40 bp, Artificial Sequence
  PCR primer for ORF amplification
tggaagtggttcaggaatgaatcagagcgatagcagcttg

SEQ ID NO: 17623 - DNA, 40 bp, Artificial Sequence
  PCR primer for ORF amplification
tggaagtggttcaggaatggatacagatttagatgtgcct

SEQ ID NO: 17624 - DNA, 40 bp, Artificial Sequence
  PCR primer for ORF amplification
tggaagtggttcaggaatggattttacgtctgatacgacg

SEQ ID NO: 17625 - DNA, 40 bp, Artificial Sequence
  PCR primer for ORF amplification
tggaagtggttcaggaatggttgtattcgaaataactata

SEQ ID NO: 17626 - DNA, 40 bp, Artificial Sequence
  PCR primer for ORF amplification
tggaagtggttcaggaatgtatacaaaactaagatctata

SEQ ID NO: 17627 - DNA, 40 bp, Artificial Sequence
  PCR primer for ORF amplification
tggaagtggttcaggaatgtctactacagttgaaaaaatc

SEQ ID NO: 17628 - DNA, 40 bp, Artificial Sequence
  PCR primer for ORF amplification
tggaagtggttcaggaatgttattccctaaacgtctgatt

SEQ ID NO: 17629 - DNA, 40 bp, Artificial Sequence
  PCR primer for ORF amplification
tggaagtggttcaggaatgttgagaaatactttttttaga

SEQ ID NO: 17630 - DNA, 40 bp, Artificial Sequence
  PCR primer for ORF amplification
tggaagtggttcaggaatgaacaattccataattactgat

SEQ ID NO: 17631 - DNA, 40 bp, Artificial Sequence
  PCR primer for ORF amplification
tggaagtggttcaggaatgaagcaaaaatttgtactaccg

SEQ ID NO: 17632 - DNA, 40 bp, Artificial Sequence
  PCR primer for ORF amplification
tggaagtggttcaggaatgaatattcaaagcaataattct

SEQ ID NO: 17633 - DNA, 40 bp, Artificial Sequence
  PCR primer for ORF amplification
tggaagtggttcaggaatgaatcgtgttggtatagacgta

SEQ ID NO: 17634 - DNA, 40 bp, Artificial Sequence
  PCR primer for ORF amplification
tggaagtggttcaggaatgagcagtgccgcaaatgaggga

SEQ ID NO: 17635 - DNA, 40 bp, Artificial Sequence
  PCR primer for ORF amplification
tggaagtggttcaggaatgagtgaatctccaatgttcgct

SEQ ID NO: 17636 - DNA, 40 bp, Artificial Sequence
  PCR primer for ORF amplification
tggaagtggttcaggaatgctcttaggttactgtggcagc

SEQ ID NO: 17637 - DNA, 40 bp, Artificial Sequence
  PCR primer for ORF amplification
tggaagtggttcaggaatggctgaagcaagcatcgaaaag

SEQ ID NO: 17638 - DNA, 40 bp, Artificial Sequence
  PCR primer for ORF amplification
tggaagtggttcaggaatgtcgaaacagtgggcgagtggt

SEQ ID NO: 17639 - DNA, 40 bp, Artificial Sequence
  PCR primer for ORF amplification
tggaagtggttcaggaatgttcattaaaaacgatcacgcc

SEQ ID NO: 17640 - DNA, 40 bp, Artificial Sequence
  PCR primer for ORF amplification
tggaagtggttcaggaatgactagacctaaaacttttttt

SEQ ID NO: 17641 - DNA, 40 bp, Artificial Sequence
  PCR primer for ORF amplification
tggaagtggttcaggaatgtacaagaactattattcaaac

SEQ ID NO: 17642 - DNA, 40 bp, Artificial Sequence
  PCR primer for ORF amplification
tggaagtggttcaggaatgtggaatcctattttactagat

SEQ ID NO: 17643 - DNA, 40 bp, Artificial Sequence
  PCR primer for ORF amplification
tggaagtggttcaggaatgtttagatctgttgctactaga

SEQ ID NO: 17644 - DNA, 40 bp, Artificial Sequence
  PCR primer for ORF amplification
tggaagtggttcaggaatgtctttaccagctacttttgat

SEQ ID NO: 17645 - DNA, 40 bp, Artificial Sequence
  PCR primer for ORF amplification
tggaagtggttcaggaatgaaatgcagggtatggtcagag

SEQ ID NO: 17646 - DNA, 40 bp, Artificial Sequence
  PCR primer for ORF amplification
tggaagtggttcaggaatgcaaacgatttctggagtctta

SEQ ID NO: 17647 - DNA, 40 bp, Artificial Sequence
  PCR primer for ORF amplification
tggaagtggttcaggaatgctactaaatgtaacgtcttcg

SEQ ID NO: 17648 - DNA, 40 bp, Artificial Sequence
  PCR primer for ORF amplification
tggaagtggttcaggaatgtttagaatagctaaaaacctc

SEQ ID NO: 17649 - DNA, 40 bp, Artificial Sequence
  PCR primer for ORF amplification
tggaagtggttcaggaatgtttatttggcagagaaagagt

SEQ ID NO: 17650 - DNA, 40 bp, Artificial Sequence
  PCR primer for ORF amplification
tggaagtggttcaggaatgaacgtcatagatttaagtgat

SEQ ID NO: 17651 - DNA, 40 bp, Artificial Sequence
  PCR primer for ORF amplification
tggaagtggttcaggaatgaatggcgagagactgcttgct

SEQ ID NO: 17652 - DNA, 40 bp, Artificial Sequence
  PCR primer for ORF amplification
tggaagtggttcaggaatgacacagactgataatcctgtc

SEQ ID NO: 17653 - DNA, 40 bp, Artificial Sequence
  PCR primer for ORF amplification
tggaagtggttcaggaatgactattgatggagacgtacat

SEQ ID NO: 17654 - DNA, 40 bp, Artificial Sequence
  PCR primer for ORF amplification
tggaagtggttcaggaatgatgccagctaacgaagataaa

SEQ ID NO: 17655 - DNA, 40 bp, Artificial Sequence
  PCR primer for ORF amplification
tggaagtggttcaggaatggctgccgtcacattacatcta

SEQ ID NO: 17656 - DNA, 40 bp, Artificial Sequence
  PCR primer for ORF amplification
tggaagtggttcaggaatggctgtcggtggtaataactgg

SEQ ID NO: 17657 - DNA, 40 bp, Artificial Sequence
  PCR primer for ORF amplification
tggaagtggttcaggaatgggttatattttgacaggatat

SEQ ID NO: 17658 - DNA, 40 bp, Artificial Sequence
  PCR primer for ORF amplification
tggaagtggttcaggaatgtcgttgaatatacatatcaag

SEQ ID NO: 17659 - DNA, 40 bp, Artificial Sequence
  PCR primer for ORF amplification
tggaagtggttcaggaatgttttccgctcaaaagccaata

SEQ ID NO: 17660 - DNA, 40 bp, Artificial Sequence
  PCR primer for ORF amplification
tggaagtggttcaggaatgaggatacagtcgctttttgtt

SEQ ID NO: 17661 - DNA, 40 bp, Artificial Sequence
  PCR primer for ORF amplification
tggaagtggttcaggaatggctctatcatggaatattcga

SEQ ID NO: 17662 - DNA, 40 bp, Artificial Sequence
  PCR primer for ORF amplification
tggaagtggttcaggaatgggggaagagattagacttttg

SEQ ID NO: 17663 - DNA, 40 bp, Artificial Sequence
  PCR primer for ORF amplification
tggaagtggttcaggaatgtcactaatggacaattggaag

SEQ ID NO: 17664 - DNA, 40 bp, Artificial Sequence
  PCR primer for ORF amplification
tggaagtggttcaggaatgtctgccaatgatttcaagcct

SEQ ID NO: 17665 - DNA, 40 bp, Artificial Sequence
  PCR primer for ORF amplification
tggaagtggttcaggaatgtttgcaaacgttggatttaga

SEQ ID NO: 17666 - DNA, 40 bp, Artificial Sequence
  PCR primer for ORF amplification
tggaagtggttcaggaatgattttcaatccggtcatatca

SEQ ID NO: 17667 - DNA, 40 bp, Artificial Sequence; identical to SEQ ID NO: 17666
  PCR primer for ORF amplification

SEQ ID NO: 17668 - DNA, 40 bp, Artificial Sequence
  PCR primer for ORF amplification
tggaagtggttcaggaatgaatatggcagaacgtgcagaa

SEQ ID NO: 17669 - DNA, 40 bp, Artificial Sequence
  PCR primer for ORF amplification
tggaagtggttcaggaatgagtttttatcaaccatcccta

SEQ ID NO: 17670 - DNA, 40 bp, Artificial Sequence
  PCR primer for ORF amplification
tggaagtggttcaggaatgatgtctactatctaccgtcat

SEQ ID NO: 17671 - DNA, 40 bp, Artificial Sequence
  PCR primer for ORF amplification
tggaagtggttcaggaatgcccacgatgatcaaaaaggat

SEQ ID NO: 17672 - DNA, 40 bp, Artificial Sequence
  PCR primer for ORF amplification
tggaagtggttcaggaatgctcagatatcatatgcaaggt

SEQ ID NO: 17673 - DNA, 40 bp, Artificial Sequence
  PCR primer for ORF amplification
tggaagtggttcaggaatgcttaaagtgaataacgttttc

SEQ ID NO: 17674 - DNA, 40 bp, Artificial Sequence
  PCR primer for ORF amplification
tggaagtggttcaggaatgtctacggaagagcagaatggt

SEQ ID NO: 17675 - DNA, 40 bp, Artificial Sequence
  PCR primer for ORF amplification
tggaagtggttcaggaatgttgagaacgtcaacattgttc

SEQ ID NO: 17676 - DNA, 40 bp, Artificial Sequence
  PCR primer for ORF amplification
tggaagtggttcaggaatgaaacacaatcgtccaaatggt

SEQ ID NO: 17677 - DNA, 40 bp, Artificial Sequence
  PCR primer for ORF amplification
tggaagtggttcaggaatgaagaaggagttgaaaattctt

SEQ ID NO: 17678 - DNA, 40 bp, Artificial Sequence
  PCR primer for ORF amplification
tggaagtggttcaggaatgaaggacctaaatccagaaatg

SEQ ID NO: 17679 - DNA, 40 bp, Artificial Sequence
  PCR primer for ORF amplification
tggaagtggttcaggaatgacatccgatcctgttaatacg

SEQ ID NO: 17680 - DNA, 40 bp, Artificial Sequence
  PCR primer for ORF amplification
tggaagtggttcaggaatgaccttggcacccctagacgcc

SEQ ID NO: 17681 - DNA, 40 bp, Artificial Sequence
  PCR primer for ORF amplification
tggaagtggttcaggaatgactgacttgtttaaacctcta

SEQ ID NO: 17682 - DNA, 40 bp, Artificial Sequence
  PCR primer for ORF amplification
tggaagtggttcaggaatgagcaacgttactacgccgtgg

SEQ ID NO: 17683 - DNA, 40 bp, Artificial Sequence
  PCR primer for ORF amplification
tggaagtggttcaggaatgcaagttgcaattccagaaacc

SEQ ID NO: 17684 - DNA, 40 bp, Artificial Sequence
  PCR primer for ORF amplification
tggaagtggttcaggaatggctaaaaagagtaactcaaag

SEQ ID NO: 17685 - DNA, 40 bp, Artificial Sequence
  PCR primer for ORF amplification
tggaagtggttcaggaatgtcaacgtttgggaaactgttc

SEQ ID NO: 17686 - DNA, 40 bp, Artificial Sequence
  PCR primer for ORF amplification
tggaagtggttcaggaatgtccgatctcgttaccaagttc

SEQ ID NO: 17687 - DNA, 40 bp, Artificial Sequence
  PCR primer for ORF amplification
tggaagtggttcaggaatgtccgcctcgattccagaaacc

SEQ ID NO: 17688 - DNA, 40 bp, Artificial Sequence
  PCR primer for ORF amplification
tggaagtggttcaggaatgtcgaagggaaaggttttgctg

SEQ ID NO: 17689 - DNA, 40 bp, Artificial Sequence
  PCR primer for ORF amplification
tggaagtggttcaggaatgtcttataaattcggcaaactt

SEQ ID NO: 17690 - DNA, 40 bp, Artificial Sequence
  PCR primer for ORF amplification
tggaagtggttcaggaatgtgcgccaatatccccgaattc

SEQ ID NO: 17691 - DNA, 40 bp, Artificial Sequence
  PCR primer for ORF amplification
tggaagtggttcaggaatgtgtcaagctaccaatggcccg

SEQ ID NO: 17692 - DNA, 40 bp, Artificial Sequence
  PCR primer for ORF amplification
tggaagtggttcaggaatgttgtctttcacaaccaagaat

SEQ ID NO: 17693 - DNA, 40 bp, Artificial Sequence
  PCR primer for ORF amplification
tggaagtggttcaggaatgagcactattagtaccacaacg

SEQ ID NO: 17694 - DNA, 40 bp, Artificial Sequence
  PCR primer for ORF amplification
tggaagtggttcaggaatgattccaaaattatatatacat

SEQ ID NO: 17695 - DNA, 40 bp, Artificial Sequence
  PCR primer for ORF amplification
tggaagtggttcaggaatgcctaaaaaatccattgaagaa

SEQ ID NO: 17696 - DNA, 40 bp, Artificial Sequence
  PCR primer for ORF amplification
tggaagtggttcaggaatgcctcactcagttacaccatcc

SEQ ID NO: 17697 - DNA, 40 bp, Artificial Sequence
  PCR primer for ORF amplification
tggaagtggttcaggaatggatatggaaattgatgaccct

SEQ ID NO: 17698 - DNA, 40 bp, Artificial Sequence
  PCR primer for ORF amplification
tggaagtggttcaggaatgtcattttccttcggctttact

SEQ ID NO: 17699 - DNA, 40 bp, Artificial Sequence
  PCR primer for ORF amplification
tggaagtggttcaggaatgtcgactagaccccaacctgat

SEQ ID NO: 17700 - DNA, 40 bp, Artificial Sequence
  PCR primer for ORF amplification
tggaagtggttcaggaatgtctaaagggagggtcaatcag

SEQ ID NO: 17701 - DNA, 40 bp, Artificial Sequence
  PCR primer for ORF amplification
tggaagtggttcaggaatgacaattaacacaaagaacata

SEQ ID NO: 17702 - DNA, 40 bp, Artificial Sequence
  PCR primer for ORF amplification
tggaagtggttcaggaatgagaccgaacaaaacaagtctg

SEQ ID NO: 17703 - DNA, 40 bp, Artificial Sequence
  PCR primer for ORF amplification
tggaagtggttcaggaatgccagtaaagttaaggtggcct

SEQ ID NO: 17704 - DNA, 40 bp, Artificial Sequence
  PCR primer for ORF amplification
tggaagtggttcaggaatggtggacttgtcaacagctttg

SEQ ID NO: 17705 - DNA, 40 bp, Artificial Sequence
  PCR primer for ORF amplification
tggaagtggttcaggaatgaaagagaatgaacttaaaaat

SEQ ID NO: 17706 - DNA, 40 bp, Artificial Sequence
  PCR primer for ORF amplification
tggaagtggttcaggaatgaaaagtttacaaacactatgt

SEQ ID NO: 17707 - DNA, 40 bp, Artificial Sequence
  PCR primer for ORF amplification
tggaagtggttcaggaatgaaagaaaatgaacttaaaaat

SEQ ID NO: 17708 - DNA, 40 bp, Artificial Sequence
  PCR primer for ORF amplification
tggaagtggttcaggaatgactgcaccacacagaagtact

SEQ ID NO: 17709 - DNA, 40 bp, Artificial Sequence
  PCR primer for ORF amplification
tggaagtggttcaggaatgagtatttttttcaagccgccg

SEQ ID NO: 17710 - DNA, 40 bp, Artificial Sequence
  PCR primer for ORF amplification
tggaagtggttcaggaatgtcgaataagcaggcggttctg

SEQ ID NO: 17711 - DNA, 40 bp, Artificial Sequence
  PCR primer for ORF amplification
tggaagtggttcaggaatgtgcgattctcctgcaacgact

SEQ ID NO: 17712 - DNA, 40 bp, Artificial Sequence
  PCR primer for ORF amplification
tggaagtggttcaggaatgtttagtaacagactaccacct

SEQ ID NO: 17713 - DNA, 40 bp, Artificial Sequence
  PCR primer for ORF amplification
tggaagtggttcaggaatgaattgtatccctagtccaatt

SEQ ID NO: 17714 - DNA, 40 bp, Artificial Sequence
  PCR primer for ORF amplification
tggaagtggttcaggaatgagagaggaaagtaggtctagg

SEQ ID NO: 17715 - DNA, 40 bp, Artificial Sequence
  PCR primer for ORF amplification
tggaagtggttcaggaatgcttcccacattcaaacgttac

SEQ ID NO: 17716 - DNA, 40 bp, Artificial Sequence
  PCR primer for ORF amplification
tggaagtggttcaggaatggaattcgttgcagaaagggct

SEQ ID NO: 17717 - DNA, 40 bp, Artificial Sequence
  PCR primer for ORF amplification
tggaagtggttcaggaatggatggagccaaatttgaaaat

SEQ ID NO: 17718 - DNA, 40 bp, Artificial Sequence
  PCR primer for ORF amplification
tggaagtggttcaggaatggccaagaaagttgccatctgt

SEQ ID NO: 17719 - DNA, 40 bp, Artificial Sequence
  PCR primer for ORF amplification
tggaagtggttcaggaatgtccatcaacctacattccgca

SEQ ID NO: 17720 - DNA, 40 bp, Artificial Sequence
  PCR primer for ORF amplification
tggaagtggttcaggaatgtccgaggcgactttgctatct

SEQ ID NO: 17721 - DNA, 40 bp, Artificial Sequence
  PCR primer for ORF amplification
tggaagtggttcaggaatgtctagcaaatggtttaatgct

SEQ ID NO: 17722 - DNA, 40 bp, Artificial Sequence; identical to SEQ ID NO: 17705
  PCR primer for ORF amplification

SEQ ID NO: 17723 - DNA, 40 bp, Artificial Sequence; identical to SEQ ID NO: 17705
  PCR primer for ORF amplification

SEQ ID NO: 17724 - DNA, 40 bp, Artificial Sequence
  PCR primer for ORF amplification
tggaagtggttcaggaatgaaagagaatgaagtcaaagat

SEQ ID NO: 17725 - DNA, 40 bp, Artificial Sequence
  PCR primer for ORF amplification
tggaagtggttcaggaatgaaaagcgattcagttgaaatc

SEQ ID NO: 17726 - DNA, 40 bp, Artificial Sequence
  PCR primer for ORF amplification
tggaagtggttcaggaatgaattataataactttgaaaat

SEQ ID NO: 17727 - DNA, 40 bp, Artificial Sequence
  PCR primer for ORF amplification
tggaagtggttcaggaatgcagattttcgtcaagactttg

SEQ ID NO: 17728 - DNA, 40 bp, Artificial Sequence
  PCR primer for ORF amplification
tggaagtggttcaggaatgctgctggaaagattgcacaag

SEQ ID NO: 17729 - DNA, 40 bp, Artificial Sequence
  PCR primer for ORF amplification
tggaagtggttcaggaatggatgttacatttctaaccaaa

SEQ ID NO: 17730 - DNA, 40 bp, Artificial Sequence
  PCR primer for ORF amplification
tggaagtggttcaggaatgtcacagttcttcgaagctgct

SEQ ID NO: 17731 - DNA, 40 bp, Artificial Sequence
  PCR primer for ORF amplification
tggaagtggttcaggaatgtcctctcaagcattcacttca

SEQ ID NO: 17732 - DNA, 40 bp, Artificial Sequence
  PCR primer for ORF amplification
tggaagtggttcaggaatgtcttttagggatgtcctagaa

SEQ ID NO: 17733 - DNA, 40 bp, Artificial Sequence
  PCR primer for ORF amplification
tggaagtggttcaggaatgttgaaacgatcatctctaata

SEQ ID NO: 17734 - DNA, 40 bp, Artificial Sequence
  PCR primer for ORF amplification
tggaagtggttcaggaatgaataataacagcagaaacaac

SEQ ID NO: 17735 - DNA, 40 bp, Artificial Sequence
  PCR primer for ORF amplification
tggaagtggttcaggaatgagaaaagaattaaaatacctt

SEQ ID NO: 17736 - DNA, 40 bp, Artificial Sequence
  PCR primer for ORF amplification
tggaagtggttcaggaatgagagctttggcatatttcaag

SEQ ID NO: 17737 - DNA, 40 bp, Artificial Sequence
  PCR primer for ORF amplification
tggaagtggttcaggaatgaggaggactttttctcagtta

SEQ ID NO: 17738 - DNA, 40 bp, Artificial Sequence
  PCR primer for ORF amplification
tggaagtggttcaggaatgcctaaaaagcaaacgaatttc

SEQ ID NO: 17739 - DNA, 40 bp, Artificial Sequence
  PCR primer for ORF amplification
tggaagtggttcaggaatggcaagtaaccagcacatagga

SEQ ID NO: 17740 - DNA, 40 bp, Artificial Sequence
  PCR primer for ORF amplification
tggaagtggttcaggaatggccggtacatttttattcact

SEQ ID NO: 17741 - DNA, 40 bp, Artificial Sequence
  PCR primer for ORF amplification
tggaagtggttcaggaatgggtattaaaggtttgaatgca

SEQ ID NO: 17742 - DNA, 40 bp, Artificial Sequence
  PCR primer for ORF amplification
tggaagtggttcaggaatgtcttccgttactgggttttac

SEQ ID NO: 17743 - DNA, 40 bp, Artificial Sequence; identical to SEQ ID NO: 17705
  PCR primer for ORF amplification

SEQ ID NO: 17744 - DNA, 40 bp, Artificial Sequence; identical to SEQ ID NO: 17724
  PCR primer for ORF amplification

SEQ ID NO: 17745 - DNA, 40 bp, Artificial Sequence
  PCR primer for ORF amplification
tggaagtggttcaggaatgactagtgcaagtattaccaat

SEQ ID NO: 17746 - DNA, 40 bp, Artificial Sequence
  PCR primer for ORF amplification
tggaagtggttcaggaatgagtgaaacagaattgagaaaa

SEQ ID NO: 17747 - DNA, 40 bp, Artificial Sequence
  PCR primer for ORF amplification
tggaagtggttcaggaatgattgtttcatttggtgatgca

SEQ ID NO: 17748 - DNA, 40 bp, Artificial Sequence
  PCR primer for ORF amplification
tggaagtggttcaggaatgcaaaaccctccgttgattcgt

SEQ ID NO: 17749 - DNA, 40 bp, Artificial Sequence
  PCR primer for ORF amplification
tggaagtggttcaggaatggcaggattgaagacatttgat

SEQ ID NO: 17750 - DNA, 40 bp, Artificial Sequence
  PCR primer for ORF amplification
tggaagtggttcaggaatggctgcaagtgagataatgaac

SEQ ID NO: 17751 - DNA, 40 bp, Artificial Sequence
  PCR primer for ORF amplification
tggaagtggttcaggaatggtcgtgacatttttgcaggac

SEQ ID NO: 17752 - DNA, 40 bp, Artificial Sequence
  PCR primer for ORF amplification
tggaagtggttcaggaatgtcaacaaattgtttttccggt

SEQ ID NO: 17753 - DNA, 40 bp, Artificial Sequence
  PCR primer for ORF amplification
tggaagtggttcaggaatgaacaaaacgaattggaaggta

SEQ ID NO: 17754 - DNA, 40 bp, Artificial Sequence
  PCR primer for ORF amplification
tggaagtggttcaggaatggaccagctaagtgacagctat

SEQ ID NO: 17755 - DNA, 40 bp, Artificial Sequence
  PCR primer for ORF amplification
tggaagtggttcaggaatggttacatatgctggaaaactg

SEQ ID NO: 17756 - DNA, 40 bp, Artificial Sequence
  PCR primer for ORF amplification
tggaagtggttcaggaatgtcattttccaattctaaagac

SEQ ID NO: 17757 - DNA, 40 bp, Artificial Sequence
  PCR primer for ORF amplification
tggaagtggttcaggaatgtccaagagcaaaactttctta

SEQ ID NO: 17758 - DNA, 40 bp, Artificial Sequence
  PCR primer for ORF amplification
tggaagtggttcaggaatgtccactgctgtgacttttttt

SEQ ID NO: 17759 - DNA, 40 bp, Artificial Sequence
  PCR primer for ORF amplification
tggaagtggttcaggaatgtcgactaatacttccaagact

SEQ ID NO: 17760 - DNA, 40 bp, Artificial Sequence
  PCR primer for ORF amplification
tggaagtggttcaggaatgaaactaagggcagaagacgtg

SEQ ID NO: 17761 - DNA, 40 bp, Artificial Sequence
  PCR primer for ORF amplification
tggaagtggttcaggaatgaatcaggaagacaacacgggc

SEQ ID NO: 17762 - DNA, 40 bp, Artificial Sequence
  PCR primer for ORF amplification
tggaagtggttcaggaatgactaaatctgtagatacgctg

SEQ ID NO: 17763 - DNA, 40 bp, Artificial Sequence
  PCR primer for ORF amplification
tggaagtggttcaggaatgagctccgttaacgcaaatgga

SEQ ID NO: 17764 - DNA, 40 bp, Artificial Sequence
  PCR primer for ORF amplification
tggaagtggttcaggaatgagtctcagcacaatcatatgt

SEQ ID NO: 17765 - DNA, 40 bp, Artificial Sequence
  PCR primer for ORF amplification
tggaagtggttcaggaatggatacagggagtgcgagcata

SEQ ID NO: 17766 - DNA, 40 bp, Artificial Sequence
  PCR primer for ORF amplification
tggaagtggttcaggaatggcttggtctggtggtaaggat

SEQ ID NO: 17767 - DNA, 40 bp, Artificial Sequence
  PCR primer for ORF amplification
tggaagtggttcaggaatggtttttgatttgaaaagaatt

SEQ ID NO: 17768 - DNA, 40 bp, Artificial Sequence
  PCR primer for ORF amplification
tggaagtggttcaggaatgtcacaagaaacaaaaatgcta

SEQ ID NO: 17769 - DNA, 40 bp, Artificial Sequence
  PCR primer for ORF amplification
tggaagtggttcaggaatgtctgcaaacggcaagatctct

SEQ ID NO: 17770 - DNA, 40 bp, Artificial Sequence
  PCR primer for ORF amplification
tggaagtggttcaggaatgttacgagtttctgaaaatggt

SEQ ID NO: 17771 - DNA, 40 bp, Artificial Sequence
  PCR primer for ORF amplification
tggaagtggttcaggaatgaaggttattagtctgaaaaag

SEQ ID NO: 17772 - DNA, 40 bp, Artificial Sequence
  PCR primer for ORF amplification
tggaagtggttcaggaatgcgtctctctaacctaattgct

SEQ ID NO: 17773 - DNA, 40 bp, Artificial Sequence
  PCR primer for ORF amplification
tggaagtggttcaggaatggtcaacttgaacactatccca

SEQ ID NO: 17774 - DNA, 40 bp, Artificial Sequence
  PCR primer for ORF amplification
tggaagtggttcaggaatgtcatccacagcagtaccacga

SEQ ID NO: 17775 - DNA, 40 bp, Artificial Sequence
  PCR primer for ORF amplification
tggaagtggttcaggaatgtccgccgctactgttggtaaa

SEQ ID NO: 17776 - DNA, 40 bp, Artificial Sequence
  PCR primer for ORF amplification
tggaagtggttcaggaatgactgaattcgaattgcctcca

SEQ ID NO: 17777 - DNA, 40 bp, Artificial Sequence
  PCR primer for ORF amplification
tggaagtggttcaggaatgagcaatgtggctggggaattg

SEQ ID NO: 17778 - DNA, 40 bp, Artificial Sequence
  PCR primer for ORF amplification
tggaagtggttcaggaatgagcactgcaactacaacagtt

SEQ ID NO: 17779 - DNA, 40 bp, Artificial Sequence
  PCR primer for ORF amplification
tggaagtggttcaggaatgagtaacggtgcgtttgatgct

SEQ ID NO: 17780 - DNA, 40 bp, Artificial Sequence
  PCR primer for ORF amplification
tggaagtggttcaggaatgagtgaacttgaagccacaatt

SEQ ID NO: 17781 - DNA, 40 bp, Artificial Sequence
  PCR primer for ORF amplification
tggaagtggttcaggaatggaacagaacaggttcaagaaa

SEQ ID NO: 17782 - DNA, 40 bp, Artificial Sequence
  PCR primer for ORF amplification
tggaagtggttcaggaatggacggtagaaatgaaaaacca

SEQ ID NO: 17783 - DNA, 40 bp, Artificial Sequence
  PCR primer for ORF amplification
tggaagtggttcaggaatggactctattcaagaatcagat

SEQ ID NO: 17784 - DNA, 40 bp, Artificial Sequence
  PCR primer for ORF amplification
tggaagtggttcaggaatgggtgttagtgcaaatttgttc

SEQ ID NO: 17785 - DNA, 40 bp, Artificial Sequence
  PCR primer for ORF amplification
tggaagtggttcaggaatgtccgatatcaacgaaaaactc

SEQ ID NO: 17786 - DNA, 40 bp, Artificial Sequence
  PCR primer for ORF amplification
tggaagtggttcaggaatgtctcacagaaagtacgaagca

SEQ ID NO: 17787 - DNA, 40 bp, Artificial Sequence
  PCR primer for ORF amplification
tggaagtggttcaggaatgtctgcaccaactccattagca

SEQ ID NO: 17788 - DNA, 40 bp, Artificial Sequence
  PCR primer for ORF amplification
tggaagtggttcaggaatgggtatgtttttattatatcgc

SEQ ID NO: 17789 - DNA, 40 bp, Artificial Sequence
  PCR primer for ORF amplification
tggaagtggttcaggaatgaattgcacacttacagataat

SEQ ID NO: 17790 - DNA, 40 bp, Artificial Sequence
  PCR primer for ORF amplification
tggaagtggttcaggaatggcaaattcgccgaaaaagcca

SEQ ID NO: 17791 - DNA, 40 bp, Artificial Sequence
  PCR primer for ORF amplification
tggaagtggttcaggaatgcgtttttcaaatttcctaact

SEQ ID NO: 17792 - DNA, 40 bp, Artificial Sequence
  PCR primer for ORF amplification
tggaagtggttcaggaatggctagttattctttagttgaa

SEQ ID NO: 17793 - DNA, 40 bp, Artificial Sequence
  PCR primer for ORF amplification
tggaagtggttcaggaatgtcaagctcaatacctagagtt

SEQ ID NO: 17794 - DNA, 40 bp, Artificial Sequence
  PCR primer for ORF amplification
tggaagtggttcaggaatgtctctactaggcgccaggtcc

SEQ ID NO: 17795 - DNA, 40 bp, Artificial Sequence
  PCR primer for ORF amplification
tggaagtggttcaggaatgggcatagttttgaaaagagca

SEQ ID NO: 17796 - DNA, 40 bp, Artificial Sequence
  PCR primer for ORF amplification
tggaagtggttcaggaatgttaggactgaaagggtgtcta

SEQ ID NO: 17797 - DNA, 40 bp, Artificial Sequence
  PCR primer for ORF amplification
tggaagtggttcaggaatggaaaataccacgaatcgtaat

SEQ ID NO: 17798 - DNA, 40 bp, Artificial Sequence
  PCR primer for ORF amplification
tggaagtggttcaggaatggtaaaggagacggagtattat

SEQ ID NO: 17799 - DNA, 40 bp, Artificial Sequence
  PCR primer for ORF amplification
tggaagtggttcaggaatggtttcattgttcaaaagaggt

SEQ ID NO: 17800 - DNA, 40 bp, Artificial Sequence
  PCR primer for ORF amplification
tggaagtggttcaggaatgtctgctgctgctgatagatta

SEQ ID NO: 17801 - DNA, 40 bp, Artificial Sequence
  PCR primer for ORF amplification
tggaagtggttcaggaatgagatttcacgatagtatactt

SEQ ID NO: 17802 - DNA, 40 bp, Artificial Sequence
  PCR primer for ORF amplification
tggaagtggttcaggaatgcctctgtcacaaaaacaaata

SEQ ID NO: 17803 - DNA, 40 bp, Artificial Sequence
  PCR primer for ORF amplification
tggaagtggttcaggaatggcagacacaccctctgtggca

SEQ ID NO: 17804 - DNA, 40 bp, Artificial Sequence
  PCR primer for ORF amplification
tggaagtggttcaggaatggccttatttaacgtagaaggt

SEQ ID NO: 17805 - DNA, 40 bp, Artificial Sequence
  PCR primer for ORF amplification
tggaagtggttcaggaatggctactgcgttatatactgca

SEQ ID NO: 17806 - DNA, 40 bp, Artificial Sequence
  PCR primer for ORF amplification
tggaagtggttcaggaatgtccaactttaagaattttact

SEQ ID NO: 17807 - DNA, 40 bp, Artificial Sequence
  PCR primer for ORF amplification
tggaagtggttcaggaatgtctgatatgcttccattggct

SEQ ID NO: 17808 - DNA, 40 bp, Artificial Sequence
  PCR primer for ORF amplification
tggaagtggttcaggaatgaataggaatacgactaccaat

SEQ ID NO: 17809 - DNA, 40 bp, Artificial Sequence
  PCR primer for ORF amplification
tggaagtggttcaggaatgacggatattcaactaaatgga

SEQ ID NO: 17810 - DNA, 40 bp, Artificial Sequence
  PCR primer for ORF amplification
tggaagtggttcaggaatgagtagcagtggtgtttatacg

SEQ ID NO: 17811 - DNA, 40 bp, Artificial Sequence
  PCR primer for ORF amplification
tggaagtggttcaggaatgattcaagatccccttgtatat

SEQ ID NO: 17812 - DNA, 40 bp, Artificial Sequence
  PCR primer for ORF amplification
tggaagtggttcaggaatgctttccagaacaatccgtaca

SEQ ID NO: 17813 - DNA, 40 bp, Artificial Sequence
  PCR primer for ORF amplification
tggaagtggttcaggaatggcgaactcattagacagactg

SEQ ID NO: 17814 - DNA, 40 bp, Artificial Sequence
  PCR primer for ORF amplification
tggaagtggttcaggaatggcgaagattatgatcccagct

SEQ ID NO: 17815 - DNA, 40 bp, Artificial Sequence
  PCR primer for ORF amplification
tggaagtggttcaggaatgggactgatattaaggtggaaa

SEQ ID NO: 17816 - DNA, 40 bp, Artificial Sequence
  PCR primer for ORF amplification
tggaagtggttcaggaatgggtcaattgctttcccatccg

SEQ ID NO: 17817 - DNA, 40 bp, Artificial Sequence
  PCR primer for ORF amplification
tggaagtggttcaggaatggtgtcgaaggatcaaacgtcc

SEQ ID NO: 17818 - DNA, 40 bp, Artificial Sequence
  PCR primer for ORF amplification
tggaagtggttcaggaatgtcatcaagaataattgtcggc

SEQ ID NO: 17819 - DNA, 40 bp, Artificial Sequence
  PCR primer for ORF amplification
tggaagtggttcaggaatgtcctgttctcaaaataagact

SEQ ID NO: 17820 - DNA, 40 bp, Artificial Sequence
  PCR primer for ORF amplification
tggaagtggttcaggaatgtctagtgtaccttataattcc

SEQ ID NO: 17821 - DNA, 40 bp, Artificial Sequence
  PCR primer for ORF amplification
tggaagtggttcaggaatgtctctggatcgtgtagattgg

SEQ ID NO: 17822 - DNA, 40 bp, Artificial Sequence
  PCR primer for ORF amplification
tggaagtggttcaggaatgttgcagagacattccttgaag

SEQ ID NO: 17823 - DNA, 40 bp, Artificial Sequence
  PCR primer for ORF amplification
tggaagtggttcaggaatgttggtgctagggtctcttaga

SEQ ID NO: 17824 - DNA, 40 bp, Artificial Sequence
  PCR primer for ORF amplification
tggaagtggttcaggaatgtttaataatcatgaaattgac

SEQ ID NO: 17825 - DNA, 40 bp, Artificial Sequence
  PCR primer for ORF amplification
tggaagtggttcaggaatgaattacctgcgagatagattt

SEQ ID NO: 17826 - DNA, 40 bp, Artificial Sequence
  PCR primer for ORF amplification
tggaagtggttcaggaatgactctacaagaatctgataaa

SEQ ID NO: 17827 - DNA, 40 bp, Artificial Sequence
  PCR primer for ORF amplification
tggaagtggttcaggaatgacttcacaattgaatgaatta

SEQ ID NO: 17828 - DNA, 40 bp, Artificial Sequence
  PCR primer for ORF amplification
tggaagtggttcaggaatgagtcagtttggcacgacagat

SEQ ID NO: 17829 - DNA, 40 bp, Artificial Sequence
  PCR primer for ORF amplification
tggaagtggttcaggaatgataagcccaagggtgaatact

SEQ ID NO: 17830 - DNA, 40 bp, Artificial Sequence
  PCR primer for ORF amplification
tggaagtggttcaggaatgcagagacacgtttttgcgagg

SEQ ID NO: 17831 - DNA, 40 bp, Artificial Sequence
  PCR primer for ORF amplification
tggaagtggttcaggaatgcctccaaagaagcaagtcgaa

SEQ ID NO: 17832 - DNA, 40 bp, Artificial Sequence
  PCR primer for ORF amplification
tggaagtggttcaggaatggattccacagcacttaaggta

SEQ ID NO: 17833 - DNA, 40 bp, Artificial Sequence
  PCR primer for ORF amplification
tggaagtggttcaggaatggctgaaagtaccacgttagaa

SEQ ID NO: 17834 - DNA, 40 bp, Artificial Sequence
  PCR primer for ORF amplification
tggaagtggttcaggaatgtcctctgctgccacggttgac

SEQ ID NO: 17835 - DNA, 40 bp, Artificial Sequence
  PCR primer for ORF amplification
tggaagtggttcaggaatgtggaagattatgcgttcatgg

SEQ ID NO: 17836 - DNA, 40 bp, Artificial Sequence
  PCR primer for ORF amplification
tggaagtggttcaggaatgtggacaaacactttcaaatgg

SEQ ID NO: 17837 - DNA, 40 bp, Artificial Sequence
  PCR primer for ORF amplification
tggaagtggttcaggaatgtctgaaggtattactgatatt

SEQ ID NO: 17838 - DNA, 40 bp, Artificial Sequence; identical to SEQ ID NO: 17837
  PCR primer for ORF amplification

SEQ ID NO: 17839 - DNA, 40 bp, Artificial Sequence
  PCR primer for ORF amplification
tggaagtggttcaggaatgcctgttgaaaaagatttaaaa

SEQ ID NO: 17840 - DNA, 40 bp, Artificial Sequence
  PCR primer for ORF amplification
tggaagtggttcaggaatggagcatgtagattccgatttt

SEQ ID NO: 17841 - DNA, 40 bp, Artificial Sequence
  PCR primer for ORF amplification
tggaagtggttcaggaatggatcccaccaaagcacccgat

SEQ ID NO: 17842 - DNA, 40 bp, Artificial Sequence
  PCR primer for ORF amplification
tggaagtggttcaggaatgtcactttctcttgtatcgtac

SEQ ID NO: 17843 - DNA, 40 bp, Artificial Sequence
  PCR primer for ORF amplification
tggaagtggttcaggaatgtctgctacatcttcaagtggt

SEQ ID NO: 17844 - DNA, 40 bp, Artificial Sequence
  PCR primer for ORF amplification
tggaagtggttcaggaatgtctttggaaagagaggaacca

SEQ ID NO: 17845 - DNA, 40 bp, Artificial Sequence
  PCR primer for ORF amplification
tggaagtggttcaggaatgtgggggttatgcaagaagcat

SEQ ID NO: 17846 - DNA, 40 bp, Artificial Sequence
  PCR primer for ORF amplification
tggaagtggttcaggaatgttgagaactcaagccgccaga

SEQ ID NO: 17847 - DNA, 40 bp, Artificial Sequence
  PCR primer for ORF amplification
tggaagtggttcaggaatgagtagaatcgatgatttacag

SEQ ID NO: 17848 - DNA, 40 bp, Artificial Sequence
  PCR primer for ORF amplification
tggaagtggttcaggaatgaagcattcccaaaaataccgt

SEQ ID NO: 17849 - DNA, 40 bp, Artificial Sequence
  PCR primer for ORF amplification
tggaagtggttcaggaatgaccgtttacacagcatccgtt

SEQ ID NO: 17850 - DNA, 40 bp, Artificial Sequence
  PCR primer for ORF amplification
tggaagtggttcaggaatgactgtcaccataaaagaattg

SEQ ID NO: 17851 - DNA, 40 bp, Artificial Sequence
  PCR primer for ORF amplification
tggaagtggttcaggaatgaggtttaggagttcttcccat

SEQ ID NO: 17852 - DNA, 40 bp, Artificial Sequence
  PCR primer for ORF amplification
tggaagtggttcaggaatgagtactttcaacagttacagc

SEQ ID NO: 17853 - DNA, 40 bp, Artificial Sequence
  PCR primer for ORF amplification
tggaagtggttcaggaatgattacttcaattgacatagca

SEQ ID NO: 17854 - DNA, 40 bp, Artificial Sequence
  PCR primer for ORF amplification
tggaagtggttcaggaatggccaaaacaacaaaaagagcc

SEQ ID NO: 17855 - DNA, 40 bp, Artificial Sequence
  PCR primer for ORF amplification
tggaagtggttcaggaatgtacgagatgtcaggtatagac

SEQ ID NO: 17856 - DNA, 40 bp, Artificial Sequence
  PCR primer for ORF amplification
tggaagtggttcaggaatgttacagagtatagtcctttcc

SEQ ID NO: 17857 - DNA, 40 bp, Artificial Sequence
  PCR primer for ORF amplification
tggaagtggttcaggaatgctgcatcaaaaaatagctcat

SEQ ID NO: 17858 - DNA, 40 bp, Artificial Sequence
  PCR primer for ORF amplification
tggaagtggttcaggaatggactcgattataccggcaggc

SEQ ID NO: 17859 - DNA, 40 bp, Artificial Sequence
  PCR primer for ORF amplification
tggaagtggttcaggaatgggatttatagcaaatatactg

SEQ ID NO: 17860 - DNA, 40 bp, Artificial Sequence
  PCR primer for ORF amplification
tggaagtggttcaggaatggggttcagaaaaatacttgct

SEQ ID NO: 17861 - DNA, 40 bp, Artificial Sequence
  PCR primer for ORF amplification
tggaagtggttcaggaatgggtggttcttccgattcagac

SEQ ID NO: 17862 - DNA, 40 bp, Artificial Sequence
  PCR primer for ORF amplification
tggaagtggttcaggaatgtccaaagtgtttattgccaca

SEQ ID NO: 17863 - DNA, 40 bp, Artificial Sequence
  PCR primer for ORF amplification
tggaagtggttcaggaatgtcgactgaagaacaaaatgga

SEQ ID NO: 17864 - DNA, 40 bp, Artificial Sequence
  PCR primer for ORF amplification
tggaagtggttcaggaatgtcgcctttgagaaagacggtt

SEQ ID NO: 17865 - DNA, 40 bp, Artificial Sequence
  PCR primer for ORF amplification
tggaagtggttcaggaatgtttagagatagaactaattta

SEQ ID NO: 17866 - DNA, 40 bp, Artificial Sequence
  PCR primer for ORF amplification
tggaagtggttcaggaatgaaattaaaattattaaatata

SEQ ID NO: 17867 - DNA, 40 bp, Artificial Sequence
  PCR primer for ORF amplification
tggaagtggttcaggaatggctttggagggattgcggaaa

SEQ ID NO: 17868 - DNA, 40 bp, Artificial Sequence
  PCR primer for ORF amplification
tggaagtggttcaggaatggttagcttaacctttaaaaat

SEQ ID NO: 17869 - DNA, 40 bp, Artificial Sequence
  PCR primer for ORF amplification
tggaagtggttcaggaatgtatgttgatccgatgaacaac

SEQ ID NO: 17870 - DNA, 40 bp, Artificial Sequence
  PCR primer for ORF amplification
tggaagtggttcaggaatgtcagaagaagacgatcattgg

SEQ ID NO: 17871 - DNA, 40 bp, Artificial Sequence
  PCR primer for ORF amplification
tggaagtggttcaggaatgtctcagaacgtttacattgta

SEQ ID NO: 17872 - DNA, 40 bp, Artificial Sequence
  PCR primer for ORF amplification
tggaagtggttcaggaatgactcccgaacaaaaggccaaa

SEQ ID NO: 17873 - DNA, 40 bp, Artificial Sequence
  PCR primer for ORF amplification
tggaagtggttcaggaatgagcttttattcaaacctaccg

SEQ ID NO: 17874 - DNA, 40 bp, Artificial Sequence
  PCR primer for ORF amplification
tggaagtggttcaggaatgcaaaagatcagtaaatactca

SEQ ID NO: 17875 - DNA, 40 bp, Artificial Sequence
  PCR primer for ORF amplification
tggaagtggttcaggaatgcctaaagagaccccttccaaa

SEQ ID NO: 17876 - DNA, 40 bp, Artificial Sequence
  PCR primer for ORF amplification
tggaagtggttcaggaatgctagccgaaaaaacccgttcc

SEQ ID NO: 17877 - DNA, 40 bp, Artificial Sequence
  PCR primer for ORF amplification
tggaagtggttcaggaatgtcgtttgacagagaagaagac

SEQ ID NO: 17878 - DNA, 40 bp, Artificial Sequence
  PCR primer for ORF amplification
tggaagtggttcaggaatgtttaagaaatacaaaaatcaa

SEQ ID NO: 17879 - DNA, 40 bp, Artificial Sequence
  PCR primer for ORF amplification
tggaagtggttcaggaatgacagcctcatcaaatgacgat

SEQ ID NO: 17880 - DNA, 40 bp, Artificial Sequence
  PCR primer for ORF amplification
tggaagtggttcaggaatgagcagtggttcagcaggggca

SEQ ID NO: 17881 - DNA, 40 bp, Artificial Sequence
  PCR primer for ORF amplification
tggaagtggttcaggaatgccatttgtaaaaggttttgag

SEQ ID NO: 17882 - DNA, 40 bp, Artificial Sequence
  PCR primer for ORF amplification
tggaagtggttcaggaatgccatttgttaaggactttaag

SEQ ID NO: 17883 - DNA, 40 bp, Artificial Sequence
  PCR primer for ORF amplification
tggaagtggttcaggaatggacgagaatgaatttgataat

SEQ ID NO: 17884 - DNA, 40 bp, Artificial Sequence
  PCR primer for ORF amplification
tggaagtggttcaggaatggtttcgtgccaaggaacaagg

SEQ ID NO: 17885 - DNA, 40 bp, Artificial Sequence
  PCR primer for ORF amplification
tggaagtggttcaggaatgtctataatcaaaaaaattgtg

SEQ ID NO: 17886 - DNA, 40 bp, Artificial Sequence
  PCR primer for ORF amplification
tggaagtggttcaggaatgtctcaagttcaagaacaacat

SEQ ID NO: 17887 - DNA, 40 bp, Artificial Sequence
  PCR primer for ORF amplification
tggaagtggttcaggaatgtctgacgatttgagaagaaaa

SEQ ID NO: 17888 - DNA, 40 bp, Artificial Sequence
  PCR primer for ORF amplification
tggaagtggttcaggaatgcgaatcaacagtgagctagcg

SEQ ID NO: 17889 - DNA, 40 bp, Artificial Sequence
  PCR primer for ORF amplification
tggaagtggttcaggaatggaaaaccaagagaaaccgctt

SEQ ID NO: 17890 - DNA, 40 bp, Artificial Sequence
  PCR primer for ORF amplification
tggaagtggttcaggaatggatcccacaagagctccggat

SEQ ID NO: 17891 - DNA, 40 bp, Artificial Sequence
  PCR primer for ORF amplification
tggaagtggttcaggaatggcaaaccctttttcgagatgg

SEQ ID NO: 17892 - DNA, 40 bp, Artificial Sequence
  PCR primer for ORF amplification
tggaagtggttcaggaatggttaaaatgagaagaataaca

SEQ ID NO: 17893 - DNA, 40 bp, Artificial Sequence
  PCR primer for ORF amplification
tggaagtggttcaggaatggttgatttggagcaggaattt

SEQ ID NO: 17894 - DNA, 40 bp, Artificial Sequence
  PCR primer for ORF amplification
tggaagtggttcaggaatggttgggcctggtctgggaatt

SEQ ID NO: 17895 - DNA, 40 bp, Artificial Sequence
  PCR primer for ORF amplification
tggaagtggttcaggaatgatgaaaagattacaccccttg

SEQ ID NO: 17896 - DNA, 40 bp, Artificial Sequence
  PCR primer for ORF amplification
tggaagtggttcaggaatgcgtgagaatgcaatgtctaca

SEQ ID NO: 17897 - DNA, 40 bp, Artificial Sequence
  PCR primer for ORF amplification
tggaagtggttcaggaatgtctagtacagtaatatctaga

SEQ ID NO: 17898 - DNA, 40 bp, Artificial Sequence
  PCR primer for ORF amplification
tggaagtggttcaggaatgttcaaactcacctctcgactc

SEQ ID NO: 17899 - DNA, 40 bp, Artificial Sequence
  PCR primer for ORF amplification
tggaagtggttcaggaatgtttcaacagctgtcggcatcc

SEQ ID NO: 17900 - DNA, 40 bp, Artificial Sequence
  PCR primer for ORF amplification
tggaagtggttcaggaatgaatggaatatttgctattgag

SEQ ID NO: 17901 - DNA, 40 bp, Artificial Sequence
  PCR primer for ORF amplification
tggaagtggttcaggaatgacaatagcgccaatggcaaac

SEQ ID NO: 17902 - DNA, 40 bp, Artificial Sequence
  PCR primer for ORF amplification
tggaagtggttcaggaatgactggcgaagaatggggcttg

SEQ ID NO: 17903 - DNA, 40 bp, Artificial Sequence
  PCR primer for ORF amplification
tggaagtggttcaggaatgcttcgcaacttagtcgtcagg

SEQ ID NO: 17904 - DNA, 40 bp, Artificial Sequence
  PCR primer for ORF amplification
tggaagtggttcaggaatggagatttacattagacttaac

SEQ ID NO: 17905 - DNA, 40 bp, Artificial Sequence
  PCR primer for ORF amplification
tggaagtggttcaggaatgtcagaaacagaactgtcgaaa

SEQ ID NO: 17906 - DNA, 40 bp, Artificial Sequence
  PCR primer for ORF amplification
tggaagtggttcaggaatgtccttaccagctacttttgac

SEQ ID NO: 17907 - DNA, 40 bp, Artificial Sequence
  PCR primer for ORF amplification
tggaagtggttcaggaatgaccattattcagacggttact

SEQ ID NO: 17908 - DNA, 40 bp, Artificial Sequence
  PCR primer for ORF amplification
tggaagtggttcaggaatgcctaacaaagtgtttaacgtg

SEQ ID NO: 17909 - DNA, 40 bp, Artificial Sequence
  PCR primer for ORF amplification
tggaagtggttcaggaatggaggaactaggtttaaaaagc

SEQ ID NO: 17910 - DNA, 40 bp, Artificial Sequence
  PCR primer for ORF amplification
tggaagtggttcaggaatgggaagtttgttgagaccggtt

SEQ ID NO: 17911 - DNA, 40 bp, Artificial Sequence
  PCR primer for ORF amplification
tggaagtggttcaggaatgtactttttaaaccaactaata

SEQ ID NO: 17912 - DNA, 40 bp, Artificial Sequence
  PCR primer for ORF amplification
tggaagtggttcaggaatgtcaactatcaaagttattgag

SEQ ID NO: 17913 - DNA, 40 bp, Artificial Sequence
  PCR primer for ORF amplification
tggaagtggttcaggaatgtcagaagatcaaaaaagtgaa

SEQ ID NO: 17914 - DNA, 40 bp, Artificial Sequence
  PCR primer for ORF amplification
tggaagtggttcaggaatgtctagttcaatatttggccca

SEQ ID NO: 17915 - DNA, 40 bp, Artificial Sequence
  PCR primer for ORF amplification
tggaagtggttcaggaatgtctgaaaatcaacgtttagga

SEQ ID NO: 17916 - DNA, 40 bp, Artificial Sequence
  PCR primer for ORF amplification
tggaagtggttcaggaatgtctgtgcaccacaaaaagaag

SEQ ID NO: 17917 - DNA, 40 bp, Artificial Sequence
  PCR primer for ORF amplification
tggaagtggttcaggaatgaacattggtggaggaaaattt

SEQ ID NO: 17918 - DNA, 40 bp, Artificial Sequence
  PCR primer for ORF amplification
tggaagtggttcaggaatgacagctgctgtaacatcctcc

SEQ ID NO: 17919 - DNA, 40 bp, Artificial Sequence
  PCR primer for ORF amplification
tggaagtggttcaggaatgactaaattgcgaattgctgta

SEQ ID NO: 17920 - DNA, 40 bp, Artificial Sequence
  PCR primer for ORF amplification
tggaagtggttcaggaatgagtcagcaaacaccacaggaa

SEQ ID NO: 17921 - DNA, 40 bp, Artificial Sequence
  PCR primer for ORF amplification
tggaagtggttcaggaatggatacggataagttaatctca

SEQ ID NO: 17922 - DNA, 40 bp, Artificial Sequence
  PCR primer for ORF amplification
tggaagtggttcaggaatgtcaacaacaggtccgttagat

SEQ ID NO: 17923 - DNA, 40 bp, Artificial Sequence
  PCR primer for ORF amplification
tggaagtggttcaggaatgtctattaatatttgtagagat

SEQ ID NO: 17924 - DNA, 40 bp, Artificial Sequence
  PCR primer for ORF amplification
tggaagtggttcaggaatgttcagcttgaaagcattattg

SEQ ID NO: 17925 - DNA, 40 bp, Artificial Sequence
  PCR primer for ORF amplification
tggaagtggttcaggaatggaaggtatgaatatgggtagc

SEQ ID NO: 17926 - DNA, 40 bp, Artificial Sequence
  PCR primer for ORF amplification
tggaagtggttcaggaatggatagagtacgctctttgatt

SEQ ID NO: 17927 - DNA, 40 bp, Artificial Sequence
  PCR primer for ORF amplification
tggaagtggttcaggaatggcagctgatagagataatttt

SEQ ID NO: 17928 - DNA, 40 bp, Artificial Sequence
  PCR primer for ORF amplification
tggaagtggttcaggaatggcttccaagaaaattaaagtt

SEQ ID NO: 17929 - DNA, 40 bp, Artificial Sequence
  PCR primer for ORF amplification
tggaagtggttcaggaatgggcgacgaattacacaaccgt

SEQ ID NO: 17930 - DNA, 40 bp, Artificial Sequence
  PCR primer for ORF amplification
tggaagtggttcaggaatgtcgcttggtataccactttcc

SEQ ID NO: 17931 - DNA, 40 bp, Artificial Sequence
  PCR primer for ORF amplification
tggaagtggttcaggaatgagtgctgccactgcgactgct

SEQ ID NO: 17932 - DNA, 40 bp, Artificial Sequence
  PCR primer for ORF amplification
tggaagtggttcaggaatgatatcaataaaaggaaccgga

SEQ ID NO: 17933 - DNA, 40 bp, Artificial Sequence
  PCR primer for ORF amplification
tggaagtggttcaggaatgcaaatagtcagaagttgtaac

SEQ ID NO: 17934 - DNA, 40 bp, Artificial Sequence
  PCR primer for ORF amplification
tggaagtggttcaggaatgcctttgaatattattgggacg

SEQ ID NO: 17935 - DNA, 40 bp, Artificial Sequence
  PCR primer for ORF amplification
tggaagtggttcaggaatggagacatacgagactagcatt

SEQ ID NO: 17936 - DNA, 40 bp, Artificial Sequence
  PCR primer for ORF amplification
tggaagtggttcaggaatggcggttgcgatcaaaaaggag

SEQ ID NO: 17937 - DNA, 40 bp, Artificial Sequence
  PCR primer for ORF amplification
tggaagtggttcaggaatggctaccttgcacttcgttcct

SEQ ID NO: 17938 - DNA, 40 bp, Artificial Sequence
  PCR primer for ORF amplification
tggaagtggttcaggaatgtacttggaatatcttcaaccg

SEQ ID NO: 17939 - DNA, 40 bp, Artificial Sequence
  PCR primer for ORF amplification
tggaagtggttcaggaatgaatcaaacaggaaggaccata

SEQ ID NO: 17940 - DNA, 40 bp, Artificial Sequence
  PCR primer for ORF amplification
tggaagtggttcaggaatgagtgacaaatctcatcagata

SEQ ID NO: 17941 - DNA, 40 bp, Artificial Sequence
  PCR primer for ORF amplification
tggaagtggttcaggaatgagtttagaggatacattagcc

SEQ ID NO: 17942 - DNA, 40 bp, Artificial Sequence
  PCR primer for ORF amplification
tggaagtggttcaggaatgtccaaaatagaagagctacca

SEQ ID NO: 17943 - DNA, 40 bp, Artificial Sequence
  PCR primer for ORF amplification
tggaagtggttcaggaatgtcctttgatagacagttgacc

SEQ ID NO: 17944 - DNA, 40 bp, Artificial Sequence
  PCR primer for ORF amplification
tggaagtggttcaggaatgaccaattcagtaaagactaat

SEQ ID NO: 17945 - DNA, 40 bp, Artificial Sequence
  PCR primer for ORF amplification
tggaagtggttcaggaatgcctttctcttctgagcaattc

SEQ ID NO: 17946 - DNA, 40 bp, Artificial Sequence
  PCR primer for ORF amplification
tggaagtggttcaggaatgggcaatatccttcggaaaggt

SEQ ID NO: 17947 - DNA, 40 bp, Artificial Sequence
  PCR primer for ORF amplification
tggaagtggttcaggaatggtagatggactgaatacctcg

SEQ ID NO: 17948 - DNA, 40 bp, Artificial Sequence
  PCR primer for ORF amplification
tggaagtggttcaggaatggttaaagaaactaagttttac

SEQ ID NO: 17949 - DNA, 40 bp, Artificial Sequence
  PCR primer for ORF amplification
tggaagtggttcaggaatgtccgaagaagtatggaatgga

SEQ ID NO: 17950 - DNA, 40 bp, Artificial Sequence
  PCR primer for ORF amplification
tggaagtggttcaggaatgtctatgatgctaagtaattgg

SEQ ID NO: 17951 - DNA, 40 bp, Artificial Sequence
  PCR primer for ORF amplification
tggaagtggttcaggaatgtttaacatgaatctactttct

SEQ ID NO: 17952 - DNA, 40 bp, Artificial Sequence
  PCR primer for ORF amplification
tggaagtggttcaggaatgagtacagccgatcaagaacaa

SEQ ID NO: 17953 - DNA, 40 bp, Artificial Sequence
  PCR primer for ORF amplification
tggaagtggttcaggaatgctaagtgcaatttccaaagtc

SEQ ID NO: 17954 - DNA, 40 bp, Artificial Sequence
  PCR primer for ORF amplification
tggaagtggttcaggaatggcatctaacgaagttttagtt

SEQ ID NO: 17955 - DNA, 40 bp, Artificial Sequence
  PCR primer for ORF amplification
tggaagtggttcaggaatgtctaccacactactttggttt

SEQ ID NO: 17956 - DNA, 40 bp, Artificial Sequence
  PCR primer for ORF amplification
tggaagtggttcaggaatgttttccatattcaattcacca

SEQ ID NO: 17957 - DNA, 40 bp, Artificial Sequence
  PCR primer for ORF amplification
tggaagtggttcaggaatgacatcagctacggacaaatct

SEQ ID NO: 17958 - DNA, 40 bp, Artificial Sequence
  PCR primer for ORF amplification
tggaagtggttcaggaatgcccagggatccattgattggt

SEQ ID NO: 17959 - DNA, 40 bp, Artificial Sequence
  PCR primer for ORF amplification
tggaagtggttcaggaatgcgtatagcgatgcatctgccg

SEQ ID NO: 17960 - DNA, 40 bp, Artificial Sequence
  PCR primer for ORF amplification
tggaagtggttcaggaatggaagaaaaggaaggtatcaag

SEQ ID NO: 17961 - DNA, 40 bp, Artificial Sequence
  PCR primer for ORF amplification
tggaagtggttcaggaatggactcattatcaaaaaagatt

SEQ ID NO: 17962 - DNA, 40 bp, Artificial Sequence
  PCR primer for ORF amplification
tggaagtggttcaggaatggatgcaactaccccactatta

SEQ ID NO: 17963 - DNA, 40 bp, Artificial Sequence
  PCR primer for ORF amplification
tggaagtggttcaggaatgtcctccgctgcaacaaaagct

SEQ ID NO: 17964 - DNA, 40 bp, Artificial Sequence
  PCR primer for ORF amplification
tggaagtggttcaggaatgtcgttggaagccatcgtcttt

SEQ ID NO: 17965 - DNA, 40 bp, Artificial Sequence
  PCR primer for ORF amplification
tggaagtggttcaggaatgtctgatttgttaccactagct

SEQ ID NO: 17966 - DNA, 40 bp, Artificial Sequence
  PCR primer for ORF amplification
tggaagtggttcaggaatgcaatcttctcttcccctttgc

SEQ ID NO: 17967 - DNA, 40 bp, Artificial Sequence
  PCR primer for ORF amplification
tggaagtggttcaggaatgaaaattgcggtagaaacgaca

SEQ ID NO: 17968 - DNA, 40 bp, Artificial Sequence
  PCR primer for ORF amplification
tggaagtggttcaggaatgacaaagattaaggtagctaac

SEQ ID NO: 17969 - DNA, 40 bp, Artificial Sequence
  PCR primer for ORF amplification
tggaagtggttcaggaatgacttccctgactaatgccgtg

SEQ ID NO: 17970 - DNA, 40 bp, Artificial Sequence
  PCR primer for ORF amplification
tggaagtggttcaggaatggctaaaagacccttaggttta

SEQ ID NO: 17971 - DNA, 40 bp, Artificial Sequence
  PCR primer for ORF amplification
tggaagtggttcaggaatgtcagaattacatgctttgctt

SEQ ID NO: 17972 - DNA, 40 bp, Artificial Sequence
  PCR primer for ORF amplification
tggaagtggttcaggaatgtctcctgcagcagctcaaaca

SEQ ID NO: 17973 - DNA, 40 bp, Artificial Sequence
  PCR primer for ORF amplification
tggaagtggttcaggaatgagagcattcccccgagtactg

SEQ ID NO: 17974 - DNA, 40 bp, Artificial Sequence
  PCR primer for ORF amplification
tggaagtggttcaggaatgcaatacaaaaagactttggtt

SEQ ID NO: 17975 - DNA, 40 bp, Artificial Sequence
  PCR primer for ORF amplification
tggaagtggttcaggaatggacacaaattctaaaaccaaa

SEQ ID NO: 17976 - DNA, 40 bp, Artificial Sequence
  PCR primer for ORF amplification
tggaagtggttcaggaatgggagctggcactcttttaaat

SEQ ID NO: 17977 - DNA, 40 bp, Artificial Sequence
  PCR primer for ORF amplification
tggaagtggttcaggaatgggattatattctcctgaatct

SEQ ID NO: 17978 - DNA, 40 bp, Artificial Sequence
  PCR primer for ORF amplification
tggaagtggttcaggaatgtccacagagactacaaaacca

SEQ ID NO: 17979 - DNA, 40 bp, Artificial Sequence
  PCR primer for ORF amplification
tggaagtggttcaggaatgtggctttcaaagttccagttc

SEQ ID NO: 17980 - DNA, 40 bp, Artificial Sequence
  PCR primer for ORF amplification
tggaagtggttcaggaatgaatccatcagtaccgaaggtt

SEQ ID NO: 17981 - DNA, 40 bp, Artificial Sequence
  PCR primer for ORF amplification
tggaagtggttcaggaatgagttatagtgtcaacacgttt

SEQ ID NO: 17982 - DNA, 40 bp, Artificial Sequence
  PCR primer for ORF amplification
tggaagtggttcaggaatgctttcattcagaagtttgact

SEQ ID NO: 17983 - DNA, 40 bp, Artificial Sequence
  PCR primer for ORF amplification
tggaagtggttcaggaatggctaagactactaaagtaaaa

SEQ ID NO: 17984 - DNA, 40 bp, Artificial Sequence
  PCR primer for ORF amplification
tggaagtggttcaggaatggtaaatttcgatttgggccaa

SEQ ID NO: 17985 - DNA, 40 bp, Artificial Sequence
  PCR primer for ORF amplification
tggaagtggttcaggaatgtatagacgatctgttggagta

SEQ ID NO: 17986 - DNA, 40 bp, Artificial Sequence
  PCR primer for ORF amplification
tggaagtggttcaggaatgtctgaagctcaagaaactcac

SEQ ID NO: 17987 - DNA, 40 bp, Artificial Sequence
  PCR primer for ORF amplification
tggaagtggttcaggaatgtttgtcagggttaaattgaat

SEQ ID NO: 17988 - DNA, 40 bp, Artificial Sequence
  PCR primer for ORF amplification
tggaagtggttcaggaatgaaaaggtccacgttgctgtcg

SEQ ID NO: 17989 - DNA, 40 bp, Artificial Sequence
  PCR primer for ORF amplification
tggaagtggttcaggaatgaacaactcaaagactaaccaa

SEQ ID NO: 17990 - DNA, 40 bp, Artificial Sequence
  PCR primer for ORF amplification
tggaagtggttcaggaatgcttgaatcgagcagtgataag

SEQ ID NO: 17991 - DNA, 40 bp, Artificial Sequence
  PCR primer for ORF amplification
tggaagtggttcaggaatgggtactacgacaagtcatcca

SEQ ID NO: 17992 - DNA, 40 bp, Artificial Sequence
  PCR primer for ORF amplification
tggaagtggttcaggaatgtccggaataattgacgcatct

SEQ ID NO: 17993 - DNA, 40 bp, Artificial Sequence
  PCR primer for ORF amplification
tggaagtggttcaggaatgtccgtgaaaaggtctgtttct

SEQ ID NO: 17994 - DNA, 40 bp, Artificial Sequence
  PCR primer for ORF amplification
tggaagtggttcaggaatgtctcaaggtactttatatgct

SEQ ID NO: 17995 - DNA, 40 bp, Artificial Sequence
  PCR primer for ORF amplification
tggaagtggttcaggaatgaaagcaaagtcgatgaagagc

SEQ ID NO: 17996 - DNA, 40 bp, Artificial Sequence
  PCR primer for ORF amplification
tggaagtggttcaggaatgcctatggttaccgtgaagtat

SEQ ID NO: 17997 - DNA, 40 bp, Artificial Sequence
  PCR primer for ORF amplification
tggaagtggttcaggaatggtatcttctttgcccaaggaa

SEQ ID NO: 17998 - DNA, 40 bp, Artificial Sequence
  PCR primer for ORF amplification
tggaagtggttcaggaatggtgacaagacatagagtgact

SEQ ID NO: 17999 - DNA, 40 bp, Artificial Sequence
  PCR primer for ORF amplification
tggaagtggttcaggaatgtctactaatactgttccctca

SEQ ID NO: 18000 - DNA, 40 bp, Artificial Sequence
  PCR primer for ORF amplification
tggaagtggttcaggaatgtctttatcttcaaagttgtct

SEQ ID NO: 18001 - DNA, 40 bp, Artificial Sequence
  PCR primer for ORF amplification
tggaagtggttcaggaatgaacgaagcagatgttacaaaa

SEQ ID NO: 18002 - DNA, 40 bp, Artificial Sequence
  PCR primer for ORF amplification
tggaagtggttcaggaatgactaagaccatcacagttgct

SEQ ID NO: 18003 - DNA, 40 bp, Artificial Sequence
  PCR primer for ORF amplification
tggaagtggttcaggaatgagagccttagcgtatttcggt

SEQ ID NO: 18004 - DNA, 40 bp, Artificial Sequence
  PCR primer for ORF amplification
tggaagtggttcaggaatgataatatttaatgggaacaaa

SEQ ID NO: 18005 - DNA, 40 bp, Artificial Sequence
  PCR primer for ORF amplification
tggaagtggttcaggaatgctggcaagatatttaaattta

SEQ ID NO: 18006 - DNA, 40 bp, Artificial Sequence
  PCR primer for ORF amplification
tggaagtggttcaggaatggatgaagtcttaccattgttt

SEQ ID NO: 18007 - DNA, 40 bp, Artificial Sequence
  PCR primer for ORF amplification
tggaagtggttcaggaatggctggcgacaaccctgaaaac

SEQ ID NO: 18008 - DNA, 40 bp, Artificial Sequence
  PCR primer for ORF amplification
tggaagtggttcaggaatggctgtatttactcctccatca

SEQ ID NO: 18009 - DNA, 40 bp, Artificial Sequence
  PCR primer for ORF amplification
tggaagtggttcaggaatgtcagaccctatcagaacgaaa

SEQ ID NO: 18010 - DNA, 40 bp, Artificial Sequence
  PCR primer for ORF amplification
tggaagtggttcaggaatgtcccagagaaagcgatactca

SEQ ID NO: 18011 - DNA, 40 bp, Artificial Sequence
  PCR primer for ORF amplification
tggaagtggttcaggaatgtctcaaagactacaaagtatc

SEQ ID NO: 18012 - DNA, 40 bp, Artificial Sequence
  PCR primer for ORF amplification
tggaagtggttcaggaatggaaaacaaactactttgttgg

SEQ ID NO: 18013 - DNA, 40 bp, Artificial Sequence
  PCR primer for ORF amplification
tggaagtggttcaggaatggactatttacatgtatataac

SEQ ID NO: 18014 - DNA, 40 bp, Artificial Sequence
  PCR primer for ORF amplification
tggaagtggttcaggaatgtcaggaacattcaatgatata

SEQ ID NO: 18015 - DNA, 40 bp, Artificial Sequence
  PCR primer for ORF amplification
tggaagtggttcaggaatgtcgacaataaagccaagccct

SEQ ID NO: 18016 - DNA, 40 bp, Artificial Sequence
  PCR primer for ORF amplification
tggaagtggttcaggaatgtctgccactctgttcaataac

SEQ ID NO: 18017 - DNA, 40 bp, Artificial Sequence
  PCR primer for ORF amplification
tggaagtggttcaggaatgtggggcatcttattgaaatcc

SEQ ID NO: 18018 - DNA, 40 bp, Artificial Sequence
  PCR primer for ORF amplification
tggaagtggttcaggaatgtttgatcctctcgatttgtac

SEQ ID NO: 18019 - DNA, 40 bp, Artificial Sequence
  PCR primer for ORF amplification
tggaagtggttcaggaatgaaactgtccgccaccactctt

SEQ ID NO: 18020 - DNA, 40 bp, Artificial Sequence
  PCR primer for ORF amplification
tggaagtggttcaggaatgagtaaaattaaagttgttcat

SEQ ID NO: 18021 - DNA, 40 bp, Artificial Sequence
  PCR primer for ORF amplification
tggaagtggttcaggaatgcataaatttgatctagagctc

SEQ ID NO: 18022 - DNA, 40 bp, Artificial Sequence
  PCR primer for ORF amplification
tggaagtggttcaggaatgcttgctgcttcattcaaacgc

SEQ ID NO: 18023 - DNA, 40 bp, Artificial Sequence
  PCR primer for ORF amplification
tggaagtggttcaggaatggttttatcaaggggagaaaca

SEQ ID NO: 18024 - DNA, 40 bp, Artificial Sequence
  PCR primer for ORF amplification
tggaagtggttcaggaatgtctaagggaaaagtttgtttg

SEQ ID NO: 18025 - DNA, 40 bp, Artificial Sequence
  PCR primer for ORF amplification
tggaagtggttcaggaatgtctatcaaaggtgattccccc

SEQ ID NO: 18026 - DNA, 40 bp, Artificial Sequence
  PCR primer for ORF amplification
tggaagtggttcaggaatgtctcaaccccagatgtcccct

SEQ ID NO: 18027 - DNA, 40 bp, Artificial Sequence
  PCR primer for ORF amplification
tggaagtggttcaggaatgttcaaagttccagtgggatta

SEQ ID NO: 18028 - DNA, 40 bp, Artificial Sequence
  PCR primer for ORF amplification
tggaagtggttcaggaatgacagacgctgaaatagaaaat

SEQ ID NO: 18029 - DNA, 40 bp, Artificial Sequence
  PCR primer for ORF amplification
tggaagtggttcaggaatgacggccgtaactgatatcatc

SEQ ID NO: 18030 - DNA, 40 bp, Artificial Sequence
  PCR primer for ORF amplification
tggaagtggttcaggaatggtccggattcttcccataatt

SEQ ID NO: 18031 - DNA, 40 bp, Artificial Sequence
  PCR primer for ORF amplification
tggaagtggttcaggaatgtcccagctgacggagttcatt

SEQ ID NO: 18032 - DNA, 40 bp, Artificial Sequence
  PCR primer for ORF amplification
tggaagtggttcaggaatgtctgaattactagatagcttt

SEQ ID NO: 18033 - DNA, 40 bp, Artificial Sequence
  PCR primer for ORF amplification
tggaagtggttcaggaatgggatattttgttccggattca

SEQ ID NO: 18034 - DNA, 40 bp, Artificial Sequence
  PCR primer for ORF amplification
tggaagtggttcaggaatgaaagtatgttatcactctaaa

SEQ ID NO: 18035 - DNA, 40 bp, Artificial Sequence
  PCR primer for ORF amplification
tggaagtggttcaggaatgaatcagtgcgcgaaggacata

SEQ ID NO: 18036 - DNA, 40 bp, Artificial Sequence
  PCR primer for ORF amplification
tggaagtggttcaggaatgagaatatcaatattacagctg

SEQ ID NO: 18037 - DNA, 40 bp, Artificial Sequence
  PCR primer for ORF amplification
tggaagtggttcaggaatgagcagtaataaaggaaatggg

SEQ ID NO: 18038 - DNA, 40 bp, Artificial Sequence
  PCR primer for ORF amplification
tggaagtggttcaggaatggcaatcaaaccaagaacgaag

SEQ ID NO: 18039 - DNA, 40 bp, Artificial Sequence
  PCR primer for ORF amplification
tggaagtggttcaggaatggttgatcttatagcgagggat

SEQ ID NO: 18040 - DNA, 40 bp, Artificial Sequence
  PCR primer for ORF amplification
tggaagtggttcaggaatgtcgacaattggagctgttgat

SEQ ID NO: 18041 - DNA, 40 bp, Artificial Sequence
  PCR primer for ORF amplification
tggaagtggttcaggaatgacaaaagcttatactatcgtt

SEQ ID NO: 18042 - DNA, 40 bp, Artificial Sequence
  PCR primer for ORF amplification
tggaagtggttcaggaatgacagacaaaggcaagaacgat

SEQ ID NO: 18043 - DNA, 40 bp, Artificial Sequence
  PCR primer for ORF amplification
tggaagtggttcaggaatgactgaacctgccctgagtagc

SEQ ID NO: 18044 - DNA, 40 bp, Artificial Sequence
  PCR primer for ORF amplification
tggaagtggttcaggaatgccacaatttggtatattatgt

SEQ ID NO: 18045 - DNA, 40 bp, Artificial Sequence
  PCR primer for ORF amplification
tggaagtggttcaggaatggaaaacttatgccctccacct

SEQ ID NO: 18046 - DNA, 40 bp, Artificial Sequence
  PCR primer for ORF amplification
tggaagtggttcaggaatggatgttgatataggatgttat

SEQ ID NO: 18047 - DNA, 40 bp, Artificial Sequence
  PCR primer for ORF amplification
tggaagtggttcaggaatggattctcgagttgcactggta

SEQ ID NO: 18048 - DNA, 40 bp, Artificial Sequence
  PCR primer for ORF amplification
tggaagtggttcaggaatggcaacccaagccctagaggat

SEQ ID NO: 18049 - DNA, 40 bp, Artificial Sequence
  PCR primer for ORF amplification
tggaagtggttcaggaatggcagcacatcagatggactcg

SEQ ID NO: 18050 - DNA, 40 bp, Artificial Sequence
  PCR primer for ORF amplification
tggaagtggttcaggaatggcggaaatacctgatgaaacc

SEQ ID NO: 18051 - DNA, 40 bp, Artificial Sequence
  PCR primer for ORF amplification
tggaagtggttcaggaatgttcccaatgaaagatcactca

SEQ ID NO: 18052 - DNA, 40 bp, Artificial Sequence
  PCR primer for ORF amplification
tggaagtggttcaggaatgtttaaaagatatttatccagt

SEQ ID NO: 18053 - DNA, 40 bp, Artificial Sequence
  PCR primer for ORF amplification
tggaagtggttcaggaatgggattctttattcctcagagt

SEQ ID NO: 18054 - DNA, 40 bp, Artificial Sequence
  PCR primer for ORF amplification
tggaagtggttcaggaatggcaaacccaacaacagggaag

SEQ ID NO: 18055 - DNA, 40 bp, Artificial Sequence
  PCR primer for ORF amplification
tggaagtggttcaggaatggcagccaactctggtctcgac

SEQ ID NO: 18056 - DNA, 40 bp, Artificial Sequence
  PCR primer for ORF amplification
tggaagtggttcaggaatgtccgaagctaccctctcctcc

SEQ ID NO: 18057 - DNA, 40 bp, Artificial Sequence
  PCR primer for ORF amplification
tggaagtggttcaggaatgaaattggatacttctcatatg

SEQ ID NO: 18058 - DNA, 40 bp, Artificial Sequence
  PCR primer for ORF amplification
tggaagtggttcaggaatgacagatcccagaagaagaaca

SEQ ID NO: 18059 - DNA, 40 bp, Artificial Sequence
  PCR primer for ORF amplification
tggaagtggttcaggaatgagtggctctacagaatctaaa

SEQ ID NO: 18060 - DNA, 40 bp, Artificial Sequence
  PCR primer for ORF amplification
tggaagtggttcaggaatgcaaatctgcaaggtatttctt

SEQ ID NO: 18061 - DNA, 40 bp, Artificial Sequence
  PCR primer for ORF amplification
tggaagtggttcaggaatggtagtacattggacaattgtg

SEQ ID NO: 18062 - DNA, 40 bp, Artificial Sequence
  PCR primer for ORF amplification
tggaagtggttcaggaatgtcggaccaggataatacccag

SEQ ID NO: 18063 - DNA, 40 bp, Artificial Sequence
  PCR primer for ORF amplification
tggaagtggttcaggaatgaacatccttttacaggatcca

SEQ ID NO: 18064 - DNA, 40 bp, Artificial Sequence
  PCR primer for ORF amplification
tggaagtggttcaggaatgacaggagaaaaaatacttcat

SEQ ID NO: 18065 - DNA, 40 bp, Artificial Sequence
  PCR primer for ORF amplification
tggaagtggttcaggaatgactgatagtgagaatgaatcc

SEQ ID NO: 18066 - DNA, 40 bp, Artificial Sequence
  PCR primer for ORF amplification
tggaagtggttcaggaatgtaccttggacgacattttttg

SEQ ID NO: 18067 - DNA, 40 bp, Artificial Sequence
  PCR primer for ORF amplification
tggaagtggttcaggaatgtcgcaccaaaaccagcttatt

SEQ ID NO: 18068 - DNA, 40 bp, Artificial Sequence
  PCR primer for ORF amplification
tggaagtggttcaggaatgttgaaagagccctcagttcgc

SEQ ID NO: 18069 - DNA, 40 bp, Artificial Sequence
  PCR primer for ORF amplification
tggaagtggttcaggaatgcatcataactcacagtctttg

SEQ ID NO: 18070 - DNA, 40 bp, Artificial Sequence
  PCR primer for ORF amplification
tggaagtggttcaggaatgcgtaagtgtaaaatttttgtt

SEQ ID NO: 18071 - DNA, 40 bp, Artificial Sequence
  PCR primer for ORF amplification
tggaagtggttcaggaatggagagagagctagggatgtat

SEQ ID NO: 18072 - DNA, 40 bp, Artificial Sequence
  PCR primer for ORF amplification
tggaagtggttcaggaatggccattgaattgggactttcc

SEQ ID NO: 18073 - DNA, 40 bp, Artificial Sequence
  PCR primer for ORF amplification
tggaagtggttcaggaatggctaaaggtttcaagttgaag

SEQ ID NO: 18074 - DNA, 40 bp, Artificial Sequence
  PCR primer for ORF amplification
tggaagtggttcaggaatgggtttcatatcgtcaatactg

SEQ ID NO: 18075 - DNA, 40 bp, Artificial Sequence
  PCR primer for ORF amplification
tggaagtggttcaggaatggttgaaacatttagttttgct

SEQ ID NO: 18076 - DNA, 40 bp, Artificial Sequence
  PCR primer for ORF amplification
tggaagtggttcaggaatgtactcaagaaaatccttatcc

SEQ ID NO: 18077 - DNA, 40 bp, Artificial Sequence
  PCR primer for ORF amplification
tggaagtggttcaggaatgaaggatgctaatgagagtaaa

SEQ ID NO: 18078 - DNA, 40 bp, Artificial Sequence
  PCR primer for ORF amplification
tggaagtggttcaggaatgactgctgctaaaccaaatcca

SEQ ID NO: 18079 - DNA, 40 bp, Artificial Sequence
  PCR primer for ORF amplification
tggaagtggttcaggaatgagcgatgttctatctcaatat

SEQ ID NO: 18080 - DNA, 40 bp, Artificial Sequence
  PCR primer for ORF amplification
tggaagtggttcaggaatgagtatgttatctagaagatta

SEQ ID NO: 18081 - DNA, 40 bp, Artificial Sequence
  PCR primer for ORF amplification
tggaagtggttcaggaatgctaaagggaccgcttaaaggt

SEQ ID NO: 18082 - DNA, 40 bp, Artificial Sequence
  PCR primer for ORF amplification
tggaagtggttcaggaatggaggaactaggtattgtgaca

SEQ ID NO: 18083 - DNA, 40 bp, Artificial Sequence
  PCR primer for ORF amplification
tggaagtggttcaggaatggatttaacaatttcaaacgaa

SEQ ID NO: 18084 - DNA, 40 bp, Artificial Sequence
  PCR primer for ORF amplification
tggaagtggttcaggaatggcaaaaggaggctcgctatac

SEQ ID NO: 18085 - DNA, 40 bp, Artificial Sequence
  PCR primer for ORF amplification
tggaagtggttcaggaatggttaataatatcatgcacgag

SEQ ID NO: 18086 - DNA, 40 bp, Artificial Sequence
  PCR primer for ORF amplification
tggaagtggttcaggaatggcaaataatacgtggaagtta

SEQ ID NO: 18087 - DNA, 40 bp, Artificial Sequence
  PCR primer for ORF amplification
tggaagtggttcaggaatggctaaagatattttgaagaac

SEQ ID NO: 18088 - DNA, 40 bp, Artificial Sequence
  PCR primer for ORF amplification
tggaagtggttcaggaatgggaggagaggttctaaataat

SEQ ID NO: 18089 - DNA, 40 bp, Artificial Sequence
  PCR primer for ORF amplification
tggaagtggttcaggaatggtagacgtggaagagaaaagt

SEQ ID NO: 18090 - DNA, 40 bp, Artificial Sequence
  PCR primer for ORF amplification
tggaagtggttcaggaatgtcagaaccagtgataaagtct

SEQ ID NO: 18091 - DNA, 40 bp, Artificial Sequence
  PCR primer for ORF amplification
tggaagtggttcaggaatgtctgcattgagaaacatcaag

SEQ ID NO: 18092 - DNA, 40 bp, Artificial Sequence
  PCR primer for ORF amplification
tggaagtggttcaggaatgacagttttatacacatctgca

SEQ ID NO: 18093 - DNA, 40 bp, Artificial Sequence
  PCR primer for ORF amplification
tggaagtggttcaggaatgactattaggagcagtatgaaa

SEQ ID NO: 18094 - DNA, 40 bp, Artificial Sequence
  PCR primer for ORF amplification
tggaagtggttcaggaatgccaagaaagtttttgggcaat

SEQ ID NO: 18095 - DNA, 40 bp, Artificial Sequence
  PCR primer for ORF amplification
tggaagtggttcaggaatgcggaccgattggaattttttc

SEQ ID NO: 18096 - DNA, 40 bp, Artificial Sequence
  PCR primer for ORF amplification
tggaagtggttcaggaatggatgatataagcggaaggcaa

SEQ ID NO: 18097 - DNA, 40 bp, Artificial Sequence
  PCR primer for ORF amplification
tggaagtggttcaggaatggcagagaaaatcttggaaaat

SEQ ID NO: 18098 - DNA, 40 bp, Artificial Sequence
  PCR primer for ORF amplification
tggaagtggttcaggaatgggaatacctggcttactgcct

SEQ ID NO: 18099 - DNA, 40 bp, Artificial Sequence
  PCR primer for ORF amplification
tggaagtggttcaggaatgggtttatttgataaagtgaag

SEQ ID NO: 18100 - DNA, 40 bp, Artificial Sequence
  PCR primer for ORF amplification
tggaagtggttcaggaatggtagatagtaatgatgatcaa

SEQ ID NO: 18101 - DNA, 40 bp, Artificial Sequence
  PCR primer for ORF amplification
tggaagtggttcaggaatgtcagctttcggtaacccattc

SEQ ID NO: 18102 - DNA, 40 bp, Artificial Sequence
  PCR primer for ORF amplification
tggaagtggttcaggaatgttgcacatgaattcgttgtgg

SEQ ID NO: 18103 - DNA, 40 bp, Artificial Sequence
  PCR primer for ORF amplification
tggaagtggttcaggaatgaccccacctcattttttttta

SEQ ID NO: 18104 - DNA, 40 bp, Artificial Sequence
  PCR primer for ORF amplification
tggaagtggttcaggaatgcacagatccacttttatcagg

SEQ ID NO: 18105 - DNA, 40 bp, Artificial Sequence
  PCR primer for ORF amplification
tggaagtggttcaggaatgcgacagagagtaggaaggtcc

SEQ ID NO: 18106 - DNA, 40 bp, Artificial Sequence
  PCR primer for ORF amplification
tggaagtggttcaggaatggaacctcaagaagagtttata

SEQ ID NO: 18107 - DNA, 40 bp, Artificial Sequence
  PCR primer for ORF amplification
tggaagtggttcaggaatggcagactttaaatctttaggt

SEQ ID NO: 18108 - DNA, 40 bp, Artificial Sequence
  PCR primer for ORF amplification
tggaagtggttcaggaatggtagtacaaaatagcccagtt

SEQ ID NO: 18109 - DNA, 40 bp, Artificial Sequence
  PCR primer for ORF amplification
tggaagtggttcaggaatgtctgatgcggctccttcattg

SEQ ID NO: 18110 - DNA, 40 bp, Artificial Sequence
  PCR primer for ORF amplification
tggaagtggttcaggaatgacagtgaatgacaaaaaaaga

SEQ ID NO: 18111 - DNA, 40 bp, Artificial Sequence
  PCR primer for ORF amplification
tggaagtggttcaggaatgagcaacgacgaaactgtagag

SEQ ID NO: 18112 - DNA, 40 bp, Artificial Sequence
  PCR primer for ORF amplification
tggaagtggttcaggaatgagctctactttctttacatgc

SEQ ID NO: 18113 - DNA, 40 bp, Artificial Sequence
  PCR primer for ORF amplification
tggaagtggttcaggaatggaattctatttgtcatccgat

SEQ ID NO: 18114 - DNA, 40 bp, Artificial Sequence
  PCR primer for ORF amplification
tggaagtggttcaggaatggacccacataatccaattggt

SEQ ID NO: 18115 - DNA, 40 bp, Artificial Sequence
  PCR primer for ORF amplification
tggaagtggttcaggaatggttgttgatactgagtattac

SEQ ID NO: 18116 - DNA, 40 bp, Artificial Sequence
  PCR primer for ORF amplification
tggaagtggttcaggaatgtacaagttggacaataacgac

SEQ ID NO: 18117 - DNA, 40 bp, Artificial Sequence
  PCR primer for ORF amplification
tggaagtggttcaggaatgtatccaggtagtggacgttac

SEQ ID NO: 18118 - DNA, 40 bp, Artificial Sequence
  PCR primer for ORF amplification
tggaagtggttcaggaatgaagaaatatctgctgtatatg

SEQ ID NO: 18119 - DNA, 40 bp, Artificial Sequence
  PCR primer for ORF amplification
tggaagtggttcaggaatgaatgtaacttctccaaaagat

SEQ ID NO: 18120 - DNA, 40 bp, Artificial Sequence
  PCR primer for ORF amplification
tggaagtggttcaggaatgacaattgaaagcactctagct

SEQ ID NO: 18121 - DNA, 40 bp, Artificial Sequence
  PCR primer for ORF amplification
tggaagtggttcaggaatgattgtggggttgacactttat

SEQ ID NO: 18122 - DNA, 40 bp, Artificial Sequence
  PCR primer for ORF amplification
tggaagtggttcaggaatgcaatctatgaatgtacaaccg

SEQ ID NO: 18123 - DNA, 40 bp, Artificial Sequence
  PCR primer for ORF amplification
tggaagtggttcaggaatggacatgactaaaaaccacacc

SEQ ID NO: 18124 - DNA, 40 bp, Artificial Sequence
  PCR primer for ORF amplification
tggaagtggttcaggaatggcgactgacaccgagaggtgt

SEQ ID NO: 18125 - DNA, 40 bp, Artificial Sequence
  PCR primer for ORF amplification
tggaagtggttcaggaatggtatatgaagcaacacctttt

SEQ ID NO: 18126 - DNA, 40 bp, Artificial Sequence
  PCR primer for ORF amplification
tggaagtggttcaggaatggttaacgttgtattgggctcc

SEQ ID NO: 18127 - DNA, 40 bp, Artificial Sequence
  PCR primer for ORF amplification
tggaagtggttcaggaatgtttgtttcaccaccaccagca

SEQ ID NO: 18128 - DNA, 40 bp, Artificial Sequence
  PCR primer for ORF amplification
tggaagtggttcaggaatgttttctttacctaccctaacc

SEQ ID NO: 18129 - DNA, 40 bp, Artificial Sequence
  PCR primer for ORF amplification
tggaagtggttcaggaatgaagactcagtactctctaata

SEQ ID NO: 18130 - DNA, 40 bp, Artificial Sequence
  PCR primer for ORF amplification
tggaagtggttcaggaatgagagaggaggggagtgaatta

SEQ ID NO: 18131 - DNA, 40 bp, Artificial Sequence
  PCR primer for ORF amplification
tggaagtggttcaggaatgagtaattcacttgaggagcgc

SEQ ID NO: 18132 - DNA, 40 bp, Artificial Sequence
  PCR primer for ORF amplification
tggaagtggttcaggaatgccaaattttcaaaaacctttt

SEQ ID NO: 18133 - DNA, 40 bp, Artificial Sequence
  PCR primer for ORF amplification
tggaagtggttcaggaatggccaccttggaagaattggat

SEQ ID NO: 18134 - DNA, 40 bp, Artificial Sequence
  PCR primer for ORF amplification
tggaagtggttcaggaatgtcaaacaagtttcactgtgac

SEQ ID NO: 18135 - DNA, 40 bp, Artificial Sequence
  PCR primer for ORF amplification
tggaagtggttcaggaatgtctcaacacgcaagctcatct

SEQ ID NO: 18136 - DNA, 40 bp, Artificial Sequence
  PCR primer for ORF amplification
tggaagtggttcaggaatgtctcaatacgcaagctcatcc

SEQ ID NO: 18137 - DNA, 40 bp, Artificial Sequence
  PCR primer for ORF amplification
tggaagtggttcaggaatgtctctgccaggttcgaaatta

SEQ ID NO: 18138 - DNA, 40 bp, Artificial Sequence
  PCR primer for ORF amplification
tggaagtggttcaggaatgtctgctgaaaccgccgccgca

SEQ ID NO: 18139 - DNA, 40 bp, Artificial Sequence
  PCR primer for ORF amplification
tggaagtggttcaggaatgttactgaaaaacttacacagt

SEQ ID NO: 18140 - DNA, 40 bp, Artificial Sequence
  PCR primer for ORF amplification
tggaagtggttcaggaatgaaggaagagctcagcaaagtg

SEQ ID NO: 18141 - DNA, 40 bp, Artificial Sequence
  PCR primer for ORF amplification
tggaagtggttcaggaatgaccactaacgaggaattcatt

SEQ ID NO: 18142 - DNA, 40 bp, Artificial Sequence
  PCR primer for ORF amplification
tggaagtggttcaggaatgcatagacgacagtttttccaa

SEQ ID NO: 18143 - DNA, 40 bp, Artificial Sequence
  PCR primer for ORF amplification
tggaagtggttcaggaatggactacaacaagagatcttcg

SEQ ID NO: 18144 - DNA, 40 bp, Artificial Sequence
  PCR primer for ORF amplification
tggaagtggttcaggaatgggagagaaccacgaccatgag

SEQ ID NO: 18145 - DNA, 40 bp, Artificial Sequence
  PCR primer for ORF amplification
tggaagtggttcaggaatggtggtgaacacgatatatatc

SEQ ID NO: 18146 - DNA, 40 bp, Artificial Sequence
  PCR primer for ORF amplification
tggaagtggttcaggaatgtcagattcagagggaggtcta

SEQ ID NO: 18147 - DNA, 40 bp, Artificial Sequence
  PCR primer for ORF amplification
tggaagtggttcaggaatgtccatgcaacaagtccaacat

SEQ ID NO: 18148 - DNA, 40 bp, Artificial Sequence
  PCR primer for ORF amplification
tggaagtggttcaggaatgtctggttatttttcagggttt

SEQ ID NO: 18149 - DNA, 40 bp, Artificial Sequence
  PCR primer for ORF amplification
tggaagtggttcaggaatgaccgtgctatatgctccttcg

SEQ ID NO: 18150 - DNA, 40 bp, Artificial Sequence
  PCR primer for ORF amplification
tggaagtggttcaggaatgatattactccaagtcatatgc

SEQ ID NO: 18151 - DNA, 40 bp, Artificial Sequence
  PCR primer for ORF amplification
tggaagtggttcaggaatggataccagcaaccacaaccaa

SEQ ID NO: 18152 - DNA, 40 bp, Artificial Sequence
  PCR primer for ORF amplification
tggaagtggttcaggaatggctagaaccaaaagtaggaag

SEQ ID NO: 18153 - DNA, 40 bp, Artificial Sequence
  PCR primer for ORF amplification
tggaagtggttcaggaatggctccaccaaagaaaaccgta

SEQ ID NO: 18154 - DNA, 40 bp, Artificial Sequence
  PCR primer for ORF amplification
tggaagtggttcaggaatgtcaaccaaaccagagaagcca

SEQ ID NO: 18155 - DNA, 40 bp, Artificial Sequence
  PCR primer for ORF amplification
tggaagtggttcaggaatgtcactgaatgacttcctaagt

SEQ ID NO: 18156 - DNA, 40 bp, Artificial Sequence
  PCR primer for ORF amplification
tggaagtggttcaggaatgttagaagcactgtttagagat

SEQ ID NO: 18157 - DNA, 40 bp, Artificial Sequence
  PCR primer for ORF amplification
tggaagtggttcaggaatggctgtctctaaagtttacgct

SEQ ID NO: 18158 - DNA, 40 bp, Artificial Sequence; identical to SEQ ID NO: 18157
  PCR primer for ORF amplification

SEQ ID NO: 18159 - DNA, 40 bp, Artificial Sequence
  PCR primer for ORF amplification
tggaagtggttcaggaatgtccatcacgaaggtacatgct

SEQ ID NO: 18160 - DNA, 40 bp, Artificial Sequence
  PCR primer for ORF amplification
tggaagtggttcaggaatgagcacgggagattttttaact

SEQ ID NO: 18161 - DNA, 40 bp, Artificial Sequence
  PCR primer for ORF amplification
tggaagtggttcaggaatgagtgaagaacaggacccttta

SEQ ID NO: 18162 - DNA, 40 bp, Artificial Sequence
  PCR primer for ORF amplification
tggaagtggttcaggaatgccaaaaaaggtttggaaatca

SEQ ID NO: 18163 - DNA, 40 bp, Artificial Sequence
  PCR primer for ORF amplification
tggaagtggttcaggaatggataacgaggttgaaaaaaat

SEQ ID NO: 18164 - DNA, 40 bp, Artificial Sequence
  PCR primer for ORF amplification
tggaagtggttcaggaatggctctcaataaactaaagaat

SEQ ID NO: 18165 - DNA, 40 bp, Artificial Sequence
  PCR primer for ORF amplification
tggaagtggttcaggaatgggacaaggtgtatcatctgga

SEQ ID NO: 18166 - DNA, 40 bp, Artificial Sequence
  PCR primer for ORF amplification
tggaagtggttcaggaatgggggattctaattccagccaa

SEQ ID NO: 18167 - DNA, 40 bp, Artificial Sequence
  PCR primer for ORF amplification
tggaagtggttcaggaatgtcagctttattaccaagatta

SEQ ID NO: 18168 - DNA, 40 bp, Artificial Sequence
  PCR primer for ORF amplification
tggaagtggttcaggaatgagtagaggcaaactggaagat

SEQ ID NO: 18169 - DNA, 40 bp, Artificial Sequence
  PCR primer for ORF amplification
tggaagtggttcaggaatggaaacaccacccattgtgatt

SEQ ID NO: 18170 - DNA, 40 bp, Artificial Sequence
  PCR primer for ORF amplification
tggaagtggttcaggaatggtatcagctttgaatcccaga

SEQ ID NO: 18171 - DNA, 40 bp, Artificial Sequence
  PCR primer for ORF amplification
tggaagtggttcaggaatgaaacggttcttactcagtcga

SEQ ID NO: 18172 - DNA, 40 bp, Artificial Sequence
  PCR primer for ORF amplification
tggaagtggttcaggaatgaaactcggaagcaaacaggta

SEQ ID NO: 18173 - DNA, 40 bp, Artificial Sequence
  PCR primer for ORF amplification
tggaagtggttcaggaatggacttactgggcgatatagtg

SEQ ID NO: 18174 - DNA, 40 bp, Artificial Sequence
  PCR primer for ORF amplification
tggaagtggttcaggaatggtcacaaaacatcagattgaa

SEQ ID NO: 18175 - DNA, 40 bp, Artificial Sequence
  PCR primer for ORF amplification
tggaagtggttcaggaatgaatgactaccatctcgaggat

SEQ ID NO: 18176 - DNA, 40 bp, Artificial Sequence
  PCR primer for ORF amplification
tggaagtggttcaggaatgatcagaacatcatctatatta

SEQ ID NO: 18177 - DNA, 40 bp, Artificial Sequence
  PCR primer for ORF amplification
tggaagtggttcaggaatgcttgctgtcagaagattaaca

SEQ ID NO: 18178 - DNA, 40 bp, Artificial Sequence
  PCR primer for ORF amplification
tggaagtggttcaggaatggatagatatcaaagaaagata

SEQ ID NO: 18179 - DNA, 40 bp, Artificial Sequence
  PCR primer for ORF amplification
tggaagtggttcaggaatggatgaaattcttgccaaagca

SEQ ID NO: 18180 - DNA, 40 bp, Artificial Sequence
  PCR primer for ORF amplification
tggaagtggttcaggaatgtcactttcaaataagactgta

SEQ ID NO: 18181 - DNA, 40 bp, Artificial Sequence
  PCR primer for ORF amplification
tggaagtggttcaggaatgtcgaagacaagatactatttg

SEQ ID NO: 18182 - DNA, 40 bp, Artificial Sequence
  PCR primer for ORF amplification
tggaagtggttcaggaatgtctgaaaataacgaattccag

SEQ ID NO: 18183 - DNA, 40 bp, Artificial Sequence
  PCR primer for ORF amplification
tggaagtggttcaggaatgagaatatcatcaacattgctt

SEQ ID NO: 18184 - DNA, 40 bp, Artificial Sequence
  PCR primer for ORF amplification
tggaagtggttcaggaatgagctcgacgatgttggatgat

SEQ ID NO: 18185 - DNA, 40 bp, Artificial Sequence
  PCR primer for ORF amplification
tggaagtggttcaggaatgagtagcacgatattttaccgc

SEQ ID NO: 18186 - DNA, 40 bp, Artificial Sequence
  PCR primer for ORF amplification
tggaagtggttcaggaatggccccaaatcaaagatcacgt

SEQ ID NO: 18187 - DNA, 40 bp, Artificial Sequence
  PCR primer for ORF amplification
tggaagtggttcaggaatgaataggactgtctttttggca

SEQ ID NO: 18188 - DNA, 40 bp, Artificial Sequence
  PCR primer for ORF amplification
tggaagtggttcaggaatgagtaatttcattagaaggcta

SEQ ID NO: 18189 - DNA, 40 bp, Artificial Sequence
  PCR primer for ORF amplification
tggaagtggttcaggaatgatcaccggtaaagaattgaga

SEQ ID NO: 18190 - DNA, 40 bp, Artificial Sequence
  PCR primer for ORF amplification
tggaagtggttcaggaatgcggctggggaatgcttatgcg

SEQ ID NO: 18191 - DNA, 40 bp, Artificial Sequence
  PCR primer for ORF amplification
tggaagtggttcaggaatggccctctttctcagtaagaga

SEQ ID NO: 18192 - DNA, 40 bp, Artificial Sequence
  PCR primer for ORF amplification
tggaagtggttcaggaatgtcaactgaacaagatgctgtt

SEQ ID NO: 18193 - DNA, 40 bp, Artificial Sequence
  PCR primer for ORF amplification
tggaagtggttcaggaatgtcaagaagagtggttatcaca

SEQ ID NO: 18194 - DNA, 40 bp, Artificial Sequence
  PCR primer for ORF amplification
tggaagtggttcaggaatgaaatacaaggaaatcaatttc

SEQ ID NO: 18195 - DNA, 40 bp, Artificial Sequence
  PCR primer for ORF amplification
tggaagtggttcaggaatgaacagtacacctcctacgtca

SEQ ID NO: 18196 - DNA, 40 bp, Artificial Sequence
  PCR primer for ORF amplification
tggaagtggttcaggaatgagaggctttagtaatgagata

SEQ ID NO: 18197 - DNA, 40 bp, Artificial Sequence
  PCR primer for ORF amplification
tggaagtggttcaggaatgagtatggataacaatgatgac

SEQ ID NO: 18198 - DNA, 40 bp, Artificial Sequence
  PCR primer for ORF amplification
tggaagtggttcaggaatgtcaagagatgtaagggcagag

SEQ ID NO: 18199 - DNA, 40 bp, Artificial Sequence
  PCR primer for ORF amplification
tggaagtggttcaggaatgtcattaccgttcttaacttct

SEQ ID NO: 18200 - DNA, 40 bp, Artificial Sequence
  PCR primer for ORF amplification
tggaagtggttcaggaatgtctttataccctttacaaaga

SEQ ID NO: 18201 - DNA, 40 bp, Artificial Sequence
  PCR primer for ORF amplification
tggaagtggttcaggaatgaaacaacgattcattcgtcaa

SEQ ID NO: 18202 - DNA, 40 bp, Artificial Sequence
  PCR primer for ORF amplification
tggaagtggttcaggaatgaacgtcgttgtgtgctccggt

SEQ ID NO: 18203 - DNA, 40 bp, Artificial Sequence
  PCR primer for ORF amplification
tggaagtggttcaggaatgactacaagaaagacagcttcc

SEQ ID NO: 18204 - DNA, 40 bp, Artificial Sequence
  PCR primer for ORF amplification
tggaagtggttcaggaatgagcgtcattcatcctttgcag

SEQ ID NO: 18205 - DNA, 40 bp, Artificial Sequence
  PCR primer for ORF amplification
tggaagtggttcaggaatgcaattacattcacttatcgct

SEQ ID NO: 18206 - DNA, 40 bp, Artificial Sequence
  PCR primer for ORF amplification
tggaagtggttcaggaatgccatctcatttcgatactgtt

SEQ ID NO: 18207 - DNA, 40 bp, Artificial Sequence
  PCR primer for ORF amplification
tggaagtggttcaggaatggagtatggacatcacgctaga

SEQ ID NO: 18208 - DNA, 40 bp, Artificial Sequence
  PCR primer for ORF amplification
tggaagtggttcaggaatgggaaagctattacaattggca

SEQ ID NO: 18209 - DNA, 40 bp, Artificial Sequence
  PCR primer for ORF amplification
tggaagtggttcaggaatgtttcatggcgctaaaggacct

SEQ ID NO: 18210 - DNA, 40 bp, Artificial Sequence
  PCR primer for ORF amplification
tggaagtggttcaggaatgtttgtttcaccacctccagca

SEQ ID NO: 18211 - DNA, 40 bp, Artificial Sequence
  PCR primer for ORF amplification
tggaagtggttcaggaatgatgatgttaattactatgaaa

SEQ ID NO: 18212 - DNA, 40 bp, Artificial Sequence
  PCR primer for ORF amplification
tggaagtggttcaggaatggcaagtctacctggtattgat

SEQ ID NO: 18213 - DNA, 40 bp, Artificial Sequence
  PCR primer for ORF amplification
tggaagtggttcaggaatggtttcgttcagagggctgact

SEQ ID NO: 18214 - DNA, 40 bp, Artificial Sequence
  PCR primer for ORF amplification
tggaagtggttcaggaatgtcaagagatgcaccaattaag

SEQ ID NO: 18215 - DNA, 40 bp, Artificial Sequence
  PCR primer for ORF amplification
tggaagtggttcaggaatgtccaaaaaacaggaatatatt

SEQ ID NO: 18216 - DNA, 40 bp, Artificial Sequence
  PCR primer for ORF amplification
tggaagtggttcaggaatgtcccatgacggaaaagaagaa

SEQ ID NO: 18217 - DNA, 40 bp, Artificial Sequence
  PCR primer for ORF amplification
tggaagtggttcaggaatgttcaagtcaactttaaactcc

SEQ ID NO: 18218 - DNA, 40 bp, Artificial Sequence
  PCR primer for ORF amplification
tggaagtggttcaggaatgaatgccctaaaatatttctca

SEQ ID NO: 18219 - DNA, 40 bp, Artificial Sequence
  PCR primer for ORF amplification
tggaagtggttcaggaatgattataaggcgcttattttca

SEQ ID NO: 18220 - DNA, 40 bp, Artificial Sequence
  PCR primer for ORF amplification
tggaagtggttcaggaatgcacgtactgctgagcaaaaaa

SEQ ID NO: 18221 - DNA, 40 bp, Artificial Sequence
  PCR primer for ORF amplification
tggaagtggttcaggaatggacgacaaagtttcagaaaag

SEQ ID NO: 18222 - DNA, 40 bp, Artificial Sequence
  PCR primer for ORF amplification
tggaagtggttcaggaatgggaaagaacgttttgttgcta

SEQ ID NO: 18223 - DNA, 40 bp, Artificial Sequence
  PCR primer for ORF amplification
tggaagtggttcaggaatgtcacacgaaggtgaagaagat

SEQ ID NO: 18224 - DNA, 40 bp, Artificial Sequence
  PCR primer for ORF amplification
tggaagtggttcaggaatgtcagcaaacagtggtgtaaaa

SEQ ID NO: 18225 - DNA, 40 bp, Artificial Sequence
  PCR primer for ORF amplification
tggaagtggttcaggaatgacttcagtatcgccctcgcca

SEQ ID NO: 18226 - DNA, 40 bp, Artificial Sequence
  PCR primer for ORF amplification
tggaagtggttcaggaatgcccaaggagtcagaggtcata

SEQ ID NO: 18227 - DNA, 40 bp, Artificial Sequence
  PCR primer for ORF amplification
tggaagtggttcaggaatggtagagaaggatacatggaaa

SEQ ID NO: 18228 - DNA, 40 bp, Artificial Sequence
  PCR primer for ORF amplification
tggaagtggttcaggaatgtcatcgcaaaacctcaatgat

SEQ ID NO: 18229 - DNA, 40 bp, Artificial Sequence
  PCR primer for ORF amplification
tggaagtggttcaggaatgctttcgcttaaaacgttactg

SEQ ID NO: 18230 - DNA, 40 bp, Artificial Sequence
  PCR primer for ORF amplification
tggaagtggttcaggaatggaggttgataacaaaaggaga

SEQ ID NO: 18231 - DNA, 40 bp, Artificial Sequence
  PCR primer for ORF amplification
tggaagtggttcaggaatggatgttcgtcgacctataagg

SEQ ID NO: 18232 - DNA, 40 bp, Artificial Sequence
  PCR primer for ORF amplification
tggaagtggttcaggaatggcaccggaaatttttgttaaa

SEQ ID NO: 18233 - DNA, 40 bp, Artificial Sequence
  PCR primer for ORF amplification
tggaagtggttcaggaatgggctccaaaaaactgaccgta

SEQ ID NO: 18234 - DNA, 40 bp, Artificial Sequence
  PCR primer for ORF amplification
tggaagtggttcaggaatgggcttggaccaggacaagata

SEQ ID NO: 18235 - DNA, 40 bp, Artificial Sequence
  PCR primer for ORF amplification
tggaagtggttcaggaatggtagctagtattagatcaggt

SEQ ID NO: 18236 - DNA, 40 bp, Artificial Sequence
  PCR primer for ORF amplification
tggaagtggttcaggaatggtgatgtcaagaatacgagat

SEQ ID NO: 18237 - DNA, 40 bp, Artificial Sequence
  PCR primer for ORF amplification
tggaagtggttcaggaatgttgcgacttttttcactggca

SEQ ID NO: 18238 - DNA, 40 bp, Artificial Sequence
  PCR primer for ORF amplification
tggaagtggttcaggaatgcgtctaaaagaattgttacct

SEQ ID NO: 18239 - DNA, 40 bp, Artificial Sequence
  PCR primer for ORF amplification
tggaagtggttcaggaatgctagtaaataaagtgataggg

SEQ ID NO: 18240 - DNA, 40 bp, Artificial Sequence
  PCR primer for ORF amplification
tggaagtggttcaggaatgggtctctgcgcatcttcagaa

SEQ ID NO: 18241 - DNA, 40 bp, Artificial Sequence
  PCR primer for ORF amplification
tggaagtggttcaggaatgtcatacttaaacaatcccgct

SEQ ID NO: 18242 - DNA, 40 bp, Artificial Sequence
  PCR primer for ORF amplification
tggaagtggttcaggaatgtctgctccagctcaaaactac

SEQ ID NO: 18243 - DNA, 40 bp, Artificial Sequence
  PCR primer for ORF amplification
tggaagtggttcaggaatgtttttggaaattcctcggtgg

SEQ ID NO: 18244 - DNA, 40 bp, Artificial Sequence
  PCR primer for ORF amplification
tggaagtggttcaggaatgaaagtagatttaccagaatcc

SEQ ID NO: 18245 - DNA, 40 bp, Artificial Sequence
  PCR primer for ORF amplification
tggaagtggttcaggaatgacttcggataaacaccttttt

SEQ ID NO: 18246 - DNA, 40 bp, Artificial Sequence
  PCR primer for ORF amplification
tggaagtggttcaggaatgctacgtatgtcaacttcaaga

SEQ ID NO: 18247 - DNA, 40 bp, Artificial Sequence
  PCR primer for ORF amplification
tggaagtggttcaggaatggctaaagatttattgcccaag

SEQ ID NO: 18248 - DNA, 40 bp, Artificial Sequence
  PCR primer for ORF amplification
tggaagtggttcaggaatggtcaatagtaagaggcagcag

SEQ ID NO: 18249 - DNA, 40 bp, Artificial Sequence
  PCR primer for ORF amplification
tggaagtggttcaggaatgtcctcaagatatagagtggaa

SEQ ID NO: 18250 - DNA, 40 bp, Artificial Sequence
  PCR primer for ORF amplification
tggaagtggttcaggaatgactgatgatgaaaagagggag

SEQ ID NO: 18251 - DNA, 40 bp, Artificial Sequence
  PCR primer for ORF amplification
tggaagtggttcaggaatgagtaggaatcaagatgtgttc

SEQ ID NO: 18252 - DNA, 40 bp, Artificial Sequence
  PCR primer for ORF amplification
tggaagtggttcaggaatggacggaaatgatcacaaagtc

SEQ ID NO: 18253 - DNA, 40 bp, Artificial Sequence
  PCR primer for ORF amplification
tggaagtggttcaggaatggatcaagaaacaatagacact

SEQ ID NO: 18254 - DNA, 40 bp, Artificial Sequence
  PCR primer for ORF amplification
tggaagtggttcaggaatgtcagaagtttccaaatggcca

SEQ ID NO: 18255 - DNA, 40 bp, Artificial Sequence
  PCR primer for ORF amplification
tggaagtggttcaggaatgtcagagttgagagccttcagt

SEQ ID NO: 18256 - DNA, 40 bp, Artificial Sequence
  PCR primer for ORF amplification
tggaagtggttcaggaatgttgaggacgaggcttactaat

SEQ ID NO: 18257 - DNA, 40 bp, Artificial Sequence
  PCR primer for ORF amplification
tggaagtggttcaggaatggccgtatcagcccgtttgaga

SEQ ID NO: 18258 - DNA, 40 bp, Artificial Sequence
  PCR primer for ORF amplification
tggaagtggttcaggaatggctaatactttcaagtattat

SEQ ID NO: 18259 - DNA, 40 bp, Artificial Sequence
  PCR primer for ORF amplification
tggaagtggttcaggaatggggtacagtactatttccaac

SEQ ID NO: 18260 - DNA, 40 bp, Artificial Sequence
  PCR primer for ORF amplification
tggaagtggttcaggaatgggtagaagaaaaattgaaatt

SEQ ID NO: 18261 - DNA, 40 bp, Artificial Sequence
  PCR primer for ORF amplification
tggaagtggttcaggaatggtatcagaggataagattgag

SEQ ID NO: 18262 - DNA, 40 bp, Artificial Sequence
  PCR primer for ORF amplification
tggaagtggttcaggaatgtcatcatctgcgattaaaata

SEQ ID NO: 18263 - DNA, 40 bp, Artificial Sequence
  PCR primer for ORF amplification
tggaagtggttcaggaatgtctggaacatttagttatgat

SEQ ID NO: 18264 - DNA, 40 bp, Artificial Sequence
  PCR primer for ORF amplification
tggaagtggttcaggaatgtgcgtgtacaagtcaaattcg

SEQ ID NO: 18265 - DNA, 40 bp, Artificial Sequence
  PCR primer for ORF amplification
tggaagtggttcaggaatgaacaacacttccataaccgga

SEQ ID NO: 18266 - DNA, 40 bp, Artificial Sequence
  PCR primer for ORF amplification
tggaagtggttcaggaatgatggatatcagccctacctgt

SEQ ID NO: 18267 - DNA, 40 bp, Artificial Sequence
  PCR primer for ORF amplification
tggaagtggttcaggaatgattcaaacgcaaagtacagcg

SEQ ID NO: 18268 - DNA, 40 bp, Artificial Sequence
  PCR primer for ORF amplification
tggaagtggttcaggaatgcctgacaataatacggagcaa

SEQ ID NO: 18269 - DNA, 40 bp, Artificial Sequence
  PCR primer for ORF amplification
tggaagtggttcaggaatgcttttaataaagaggtacttg

SEQ ID NO: 18270 - DNA, 40 bp, Artificial Sequence
  PCR primer for ORF amplification
tggaagtggttcaggaatggaactgaatcaggttttagaa

SEQ ID NO: 18271 - DNA, 40 bp, Artificial Sequence
  PCR primer for ORF amplification
tggaagtggttcaggaatggagaaagctttggaattagac

SEQ ID NO: 18272 - DNA, 40 bp, Artificial Sequence
  PCR primer for ORF amplification
tggaagtggttcaggaatggccaagagaagacaaaagaaa

SEQ ID NO: 18273 - DNA, 40 bp, Artificial Sequence
  PCR primer for ORF amplification
tggaagtggttcaggaatggctaaaagaaggcagaaaaag

SEQ ID NO: 18274 - DNA, 40 bp, Artificial Sequence
  PCR primer for ORF amplification
tggaagtggttcaggaatgtactcatttgaactggacaaa

SEQ ID NO: 18275 - DNA, 40 bp, Artificial Sequence
  PCR primer for ORF amplification
tggaagtggttcaggaatgtctgaaaataacgaagaacaa

SEQ ID NO: 18276 - DNA, 40 bp, Artificial Sequence
  PCR primer for ORF amplification
tggaagtggttcaggaatgtttgatcttaagacgattctc

SEQ ID NO: 18277 - DNA, 40 bp, Artificial Sequence
  PCR primer for ORF amplification
tggaagtggttcaggaatgcatgggcctacttcaaaagct

SEQ ID NO: 18278 - DNA, 40 bp, Artificial Sequence
  PCR primer for ORF amplification
tggaagtggttcaggaatgctgaaatacaggtctttgcca

SEQ ID NO: 18279 - DNA, 40 bp, Artificial Sequence
  PCR primer for ORF amplification
tggaagtggttcaggaatgtcagagccagaatttcaacaa

SEQ ID NO: 18280 - DNA, 40 bp, Artificial Sequence
  PCR primer for ORF amplification
tggaagtggttcaggaatgtcctcttccatcgatatcagt

SEQ ID NO: 18281 - DNA, 40 bp, Artificial Sequence
  PCR primer for ORF amplification
tggaagtggttcaggaatgtcgaaacaatttgttagatct

SEQ ID NO: 18282 - DNA, 40 bp, Artificial Sequence
  PCR primer for ORF amplification
tggaagtggttcaggaatgactatatctactcttagtaac

SEQ ID NO: 18283 - DNA, 40 bp, Artificial Sequence
  PCR primer for ORF amplification
tggaagtggttcaggaatggacatggccaaccagttgcta

SEQ ID NO: 18284 - DNA, 40 bp, Artificial Sequence
  PCR primer for ORF amplification
tggaagtggttcaggaatggatatatttaggcatactttt

SEQ ID NO: 18285 - DNA, 40 bp, Artificial Sequence
  PCR primer for ORF amplification
tggaagtggttcaggaatggctccaactaatctaaccaag

SEQ ID NO: 18286 - DNA, 40 bp, Artificial Sequence
  PCR primer for ORF amplification
tggaagtggttcaggaatgggtttagtagacggttatgac

SEQ ID NO: 18287 - DNA, 40 bp, Artificial Sequence
  PCR primer for ORF amplification
tggaagtggttcaggaatgtcaaaattgttcttagatgaa

SEQ ID NO: 18288 - DNA, 40 bp, Artificial Sequence
  PCR primer for ORF amplification
tggaagtggttcaggaatgtcagaagaggataaagcgaaa

SEQ ID NO: 18289 - DNA, 40 bp, Artificial Sequence
  PCR primer for ORF amplification
tggaagtggttcaggaatgttacaaaagctttccatgacc

SEQ ID NO: 18290 - DNA, 40 bp, Artificial Sequence
  PCR primer for ORF amplification
tggaagtggttcaggaatgaccggtgattccagaagcatc

SEQ ID NO: 18291 - DNA, 40 bp, Artificial Sequence
  PCR primer for ORF amplification
tggaagtggttcaggaatgcaacctaaaactttcgtccac

SEQ ID NO: 18292 - DNA, 40 bp, Artificial Sequence
  PCR primer for ORF amplification
tggaagtggttcaggaatgcccacacctatgacgcctgtc

SEQ ID NO: 18293 - DNA, 40 bp, Artificial Sequence
  PCR primer for ORF amplification
tggaagtggttcaggaatgtcagagaaggcttctgaagag

SEQ ID NO: 18294 - DNA, 40 bp, Artificial Sequence
  PCR primer for ORF amplification
tggaagtggttcaggaatgtcatttcgtaaaagaggtgaa

SEQ ID NO: 18295 - DNA, 40 bp, Artificial Sequence
  PCR primer for ORF amplification
tggaagtggttcaggaatgtccagttcacaacaaatagcc

SEQ ID NO: 18296 - DNA, 40 bp, Artificial Sequence
  PCR primer for ORF amplification
tggaagtggttcaggaatgtcggataagccgattgacata

SEQ ID NO: 18297 - DNA, 40 bp, Artificial Sequence
  PCR primer for ORF amplification
tggaagtggttcaggaatgttgagatactatggggcgaca

SEQ ID NO: 18298 - DNA, 40 bp, Artificial Sequence
  PCR primer for ORF amplification
tggaagtggttcaggaatgtttcgctcgggttactatcca

SEQ ID NO: 18299 - DNA, 40 bp, Artificial Sequence
  PCR primer for ORF amplification
tggaagtggttcaggaatgacaagcgaaccagagtttcag

SEQ ID NO: 18300 - DNA, 40 bp, Artificial Sequence
  PCR primer for ORF amplification
tggaagtggttcaggaatgacagcactagattctcgaaac

SEQ ID NO: 18301 - DNA, 40 bp, Artificial Sequence
  PCR primer for ORF amplification
tggaagtggttcaggaatgagagaaatcattcatatctcg

SEQ ID NO: 18302 - DNA, 40 bp, Artificial Sequence
  PCR primer for ORF amplification
tggaagtggttcaggaatgctaagaacagtaacttcaaag

SEQ ID NO: 18303 - DNA, 40 bp, Artificial Sequence
  PCR primer for ORF amplification
tggaagtggttcaggaatgctaatagacgcaattcatggt

SEQ ID NO: 18304 - DNA, 40 bp, Artificial Sequence
  PCR primer for ORF amplification
tggaagtggttcaggaatggttagctcactggcatcaaat

SEQ ID NO: 18305 - DNA, 40 bp, Artificial Sequence
  PCR primer for ORF amplification
tggaagtggttcaggaatgtctgacaaccctgagatgaaa

SEQ ID NO: 18306 - DNA, 40 bp, Artificial Sequence
  PCR primer for ORF amplification
tggaagtggttcaggaatgggtaaagagaagtctcacatt

SEQ ID NO: 18307 - DNA, 40 bp, Artificial Sequence
  PCR primer for ORF amplification
tggaagtggttcaggaatgaaggatgtcttacaatgggcg

SEQ ID NO: 18308 - DNA, 40 bp, Artificial Sequence
  PCR primer for ORF amplification
tggaagtggttcaggaatgaatatgctcattgtcggtaga

SEQ ID NO: 18309 - DNA, 40 bp, Artificial Sequence
  PCR primer for ORF amplification
tggaagtggttcaggaatgaccgatgagaaacgagctttt

SEQ ID NO: 18310 - DNA, 40 bp, Artificial Sequence
  PCR primer for ORF amplification
tggaagtggttcaggaatgatcgtcaatattagtgcgaag

SEQ ID NO: 18311 - DNA, 40 bp, Artificial Sequence
  PCR primer for ORF amplification
tggaagtggttcaggaatggaaggtgaacagtctccgcaa

SEQ ID NO: 18312 - DNA, 40 bp, Artificial Sequence
  PCR primer for ORF amplification
tggaagtggttcaggaatggttgccaattgggtacttgct

SEQ ID NO: 18313 - DNA, 40 bp, Artificial Sequence
  PCR primer for ORF amplification
tggaagtggttcaggaatgtaccaaggcccaccgcaaccg

SEQ ID NO: 18314 - DNA, 40 bp, Artificial Sequence
  PCR primer for ORF amplification
tggaagtggttcaggaatgtctaacgaattacggcttgaa

SEQ ID NO: 18315 - DNA, 40 bp, Artificial Sequence
  PCR primer for ORF amplification
tggaagtggttcaggaatgacagcagctaataagaatatt

SEQ ID NO: 18316 - DNA, 40 bp, Artificial Sequence
  PCR primer for ORF amplification
tggaagtggttcaggaatgaccgaaaaccaaaccgcacat

SEQ ID NO: 18317 - DNA, 40 bp, Artificial Sequence
  PCR primer for ORF amplification
tggaagtggttcaggaatgagtggcagtgatagaggagac

SEQ ID NO: 18318 - DNA, 40 bp, Artificial Sequence
  PCR primer for ORF amplification
tggaagtggttcaggaatgccgtcaaacgtacgttcggga

SEQ ID NO: 18319 - DNA, 40 bp, Artificial Sequence
  PCR primer for ORF amplification
tggaagtggttcaggaatggttttagcaatggaaagtaga

SEQ ID NO: 18320 - DNA, 40 bp, Artificial Sequence
  PCR primer for ORF amplification
tggaagtggttcaggaatgtcatttagattcaacgaagct

SEQ ID NO: 18321 - DNA, 40 bp, Artificial Sequence
  PCR primer for ORF amplification
tggaagtggttcaggaatgtcctctgcaattgacaatctc

SEQ ID NO: 18322 - DNA, 40 bp, Artificial Sequence
  PCR primer for ORF amplification
tggaagtggttcaggaatgacagaagataaatcgcaggtt

SEQ ID NO: 18323 - DNA, 40 bp, Artificial Sequence
  PCR primer for ORF amplification
tggaagtggttcaggaatgacagttccttatctaaattca

SEQ ID NO: 18324 - DNA, 40 bp, Artificial Sequence
  PCR primer for ORF amplification
tggaagtggttcaggaatgagcactttagatattgcagaa

SEQ ID NO: 18325 - DNA, 40 bp, Artificial Sequence
  PCR primer for ORF amplification
tggaagtggttcaggaatgatgcttgaagggtatacggta

SEQ ID NO: 18326 - DNA, 40 bp, Artificial Sequence
  PCR primer for ORF amplification
tggaagtggttcaggaatgcctagggccttatcaataaaa

SEQ ID NO: 18327 - DNA, 40 bp, Artificial Sequence
  PCR primer for ORF amplification
tggaagtggttcaggaatgcctatcaatgccatcacttcc

SEQ ID NO: 18328 - DNA, 40 bp, Artificial Sequence
  PCR primer for ORF amplification
tggaagtggttcaggaatgtccaacaagctgttcaggtta

SEQ ID NO: 18329 - DNA, 40 bp, Artificial Sequence
  PCR primer for ORF amplification
tggaagtggttcaggaatgtctgaatcagtggccattata

SEQ ID NO: 18330 - DNA, 40 bp, Artificial Sequence
  PCR primer for ORF amplification
tggaagtggttcaggaatgatgatgttccataattgcaga

SEQ ID NO: 18331 - DNA, 40 bp, Artificial Sequence
  PCR primer for ORF amplification
tggaagtggttcaggaatggaagaatttgaagaatttcga

SEQ ID NO: 18332 - DNA, 40 bp, Artificial Sequence
  PCR primer for ORF amplification
tggaagtggttcaggaatggctcctgtagttatttcagaa

SEQ ID NO: 18333 - DNA, 40 bp, Artificial Sequence
  PCR primer for ORF amplification
tggaagtggttcaggaatgggtatacctatgcaaatatac

SEQ ID NO: 18334 - DNA, 40 bp, Artificial Sequence
  PCR primer for ORF amplification
tggaagtggttcaggaatgaaaatacaacttgtaagatgg

SEQ ID NO: 18335 - DNA, 40 bp, Artificial Sequence
  PCR primer for ORF amplification
tggaagtggttcaggaatgagcgaaataaataatgaaaat

SEQ ID NO: 18336 - DNA, 40 bp, Artificial Sequence
  PCR primer for ORF amplification
tggaagtggttcaggaatgagtgacgaaaccatgcctgta

SEQ ID NO: 18337 - DNA, 40 bp, Artificial Sequence
  PCR primer for ORF amplification
tggaagtggttcaggaatgagttactttcctcgaacatat

SEQ ID NO: 18338 - DNA, 40 bp, Artificial Sequence
  PCR primer for ORF amplification
tggaagtggttcaggaatgcaaagaaataataggttaaga

SEQ ID NO: 18339 - DNA, 40 bp, Artificial Sequence
  PCR primer for ORF amplification
tggaagtggttcaggaatgcccgctcgagaatataactat

SEQ ID NO: 18340 - DNA, 40 bp, Artificial Sequence
  PCR primer for ORF amplification
tggaagtggttcaggaatggaaagatatgatagacagctg

SEQ ID NO: 18341 - DNA, 40 bp, Artificial Sequence
  PCR primer for ORF amplification
tggaagtggttcaggaatgttggacatcaaccaatttatc

SEQ ID NO: 18342 - DNA, 40 bp, Artificial Sequence
  PCR primer for ORF amplification
tggaagtggttcaggaatgttttcaagaacagcatccaag

SEQ ID NO: 18343 - DNA, 40 bp, Artificial Sequence
  PCR primer for ORF amplification
tggaagtggttcaggaatgaaccgtattactaggaaaagt

SEQ ID NO: 18344 - DNA, 40 bp, Artificial Sequence
  PCR primer for ORF amplification
tggaagtggttcaggaatgaggttactagtcagctgtgtg

SEQ ID NO: 18345 - DNA, 40 bp, Artificial Sequence
  PCR primer for ORF amplification
tggaagtggttcaggaatgcctaccattttatacaacacc

SEQ ID NO: 18346 - DNA, 40 bp, Artificial Sequence
  PCR primer for ORF amplification
tggaagtggttcaggaatgctttccagagcgacgcgtact

SEQ ID NO: 18347 - DNA, 40 bp, Artificial Sequence
  PCR primer for ORF amplification
tggaagtggttcaggaatggtcgctatcagtgaagtcaaa

SEQ ID NO: 18348 - DNA, 40 bp, Artificial Sequence
  PCR primer for ORF amplification
tggaagtggttcaggaatgtcagacggcactcaaaaacta

SEQ ID NO: 18349 - DNA, 40 bp, Artificial Sequence
  PCR primer for ORF amplification
tggaagtggttcaggaatgtcgaagaaatttagctctaaa

SEQ ID NO: 18350 - DNA, 40 bp, Artificial Sequence
  PCR primer for ORF amplification
tggaagtggttcaggaatgtggaaataccttcatagatca

SEQ ID NO: 18351 - DNA, 40 bp, Artificial Sequence
  PCR primer for ORF amplification
tggaagtggttcaggaatgaggtttctttcaaaaaggata

SEQ ID NO: 18352 - DNA, 40 bp, Artificial Sequence
  PCR primer for ORF amplification
tggaagtggttcaggaatgccactgaaacgctccttaaaa

SEQ ID NO: 18353 - DNA, 40 bp, Artificial Sequence
  PCR primer for ORF amplification
tggaagtggttcaggaatgccagaagatacaagctatagc

SEQ ID NO: 18354 - DNA, 40 bp, Artificial Sequence
  PCR primer for ORF amplification
tggaagtggttcaggaatggctttgactcagtttgaaaat

SEQ ID NO: 18355 - DNA, 40 bp, Artificial Sequence
  PCR primer for ORF amplification
tggaagtggttcaggaatgggaagcgtgaactcatcaccg

SEQ ID NO: 18356 - DNA, 40 bp, Artificial Sequence
  PCR primer for ORF amplification
tggaagtggttcaggaatgggacaaattctatcaaacccg

SEQ ID NO: 18357 - DNA, 40 bp, Artificial Sequence
  PCR primer for ORF amplification
tggaagtggttcaggaatgtcatctgaaagcccacaggat

SEQ ID NO: 18358 - DNA, 40 bp, Artificial Sequence
  PCR primer for ORF amplification
tggaagtggttcaggaatgacattattttcttgtagtgta

SEQ ID NO: 18359 - DNA, 40 bp, Artificial Sequence
  PCR primer for ORF amplification
tggaagtggttcaggaatgagtaaatatattgcacttgaa

SEQ ID NO: 18360 - DNA, 40 bp, Artificial Sequence
  PCR primer for ORF amplification
tggaagtggttcaggaatgagtagtgaactcatgttcaac

SEQ ID NO: 18361 - DNA, 40 bp, Artificial Sequence
  PCR primer for ORF amplification
tggaagtggttcaggaatgccgatcaagagattagataca

SEQ ID NO: 18362 - DNA, 40 bp, Artificial Sequence
  PCR primer for ORF amplification
tggaagtggttcaggaatgcgtggagaatggcaggaattt

SEQ ID NO: 18363 - DNA, 40 bp, Artificial Sequence
  PCR primer for ORF amplification
tggaagtggttcaggaatgctaagatcaaatttatgcaga

SEQ ID NO: 18364 - DNA, 40 bp, Artificial Sequence
  PCR primer for ORF amplification
tggaagtggttcaggaatggacgggcataatcagaaccag

SEQ ID NO: 18365 - DNA, 40 bp, Artificial Sequence
  PCR primer for ORF amplification
tggaagtggttcaggaatggcccgcaatagacaagcgtgc

SEQ ID NO: 18366 - DNA, 40 bp, Artificial Sequence
  PCR primer for ORF amplification
tggaagtggttcaggaatggcgtttgaggattatttttct

SEQ ID NO: 18367 - DNA, 40 bp, Artificial Sequence
  PCR primer for ORF amplification
tggaagtggttcaggaatgccatttaatcataatagcaag

SEQ ID NO: 18368 - DNA, 40 bp, Artificial Sequence
  PCR primer for ORF amplification
tggaagtggttcaggaatgtctagtactcaagtaggaaat

SEQ ID NO: 18369 - DNA, 40 bp, Artificial Sequence
  PCR primer for ORF amplification
tggaagtggttcaggaatgtacgagtactgctcagttgta

SEQ ID NO: 18370 - DNA, 40 bp, Artificial Sequence
  PCR primer for ORF amplification
tggaagtggttcaggaatgttgaagtcagccgtttattca

SEQ ID NO: 18371 - DNA, 40 bp, Artificial Sequence
  PCR primer for ORF amplification
tggaagtggttcaggaatgcaattcgctgggaagaaaact

SEQ ID NO: 18372 - DNA, 40 bp, Artificial Sequence
  PCR primer for ORF amplification
tggaagtggttcaggaatgcattgcgtactagcgcgaata

SEQ ID NO: 18373 - DNA, 40 bp, Artificial Sequence
  PCR primer for ORF amplification
tggaagtggttcaggaatgccaccaaaagaagactgggaa

SEQ ID NO: 18374 - DNA, 40 bp, Artificial Sequence
  PCR primer for ORF amplification
tggaagtggttcaggaatgcgaatctcaaaaaatagtcat

SEQ ID NO: 18375 - DNA, 40 bp, Artificial Sequence
  PCR primer for ORF amplification
tggaagtggttcaggaatggcaatcgttaatagttggcta

SEQ ID NO: 18376 - DNA, 40 bp, Artificial Sequence
  PCR primer for ORF amplification
tggaagtggttcaggaatggcgaaaagcaaatccagtcag

SEQ ID NO: 18377 - DNA, 40 bp, Artificial Sequence
  PCR primer for ORF amplification
tggaagtggttcaggaatgttgcttagtgcgcctgttaac

SEQ ID NO: 18378 - DNA, 40 bp, Artificial Sequence
  PCR primer for ORF amplification
tggaagtggttcaggaatgtttaaatctgttgtttattca

SEQ ID NO: 18379 - DNA, 40 bp, Artificial Sequence
  PCR primer for ORF amplification
tggaagtggttcaggaatgtttaagtctgttgtttattcg

SEQ ID NO: 18380 - DNA, 40 bp, Artificial Sequence
  PCR primer for ORF amplification
tggaagtggttcaggaatgaatcttaaactttctgctatt

SEQ ID NO: 18381 - DNA, 40 bp, Artificial Sequence
  PCR primer for ORF amplification
tggaagtggttcaggaatgaattttgttacctgccatgtt

SEQ ID NO: 18382 - DNA, 40 bp, Artificial Sequence
  PCR primer for ORF amplification
tggaagtggttcaggaatgactttagtcaagtatgcatgc

SEQ ID NO: 18383 - DNA, 40 bp, Artificial Sequence
  PCR primer for ORF amplification
tggaagtggttcaggaatggaagcttcacatttgcaaatc

SEQ ID NO: 18384 - DNA, 40 bp, Artificial Sequence
  PCR primer for ORF amplification
tggaagtggttcaggaatgggtcaaatattgtccaatcca

SEQ ID NO: 18385 - DNA, 40 bp, Artificial Sequence
  PCR primer for ORF amplification
tggaagtggttcaggaatggtgaagcccgttatttttgcc

SEQ ID NO: 18386 - DNA, 40 bp, Artificial Sequence
  PCR primer for ORF amplification
tggaagtggttcaggaatgttactgaatactacttatact

SEQ ID NO: 18387 - DNA, 40 bp, Artificial Sequence
  PCR primer for ORF amplification
tggaagtggttcaggaatgacaagcattgacattaacaac

SEQ ID NO: 18388 - DNA, 40 bp, Artificial Sequence
  PCR primer for ORF amplification
tggaagtggttcaggaatgcccccaagaaatacctatgaa

SEQ ID NO: 18389 - DNA, 40 bp, Artificial Sequence
  PCR primer for ORF amplification
tggaagtggttcaggaatgccttacactctatccgacgct

SEQ ID NO: 18390 - DNA, 40 bp, Artificial Sequence
  PCR primer for ORF amplification
tggaagtggttcaggaatggataatcagcaggaaagtata

SEQ ID NO: 18391 - DNA, 40 bp, Artificial Sequence
  PCR primer for ORF amplification
tggaagtggttcaggaatgtcttattcagctgccgataat

SEQ ID NO: 18392 - DNA, 40 bp, Artificial Sequence
  PCR primer for ORF amplification
tggaagtggttcaggaatgtttctcaatagaatgatgaag

SEQ ID NO: 18393 - DNA, 40 bp, Artificial Sequence
  PCR primer for ORF amplification
tggaagtggttcaggaatgaatcggcgtctcctggtacgt

SEQ ID NO: 18394 - DNA, 40 bp, Artificial Sequence
  PCR primer for ORF amplification
tggaagtggttcaggaatgactatccctggaagatttatg

SEQ ID NO: 18395 - DNA, 40 bp, Artificial Sequence
  PCR primer for ORF amplification
tggaagtggttcaggaatgagtattgtaagacagtcatgt

SEQ ID NO: 18396 - DNA, 40 bp, Artificial Sequence
  PCR primer for ORF amplification
tggaagtggttcaggaatgcagaatccttacggtcacttt

SEQ ID NO: 18397 - DNA, 40 bp, Artificial Sequence
  PCR primer for ORF amplification
tggaagtggttcaggaatgtcatacaagtcagcaataata

SEQ ID NO: 18398 - DNA, 40 bp, Artificial Sequence
  PCR primer for ORF amplification
tggaagtggttcaggaatgtcctcccaacaacacaagttc

SEQ ID NO: 18399 - DNA, 40 bp, Artificial Sequence
  PCR primer for ORF amplification
tggaagtggttcaggaatgtcgaaattggtcatatcaacg

SEQ ID NO: 18400 - DNA, 40 bp, Artificial Sequence
  PCR primer for ORF amplification
tggaagtggttcaggaatgtctctctctcccgttgttgtt

SEQ ID NO: 18401 - DNA, 40 bp, Artificial Sequence
  PCR primer for ORF amplification
tggaagtggttcaggaatgaagttcgtgacagctagttat

SEQ ID NO: 18402 - DNA, 40 bp, Artificial Sequence
  PCR primer for ORF amplification
tggaagtggttcaggaatgaatgaaattatggatatggat

SEQ ID NO: 18403 - DNA, 40 bp, Artificial Sequence
  PCR primer for ORF amplification
tggaagtggttcaggaatgagcatttgtccacatatacag

SEQ ID NO: 18404 - DNA, 40 bp, Artificial Sequence
  PCR primer for ORF amplification
tggaagtggttcaggaatgatcgtatttcgtcgctttcct

SEQ ID NO: 18405 - DNA, 40 bp, Artificial Sequence
  PCR primer for ORF amplification
tggaagtggttcaggaatgatggttttttcgagcaccttt

SEQ ID NO: 18406 - DNA, 40 bp, Artificial Sequence
  PCR primer for ORF amplification
tggaagtggttcaggaatggaaagttttgaaaatttgagc

SEQ ID NO: 18407 - DNA, 40 bp, Artificial Sequence
  PCR primer for ORF amplification
tggaagtggttcaggaatgggctcaaaagtagcaggtaaa

SEQ ID NO: 18408 - DNA, 40 bp, Artificial Sequence
  PCR primer for ORF amplification
tggaagtggttcaggaatgtcacgatcccttttggtagag

SEQ ID NO: 18409 - DNA, 40 bp, Artificial Sequence
  PCR primer for ORF amplification
tggaagtggttcaggaatgtcgattcaaactagtgatcca

SEQ ID NO: 18410 - DNA, 40 bp, Artificial Sequence
  PCR primer for ORF amplification
tggaagtggttcaggaatgtctatttgtgaacaatactac

SEQ ID NO: 18411 - DNA, 40 bp, Artificial Sequence
  PCR primer for ORF amplification
tggaagtggttcaggaatggggtgtacagtgagtacgcaa

SEQ ID NO: 18412 - DNA, 40 bp, Artificial Sequence
  PCR primer for ORF amplification
tggaagtggttcaggaatgtttggattaaataaagcatct

SEQ ID NO: 18413 - DNA, 40 bp, Artificial Sequence
  PCR primer for ORF amplification
tggaagtggttcaggaatgactttaactaagcaaacatgc

SEQ ID NO: 18414 - DNA, 40 bp, Artificial Sequence
  PCR primer for ORF amplification
tggaagtggttcaggaatgcgatcttatatgcagattctt

SEQ ID NO: 18415 - DNA, 40 bp, Artificial Sequence
  PCR primer for ORF amplification
tggaagtggttcaggaatgctcaggtgtgcggtcaagaag

SEQ ID NO: 18416 - DNA, 40 bp, Artificial Sequence
  PCR primer for ORF amplification
tggaagtggttcaggaatggcaaaggataatagtgagaag

SEQ ID NO: 18417 - DNA, 40 bp, Artificial Sequence
  PCR primer for ORF amplification
tggaagtggttcaggaatgggtgccgtaatttctttgcca

SEQ ID NO: 18418 - DNA, 40 bp, Artificial Sequence
  PCR primer for ORF amplification
tggaagtggttcaggaatgggtggagaaattattactttg

SEQ ID NO: 18419 - DNA, 40 bp, Artificial Sequence
  PCR primer for ORF amplification
tggaagtggttcaggaatgtccgaagaacggcatgaagat

SEQ ID NO: 18420 - DNA, 40 bp, Artificial Sequence
  PCR primer for ORF amplification
tggaagtggttcaggaatgtttcaaaggtctggcgctgct

SEQ ID NO: 18421 - DNA, 40 bp, Artificial Sequence
  PCR primer for ORF amplification
tggaagtggttcaggaatgaaattaaaattgatagtaaat

SEQ ID NO: 18422 - DNA, 40 bp, Artificial Sequence
  PCR primer for ORF amplification
tggaagtggttcaggaatgagtatttcaaattggatcacc

SEQ ID NO: 18423 - DNA, 40 bp, Artificial Sequence
  PCR primer for ORF amplification
tggaagtggttcaggaatgtttagagtcaagatcatctct

SEQ ID NO: 18424 - DNA, 40 bp, Artificial Sequence
  PCR primer for ORF amplification
tggaagtggttcaggaatgcatgaagtagtaacgatatcg

SEQ ID NO: 18425 - DNA, 40 bp, Artificial Sequence
  PCR primer for ORF amplification
tggaagtggttcaggaatggcagaccttcaaaaacaagag

SEQ ID NO: 18426 - DNA, 40 bp, Artificial Sequence
  PCR primer for ORF amplification
tggaagtggttcaggaatggcttctgcagtgtatttttgc

SEQ ID NO: 18427 - DNA, 40 bp, Artificial Sequence
  PCR primer for ORF amplification
tggaagtggttcaggaatgtctgaagcgatattccagcca

SEQ ID NO: 18428 - DNA, 40 bp, Artificial Sequence
  PCR primer for ORF amplification
tggaagtggttcaggaatgaaattctcaactgccgttact

SEQ ID NO: 18429 - DNA, 40 bp, Artificial Sequence
  PCR primer for ORF amplification
tggaagtggttcaggaatgaggcaggtttggttctcttgg

SEQ ID NO: 18430 - DNA, 40 bp, Artificial Sequence
  PCR primer for ORF amplification
tggaagtggttcaggaatgagttttagaaggattaactct

SEQ ID NO: 18431 - DNA, 40 bp, Artificial Sequence
  PCR primer for ORF amplification
tggaagtggttcaggaatgatagcttccaaaagctcctta

SEQ ID NO: 18432 - DNA, 40 bp, Artificial Sequence
  PCR primer for ORF amplification
tggaagtggttcaggaatgctgtccattttaagaaattcg

SEQ ID NO: 18433 - DNA, 40 bp, Artificial Sequence
  PCR primer for ORF amplification
tggaagtggttcaggaatggctgacaattctacttccaga

SEQ ID NO: 18434 - DNA, 40 bp, Artificial Sequence
  PCR primer for ORF amplification
tggaagtggttcaggaatgtcatcatcagacatctttgat

SEQ ID NO: 18435 - DNA, 40 bp, Artificial Sequence
  PCR primer for ORF amplification
tggaagtggttcaggaatgttacaagataataatgggccc

SEQ ID NO: 18436 - DNA, 40 bp, Artificial Sequence
  PCR primer for ORF amplification
tggaagtggttcaggaatgacattgaataggaagtgcgta

SEQ ID NO: 18437 - DNA, 40 bp, Artificial Sequence
  PCR primer for ORF amplification
tggaagtggttcaggaatgactgacacaaaacagctattc

SEQ ID NO: 18438 - DNA, 40 bp, Artificial Sequence
  PCR primer for ORF amplification
tggaagtggttcaggaatgtacaacagaaaagacagagat

SEQ ID NO: 18439 - DNA, 40 bp, Artificial Sequence
  PCR primer for ORF amplification
tggaagtggttcaggaatgtttcgaaggggagataattca

SEQ ID NO: 18440 - DNA, 40 bp, Artificial Sequence
  PCR primer for ORF amplification
tggaagtggttcaggaatgaaattctctaccatcttacct

SEQ ID NO: 18441 - DNA, 40 bp, Artificial Sequence
  PCR primer for ORF amplification
tggaagtggttcaggaatgaatgctttgacaaccatagat

SEQ ID NO: 18442 - DNA, 40 bp, Artificial Sequence
  PCR primer for ORF amplification
tggaagtggttcaggaatgactggtcctggacctgaaata

SEQ ID NO: 18443 - DNA, 40 bp, Artificial Sequence
  PCR primer for ORF amplification
tggaagtggttcaggaatgccttctttcaatcctgttaga

SEQ ID NO: 18444 - DNA, 40 bp, Artificial Sequence
  PCR primer for ORF amplification
tggaagtggttcaggaatggattctggtatgttctagcgc

SEQ ID NO: 18445 - DNA, 40 bp, Artificial Sequence
  PCR primer for ORF amplification
tggaagtggttcaggaatggcaaacaaatcacgacccaag

SEQ ID NO: 18446 - DNA, 40 bp, Artificial Sequence
  PCR primer for ORF amplification
tggaagtggttcaggaatgggcgcaaccaaaattttaatg

SEQ ID NO: 18447 - DNA, 40 bp, Artificial Sequence
  PCR primer for ORF amplification
tggaagtggttcaggaatgtctgaaaataagaactctgag

SEQ ID NO: 18448 - DNA, 40 bp, Artificial Sequence
  PCR primer for ORF amplification
tggaagtggttcaggaatgtcttctgaatcaggaaagcct

SEQ ID NO: 18449 - DNA, 40 bp, Artificial Sequence
  PCR primer for ORF amplification
tggaagtggttcaggaatgaatgtgaccactccggaagtt

SEQ ID NO: 18450 - DNA, 40 bp, Artificial Sequence
  PCR primer for ORF amplification
tggaagtggttcaggaatgacgcacccagttatatcacta

SEQ ID NO: 18451 - DNA, 40 bp, Artificial Sequence
  PCR primer for ORF amplification
tggaagtggttcaggaatggaaggaaaggttgatgtcttg

SEQ ID NO: 18452 - DNA, 40 bp, Artificial Sequence
  PCR primer for ORF amplification
tggaagtggttcaggaatgggttttgttgatttcttcgaa

SEQ ID NO: 18453 - DNA, 40 bp, Artificial Sequence
  PCR primer for ORF amplification
tggaagtggttcaggaatgtcagcgatattatcaacaact

SEQ ID NO: 18454 - DNA, 40 bp, Artificial Sequence
  PCR primer for ORF amplification
tggaagtggttcaggaatgttcttttcaaaagttatgctt

SEQ ID NO: 18455 - DNA, 40 bp, Artificial Sequence
  PCR primer for ORF amplification
tggaagtggttcaggaatgagtgagaaagaaacaaattac

SEQ ID NO: 18456 - DNA, 40 bp, Artificial Sequence
  PCR primer for ORF amplification
tggaagtggttcaggaatgtcccaagaaatttcatataca

SEQ ID NO: 18457 - DNA, 40 bp, Artificial Sequence
  PCR primer for ORF amplification
tggaagtggttcaggaatgtcctccaaccgtgttctagac

SEQ ID NO: 18458 - DNA, 40 bp, Artificial Sequence
  PCR primer for ORF amplification
tggaagtggttcaggaatgtctaggaagttgtcccacctg

SEQ ID NO: 18459 - DNA, 40 bp, Artificial Sequence
  PCR primer for ORF amplification
tggaagtggttcaggaatgtctgagttaggtgagtattct

SEQ ID NO: 18460 - DNA, 40 bp, Artificial Sequence
  PCR primer for ORF amplification
tggaagtggttcaggaatgggtatttttcaatcaatagaa

SEQ ID NO: 18461 - DNA, 40 bp, Artificial Sequence
  PCR primer for ORF amplification
tggaagtggttcaggaatgtctcactcacttacttccgtt

SEQ ID NO: 18462 - DNA, 40 bp, Artificial Sequence
  PCR primer for ORF amplification
tggaagtggttcaggaatgttgaagtggataaaaggtggg

SEQ ID NO: 18463 - DNA, 40 bp, Artificial Sequence
  PCR primer for ORF amplification
tggaagtggttcaggaatgtctgctaacttagataaatcc

SEQ ID NO: 18464 - DNA, 40 bp, Artificial Sequence
  PCR primer for ORF amplification
tggaagtggttcaggaatgagtgatacaaagagagatccg

SEQ ID NO: 18465 - DNA, 40 bp, Artificial Sequence
  PCR primer for ORF amplification
tggaagtggttcaggaatgagttttaaagggtttaccaag

SEQ ID NO: 18466 - DNA, 40 bp, Artificial Sequence
  PCR primer for ORF amplification
tggaagtggttcaggaatgcctgactatgacaattacact

SEQ ID NO: 18467 - DNA, 40 bp, Artificial Sequence
  PCR primer for ORF amplification
tggaagtggttcaggaatgctaaggaacggcgttcagagg

SEQ ID NO: 18468 - DNA, 40 bp, Artificial Sequence
  PCR primer for ORF amplification
tggaagtggttcaggaatggatagacctatagatgatatt

SEQ ID NO: 18469 - DNA, 40 bp, Artificial Sequence
  PCR primer for ORF amplification
tggaagtggttcaggaatggatttttatactactgatatc

SEQ ID NO: 18470 - DNA, 40 bp, Artificial Sequence
  PCR primer for ORF amplification
tggaagtggttcaggaatgggcggctatttggcgatcgtg

SEQ ID NO: 18471 - DNA, 40 bp, Artificial Sequence
  PCR primer for ORF amplification
tggaagtggttcaggaatggtcaaaagaacagtcgccacc

SEQ ID NO: 18472 - DNA, 40 bp, Artificial Sequence
  PCR primer for ORF amplification
tggaagtggttcaggaatgtctgcctttgtcagggtggtt

SEQ ID NO: 18473 - DNA, 40 bp, Artificial Sequence
  PCR primer for ORF amplification
tggaagtggttcaggaatgagtagctccacaaagtgcaag

SEQ ID NO: 18474 - DNA, 40 bp, Artificial Sequence
  PCR primer for ORF amplification
tggaagtggttcaggaatgctttctgcaaccaaacaaaca

SEQ ID NO: 18475 - DNA, 40 bp, Artificial Sequence
  PCR primer for ORF amplification
tggaagtggttcaggaatggccagagcatcctctactaaa

SEQ ID NO: 18476 - DNA, 40 bp, Artificial Sequence
  PCR primer for ORF amplification
tggaagtggttcaggaatggtaacacagaccaatccggtc

SEQ ID NO: 18477 - DNA, 40 bp, Artificial Sequence
  PCR primer for ORF amplification
tggaagtggttcaggaatgtatttgtcattctatatcact

SEQ ID NO: 18478 - DNA, 40 bp, Artificial Sequence
  PCR primer for ORF amplification
tggaagtggttcaggaatgtcaaaggaggatttcgttatt

SEQ ID NO: 18479 - DNA, 40 bp, Artificial Sequence
  PCR primer for ORF amplification
tggaagtggttcaggaatgacctcatcatctggtgttgat

SEQ ID NO: 18480 - DNA, 40 bp, Artificial Sequence
  PCR primer for ORF amplification
tggaagtggttcaggaatgctacggataagtattgactct

SEQ ID NO: 18481 - DNA, 40 bp, Artificial Sequence
  PCR primer for ORF amplification
tggaagtggttcaggaatggatagtgtaattcaaaaaaga

SEQ ID NO: 18482 - DNA, 40 bp, Artificial Sequence
  PCR primer for ORF amplification
tggaagtggttcaggaatggctgataagatagagaggcat

SEQ ID NO: 18483 - DNA, 40 bp, Artificial Sequence
  PCR primer for ORF amplification
tggaagtggttcaggaatgggtaaaaataagaagaaaaca

SEQ ID NO: 18484 - DNA, 40 bp, Artificial Sequence
  PCR primer for ORF amplification
tggaagtggttcaggaatgggttcaaatgatttgataaat

SEQ ID NO: 18485 - DNA, 40 bp, Artificial Sequence
  PCR primer for ORF amplification
tggaagtggttcaggaatgtccttggaagataaatttgat

SEQ ID NO: 18486 - DNA, 40 bp, Artificial Sequence
  PCR primer for ORF amplification
tggaagtggttcaggaatgtctgtgcacgctgcaacaaac

SEQ ID NO: 18487 - DNA, 40 bp, Artificial Sequence
  PCR primer for ORF amplification
tggaagtggttcaggaatgtctgttaccagtagggaacaa

SEQ ID NO: 18488 - DNA, 40 bp, Artificial Sequence
  PCR primer for ORF amplification
tggaagtggttcaggaatgttactacgttctcttacaagt

SEQ ID NO: 18489 - DNA, 40 bp, Artificial Sequence
  PCR primer for ORF amplification
tggaagtggttcaggaatggttcatttaggtccaaagaaa

SEQ ID NO: 18490 - DNA, 40 bp, Artificial Sequence
  PCR primer for ORF amplification
tggaagtggttcaggaatgtctggccaaaagggcgagatc

SEQ ID NO: 18491 - DNA, 40 bp, Artificial Sequence
  PCR primer for ORF amplification
tggaagtggttcaggaatgggcttcaatatagcgtatgtc

SEQ ID NO: 18492 - DNA, 40 bp, Artificial Sequence
  PCR primer for ORF amplification
tggaagtggttcaggaatgagagaagttattagtattaat

SEQ ID NO: 18493 - DNA, 40 bp, Artificial Sequence
  PCR primer for ORF amplification
tggaagtggttcaggaatggttcatttaggtccaaaaaaa

SEQ ID NO: 18494 - DNA, 40 bp, Artificial Sequence
  PCR primer for ORF amplification
tggaagtggttcaggaatgaataggattctatctagtgca

SEQ ID NO: 18495 - DNA, 40 bp, Artificial Sequence
  PCR primer for ORF amplification
tggaagtggttcaggaatgagcgaacaaaaggaagatttg

SEQ ID NO: 18496 - DNA, 40 bp, Artificial Sequence
  PCR primer for ORF amplification
tggaagtggttcaggaatgagtcttaaagaagacgacttt

SEQ ID NO: 18497 - DNA, 40 bp, Artificial Sequence
  PCR primer for ORF amplification
tggaagtggttcaggaatgatgaacaataacgaaagtgag

SEQ ID NO: 18498 - DNA, 40 bp, Artificial Sequence
  PCR primer for ORF amplification
tggaagtggttcaggaatgccaagaaaggctaatttgcta

SEQ ID NO: 18499 - DNA, 40 bp, Artificial Sequence
  PCR primer for ORF amplification
tggaagtggttcaggaatgcctctatcaaaggtggagcac

SEQ ID NO: 18500 - DNA, 40 bp, Artificial Sequence
  PCR primer for ORF amplification
tggaagtggttcaggaatgcttttcagaaacatagaagtg

SEQ ID NO: 18501 - DNA, 40 bp, Artificial Sequence
  PCR primer for ORF amplification
tggaagtggttcaggaatggacgatataatcacgcaagtt

SEQ ID NO: 18502 - DNA, 40 bp, Artificial Sequence
  PCR primer for ORF amplification
tggaagtggttcaggaatggtacaaaggcttctaccgggc

SEQ ID NO: 18503 - DNA, 40 bp, Artificial Sequence
  PCR primer for ORF amplification
tggaagtggttcaggaatgtcgcatactttaaaatcgaaa

SEQ ID NO: 18504 - DNA, 40 bp, Artificial Sequence
  PCR primer for ORF amplification
tggaagtggttcaggaatgcgattccatcgtcaaggtatc

SEQ ID NO: 18505 - DNA, 40 bp, Artificial Sequence
  PCR primer for ORF amplification
tggaagtggttcaggaatggaccaccaaataaccactgca

SEQ ID NO: 18506 - DNA, 40 bp, Artificial Sequence
  PCR primer for ORF amplification
tggaagtggttcaggaatggacgcattgttaacaaagttc

SEQ ID NO: 18507 - DNA, 40 bp, Artificial Sequence
  PCR primer for ORF amplification
tggaagtggttcaggaatggactcacaaccagttgacgtt

SEQ ID NO: 18508 - DNA, 40 bp, Artificial Sequence
  PCR primer for ORF amplification
tggaagtggttcaggaatggcttactctaaaatcacatta

SEQ ID NO: 18509 - DNA, 40 bp, Artificial Sequence
  PCR primer for ORF amplification
tggaagtggttcaggaatggctgaaactgaaagactaatg

SEQ ID NO: 18510 - DNA, 40 bp, Artificial Sequence
  PCR primer for ORF amplification
tggaagtggttcaggaatgtcagctatacaatcgccagca

SEQ ID NO: 18511 - DNA, 40 bp, Artificial Sequence
  PCR primer for ORF amplification
tggaagtggttcaggaatgttgagatttaccaattgtagt

SEQ ID NO: 18512 - DNA, 40 bp, Artificial Sequence
  PCR primer for ORF amplification
tggaagtggttcaggaatgaagattaagaccattaaaaga

SEQ ID NO: 18513 - DNA, 40 bp, Artificial Sequence
  PCR primer for ORF amplification
tggaagtggttcaggaatgacaaaaagtgatttattattt

SEQ ID NO: 18514 - DNA, 40 bp, Artificial Sequence
  PCR primer for ORF amplification
tggaagtggttcaggaatgagctcgcaatttccttcgtcc

SEQ ID NO: 18515 - DNA, 40 bp, Artificial Sequence
  PCR primer for ORF amplification
tggaagtggttcaggaatgcaagaatcaaaagaaccacaa

SEQ ID NO: 18516 - DNA, 40 bp, Artificial Sequence
  PCR primer for ORF amplification
tggaagtggttcaggaatgcaatttcactcagataagcag

SEQ ID NO: 18517 - DNA, 40 bp, Artificial Sequence
  PCR primer for ORF amplification
tggaagtggttcaggaatgcatttgaaaaaggggaagagg

SEQ ID NO: 18518 - DNA, 40 bp, Artificial Sequence
  PCR primer for ORF amplification
tggaagtggttcaggaatggactataagcataattttgct

SEQ ID NO: 18519 - DNA, 40 bp, Artificial Sequence
  PCR primer for ORF amplification
tggaagtggttcaggaatggagttgttaaagcttctgtgt

SEQ ID NO: 18520 - DNA, 40 bp, Artificial Sequence
  PCR primer for ORF amplification
tggaagtggttcaggaatggctcggggtgacggacatcta

SEQ ID NO: 18521 - DNA, 40 bp, Artificial Sequence
  PCR primer for ORF amplification
tggaagtggttcaggaatgggtaatgttccagggaaaata

SEQ ID NO: 18522 - DNA, 40 bp, Artificial Sequence
  PCR primer for ORF amplification
tggaagtggttcaggaatgtccaatgctgctttgcaagtt

SEQ ID NO: 18523 - DNA, 40 bp, Artificial Sequence
  PCR primer for ORF amplification
tggaagtggttcaggaatgtctgctgatttcggtttgatt

SEQ ID NO: 18524 - DNA, 40 bp, Artificial Sequence
  PCR primer for ORF amplification
tggaagtggttcaggaatgaatgcggaccatcacctgcaa

SEQ ID NO: 18525 - DNA, 40 bp, Artificial Sequence
  PCR primer for ORF amplification
tggaagtggttcaggaatgaatttctacagggatgcaaca

SEQ ID NO: 18526 - DNA, 40 bp, Artificial Sequence
  PCR primer for ORF amplification
tggaagtggttcaggaatgctggtatcatcatcttttgca

SEQ ID NO: 18527 - DNA, 40 bp, Artificial Sequence
  PCR primer for ORF amplification
tggaagtggttcaggaatggaaagcaaagaaatatcaatt

SEQ ID NO: 18528 - DNA, 40 bp, Artificial Sequence
  PCR primer for ORF amplification
tggaagtggttcaggaatggaggctacatcaagtgctctt

SEQ ID NO: 18529 - DNA, 40 bp, Artificial Sequence
  PCR primer for ORF amplification
tggaagtggttcaggaatgtcgactttaaaacagagaaaa

SEQ ID NO: 18530 - DNA, 40 bp, Artificial Sequence
  PCR primer for ORF amplification
tggaagtggttcaggaatgtctggttttcgtctaattgat

SEQ ID NO: 18531 - DNA, 40 bp, Artificial Sequence
  PCR primer for ORF amplification
tggaagtggttcaggaatgttcaggatacaactgagaact

SEQ ID NO: 18532 - DNA, 40 bp, Artificial Sequence
  PCR primer for ORF amplification
tggaagtggttcaggaatgtttcccagagcttctgcattg

SEQ ID NO: 18533 - DNA, 40 bp, Artificial Sequence
  PCR primer for ORF amplification
tggaagtggttcaggaatgggtattaacaatcctattcca

SEQ ID NO: 18534 - DNA, 40 bp, Artificial Sequence
  PCR primer for ORF amplification
tggaagtggttcaggaatgaaactctcaactaaactttgt

SEQ ID NO: 18535 - DNA, 40 bp, Artificial Sequence
  PCR primer for ORF amplification
tggaagtggttcaggaatgaagccacagtgcatactcatc

SEQ ID NO: 18536 - DNA, 40 bp, Artificial Sequence
  PCR primer for ORF amplification
tggaagtggttcaggaatgaattctccaacaatgaaatcg

SEQ ID NO: 18537 - DNA, 40 bp, Artificial Sequence
  PCR primer for ORF amplification
tggaagtggttcaggaatgaccagtttgtccaaaagcttc

SEQ ID NO: 18538 - DNA, 40 bp, Artificial Sequence
  PCR primer for ORF amplification
tggaagtggttcaggaatgaggttgatatccaaaagaaga

SEQ ID NO: 18539 - DNA, 40 bp, Artificial Sequence
  PCR primer for ORF amplification
tggaagtggttcaggaatgagtgctctactgtccgagtct

SEQ ID NO: 18540 - DNA, 40 bp, Artificial Sequence
  PCR primer for ORF amplification
tggaagtggttcaggaatgatattagatccattatctcca

SEQ ID NO: 18541 - DNA, 40 bp, Artificial Sequence
  PCR primer for ORF amplification
tggaagtggttcaggaatgattagtggtgtgctggtatac

SEQ ID NO: 18542 - DNA, 40 bp, Artificial Sequence
  PCR primer for ORF amplification
tggaagtggttcaggaatggcacactatccaccttccaag

SEQ ID NO: 18543 - DNA, 40 bp, Artificial Sequence
  PCR primer for ORF amplification
tggaagtggttcaggaatggtatatcgtaacaggtcaaag

SEQ ID NO: 18544 - DNA, 40 bp, Artificial Sequence
  PCR primer for ORF amplification
tggaagtggttcaggaatgtccaacccaatagaaaacaca

SEQ ID NO: 18545 - DNA, 40 bp, Artificial Sequence
  PCR primer for ORF amplification
tggaagtggttcaggaatgtctaagtatcaaattaattgc

SEQ ID NO: 18546 - DNA, 40 bp, Artificial Sequence
  PCR primer for ORF amplification
tggaagtggttcaggaatgagcgatgacttgttttctaag

SEQ ID NO: 18547 - DNA, 40 bp, Artificial Sequence
  PCR primer for ORF amplification
tggaagtggttcaggaatgataatgtcatcaactatgtcg

SEQ ID NO: 18548 - DNA, 40 bp, Artificial Sequence
  PCR primer for ORF amplification
tggaagtggttcaggaatgcaagatcccaatatttgccag

SEQ ID NO: 18549 - DNA, 40 bp, Artificial Sequence
  PCR primer for ORF amplification
tggaagtggttcaggaatgcgcccaagaaggagaggatta

SEQ ID NO: 18550 - DNA, 40 bp, Artificial Sequence
  PCR primer for ORF amplification
tggaagtggttcaggaatgctcgaattacgaagttgtagt

SEQ ID NO: 18551 - DNA, 40 bp, Artificial Sequence
  PCR primer for ORF amplification
tggaagtggttcaggaatggagagtcgaactacagggcct

SEQ ID NO: 18552 - DNA, 40 bp, Artificial Sequence
  PCR primer for ORF amplification
tggaagtggttcaggaatggcaaagagcaaaaaaaaaaca

SEQ ID NO: 18553 - DNA, 40 bp, Artificial Sequence
  PCR primer for ORF amplification
tggaagtggttcaggaatggctaatgatcaagatcccaac

SEQ ID NO: 18554 - DNA, 40 bp, Artificial Sequence
  PCR primer for ORF amplification
tggaagtggttcaggaatgtcaaaggcagtaggtgattta

SEQ ID NO: 18555 - DNA, 40 bp, Artificial Sequence
  PCR primer for ORF amplification
tggaagtggttcaggaatgtttcatgctttcaccttcctt

SEQ ID NO: 18556 - DNA, 40 bp, Artificial Sequence
  PCR primer for ORF amplification
tggaagtggttcaggaatgaataaagacgtcgactatcaa

SEQ ID NO: 18557 - DNA, 40 bp, Artificial Sequence
  PCR primer for ORF amplification
tggaagtggttcaggaatgacggttttctctggagtaaat

SEQ ID NO: 18558 - DNA, 40 bp, Artificial Sequence
  PCR primer for ORF amplification
tggaagtggttcaggaatgagctttgttcaaataaggcac

SEQ ID NO: 18559 - DNA, 40 bp, Artificial Sequence
  PCR primer for ORF amplification
tggaagtggttcaggaatgagtaacgatgaaggagaaaca

SEQ ID NO: 18560 - DNA, 40 bp, Artificial Sequence
  PCR primer for ORF amplification
tggaagtggttcaggaatgctaccctatatggaccaagta

SEQ ID NO: 18561 - DNA, 40 bp, Artificial Sequence
  PCR primer for ORF amplification
tggaagtggttcaggaatgcttcttttcgagcaacctgtt

SEQ ID NO: 18562 - DNA, 40 bp, Artificial Sequence
  PCR primer for ORF amplification
tggaagtggttcaggaatggagtgccagaggtgccctgca

SEQ ID NO: 18563 - DNA, 40 bp, Artificial Sequence
  PCR primer for ORF amplification
tggaagtggttcaggaatgactaactggcagcaacagctt

SEQ ID NO: 18564 - DNA, 40 bp, Artificial Sequence
  PCR primer for ORF amplification
tggaagtggttcaggaatgagctctgaagaggactatttc

SEQ ID NO: 18565 - DNA, 40 bp, Artificial Sequence
  PCR primer for ORF amplification
tggaagtggttcaggaatgcagaggtggctacaactgtgg

SEQ ID NO: 18566 - DNA, 40 bp, Artificial Sequence
  PCR primer for ORF amplification
tggaagtggttcaggaatgctgctgaaaaattgcgagacg

SEQ ID NO: 18567 - DNA, 40 bp, Artificial Sequence
  PCR primer for ORF amplification
tggaagtggttcaggaatggacttaagagtaggaaggaaa

SEQ ID NO: 18568 - DNA, 40 bp, Artificial Sequence
  PCR primer for ORF amplification
tggaagtggttcaggaatggataagtacggacatatagct

SEQ ID NO: 18569 - DNA, 40 bp, Artificial Sequence
  PCR primer for ORF amplification
tggaagtggttcaggaatggatgatttttcaagagatacc

SEQ ID NO: 18570 - DNA, 40 bp, Artificial Sequence
  PCR primer for ORF amplification
tggaagtggttcaggaatgaaaactgatagattactgatt

SEQ ID NO: 18571 - DNA, 40 bp, Artificial Sequence
  PCR primer for ORF amplification
tggaagtggttcaggaatgactacggataacgctaaggcg

SEQ ID NO: 18572 - DNA, 40 bp, Artificial Sequence
  PCR primer for ORF amplification
tggaagtggttcaggaatgtcaaattctccaacagtagca

SEQ ID NO: 18573 - DNA, 40 bp, Artificial Sequence
  PCR primer for ORF amplification
tggaagtggttcaggaatgattaaatgaacaataattaat

SEQ ID NO: 18574 - DNA, 40 bp, Artificial Sequence
  PCR primer for ORF amplification
tggaagtggttcaggaatggctccatttaggcaggacagt

SEQ ID NO: 18575 - DNA, 40 bp, Artificial Sequence
  PCR primer for ORF amplification
tggaagtggttcaggaatgaaagtattacaattcaatcaa

SEQ ID NO: 18576 - DNA, 40 bp, Artificial Sequence
  PCR primer for ORF amplification
tggaagtggttcaggaatgacggccgcacatcctgttgct

SEQ ID NO: 18577 - DNA, 40 bp, Artificial Sequence
  PCR primer for ORF amplification
tggaagtggttcaggaatgtcaatgagtaatattgttgtt

SEQ ID NO: 18578 - DNA, 40 bp, Artificial Sequence
  PCR primer for ORF amplification
tggaagtggttcaggaatgtctgctgttaacgttgcacct

SEQ ID NO: 18579 - DNA, 40 bp, Artificial Sequence
  PCR primer for ORF amplification
tggaagtggttcaggaatgactttgagtaagtattctaaa

SEQ ID NO: 18580 - DNA, 40 bp, Artificial Sequence
  PCR primer for ORF amplification
tggaagtggttcaggaatgagaccgttgtatagctgcaac

SEQ ID NO: 18581 - DNA, 40 bp, Artificial Sequence
  PCR primer for ORF amplification
tggaagtggttcaggaatgccattaaggtcattatttcat

SEQ ID NO: 18582 - DNA, 40 bp, Artificial Sequence
  PCR primer for ORF amplification
tggaagtggttcaggaatggatgcttcctcggttccacca

SEQ ID NO: 18583 - DNA, 40 bp, Artificial Sequence
  PCR primer for ORF amplification
tggaagtggttcaggaatgttcatcagtagaagatgcaga

SEQ ID NO: 18584 - DNA, 40 bp, Artificial Sequence
  PCR primer for ORF amplification
tggaagtggttcaggaatgttgaaatcaactgctacaaga

SEQ ID NO: 18585 - DNA, 40 bp, Artificial Sequence
  PCR primer for ORF amplification
tggaagtggttcaggaatgtttaaccatgattggaagtac

SEQ ID NO: 18586 - DNA, 40 bp, Artificial Sequence
  PCR primer for ORF amplification
tggaagtggttcaggaatgaaaatcgcactgccagtattc

SEQ ID NO: 18587 - DNA, 40 bp, Artificial Sequence
  PCR primer for ORF amplification
tggaagtggttcaggaatgagcggagaaacgtttgagttc

SEQ ID NO: 18588 - DNA, 40 bp, Artificial Sequence
  PCR primer for ORF amplification
tggaagtggttcaggaatggagaatagaaacagtagtacc

SEQ ID NO: 18589 - DNA, 40 bp, Artificial Sequence
  PCR primer for ORF amplification
tggaagtggttcaggaatgggaggtgaagacgaaatatta

SEQ ID NO: 18590 - DNA, 40 bp, Artificial Sequence
  PCR primer for ORF amplification
tggaagtggttcaggaatgtccactaagaagcacaccaaa

SEQ ID NO: 18591 - DNA, 40 bp, Artificial Sequence
  PCR primer for ORF amplification
tggaagtggttcaggaatgtcttacaattttacaggtacg

SEQ ID NO: 18592 - DNA, 40 bp, Artificial Sequence
  PCR primer for ORF amplification
tggaagtggttcaggaatgtcttggataaaaaatgtaaca

SEQ ID NO: 18593 - DNA, 40 bp, Artificial Sequence
  PCR primer for ORF amplification
tggaagtggttcaggaatgttaagaatcagatcactccta

SEQ ID NO: 18594 - DNA, 40 bp, Artificial Sequence
  PCR primer for ORF amplification
tggaagtggttcaggaatgaagtataataacagaaaactc

SEQ ID NO: 18595 - DNA, 40 bp, Artificial Sequence
  PCR primer for ORF amplification
tggaagtggttcaggaatgactaagctacactttgacact

SEQ ID NO: 18596 - DNA, 40 bp, Artificial Sequence
  PCR primer for ORF amplification
tggaagtggttcaggaatgactttacctgaatcaaaagac

SEQ ID NO: 18597 - DNA, 40 bp, Artificial Sequence
  PCR primer for ORF amplification
tggaagtggttcaggaatgctcagaaatacgctaaaatgt

SEQ ID NO: 18598 - DNA, 40 bp, Artificial Sequence
  PCR primer for ORF amplification
tggaagtggttcaggaatgtcaattatgccagttaagaac

SEQ ID NO: 18599 - DNA, 40 bp, Artificial Sequence
  PCR primer for ORF amplification
tggaagtggttcaggaatgtcagagggaaaagtagacgaa

SEQ ID NO: 18600 - DNA, 40 bp, Artificial Sequence
  PCR primer for ORF amplification
tggaagtggttcaggaatgtcattcgacgacttacacaaa

SEQ ID NO: 18601 - DNA, 40 bp, Artificial Sequence
  PCR primer for ORF amplification
tggaagtggttcaggaatgtcatttgaaaatttacataaa

SEQ ID NO: 18602 - DNA, 40 bp, Artificial Sequence
  PCR primer for ORF amplification
tggaagtggttcaggaatgtctagattagaaagattgacc

SEQ ID NO: 18603 - DNA, 40 bp, Artificial Sequence
  PCR primer for ORF amplification
tggaagtggttcaggaatgtctgattcatcacctactatc

SEQ ID NO: 18604 - DNA, 40 bp, Artificial Sequence
  PCR primer for ORF amplification
tggaagtggttcaggaatgattagatctgtgagaagggtt

SEQ ID NO: 18605 - DNA, 40 bp, Artificial Sequence
  PCR primer for ORF amplification
tggaagtggttcaggaatgattggctcacttagaaacaaa

SEQ ID NO: 18606 - DNA, 40 bp, Artificial Sequence
  PCR primer for ORF amplification
tggaagtggttcaggaatgcttttacaaggaatgcgttta

SEQ ID NO: 18607 - DNA, 40 bp, Artificial Sequence
  PCR primer for ORF amplification
tggaagtggttcaggaatggttacaaatatggtgaaattg

SEQ ID NO: 18608 - DNA, 40 bp, Artificial Sequence
  PCR primer for ORF amplification
tggaagtggttcaggaatgtcagaagagagggaagaaaac

SEQ ID NO: 18609 - DNA, 40 bp, Artificial Sequence
  PCR primer for ORF amplification
tggaagtggttcaggaatgtccaaaattgttaagagaaag

SEQ ID NO: 18610 - DNA, 40 bp, Artificial Sequence
  PCR primer for ORF amplification
tggaagtggttcaggaatgtcccatcgtatagcaccttcc

SEQ ID NO: 18611 - DNA, 40 bp, Artificial Sequence
  PCR primer for ORF amplification
tggaagtggttcaggaatgttgaacattcccataattgct

SEQ ID NO: 18612 - DNA, 40 bp, Artificial Sequence
  PCR primer for ORF amplification
tggaagtggttcaggaatgacaaaatcagacgaaacaaca

SEQ ID NO: 18613 - DNA, 40 bp, Artificial Sequence
  PCR primer for ORF amplification
tggaagtggttcaggaatgaaattttctgcgtatttatgg

SEQ ID NO: 18614 - DNA, 40 bp, Artificial Sequence
  PCR primer for ORF amplification
tggaagtggttcaggaatgaacaacaataatgttacggaa

SEQ ID NO: 18615 - DNA, 40 bp, Artificial Sequence
  PCR primer for ORF amplification
tggaagtggttcaggaatgacagaaagtgtaggtggaaat

SEQ ID NO: 18616 - DNA, 40 bp, Artificial Sequence
  PCR primer for ORF amplification
tggaagtggttcaggaatgataccaccacgaatcgttcca

SEQ ID NO: 18617 - DNA, 40 bp, Artificial Sequence
  PCR primer for ORF amplification
tggaagtggttcaggaatgccaatttggaaaacacaaaca

SEQ ID NO: 18618 - DNA, 40 bp, Artificial Sequence
  PCR primer for ORF amplification
tggaagtggttcaggaatgctgctggacgtgaacacaaat

SEQ ID NO: 18619 - DNA, 40 bp, Artificial Sequence
  PCR primer for ORF amplification
tggaagtggttcaggaatgctgtcagactgcttgctgaac

SEQ ID NO: 18620 - DNA, 40 bp, Artificial Sequence
  PCR primer for ORF amplification
tggaagtggttcaggaatgaacatattgctaatgcaacgg

SEQ ID NO: 18621 - DNA, 40 bp, Artificial Sequence
  PCR primer for ORF amplification
tggaagtggttcaggaatgaggaagctaaatccagcttta

SEQ ID NO: 18622 - DNA, 40 bp, Artificial Sequence
  PCR primer for ORF amplification
tggaagtggttcaggaatgattgaaaaggataaaagaacg

SEQ ID NO: 18623 - DNA, 40 bp, Artificial Sequence
  PCR primer for ORF amplification
tggaagtggttcaggaatgcacctagatctcatacacaag

SEQ ID NO: 18624 - DNA, 40 bp, Artificial Sequence
  PCR primer for ORF amplification
tggaagtggttcaggaatgctttgtgctattagtgggaaa

SEQ ID NO: 18625 - DNA, 40 bp, Artificial Sequence
  PCR primer for ORF amplification
tggaagtggttcaggaatggaaaaaattcccaggtggttg

SEQ ID NO: 18626 - DNA, 40 bp, Artificial Sequence
  PCR primer for ORF amplification
tggaagtggttcaggaatgtccgatagattcgttatttgg

SEQ ID NO: 18627 - DNA, 40 bp, Artificial Sequence
  PCR primer for ORF amplification
tggaagtggttcaggaatgtctgacttccaattagaaatt

SEQ ID NO: 18628 - DNA, 40 bp, Artificial Sequence
  PCR primer for ORF amplification
tggaagtggttcaggaatgaataaatttgacgagtttata

SEQ ID NO: 18629 - DNA, 40 bp, Artificial Sequence
  PCR primer for ORF amplification
tggaagtggttcaggaatgaccagtacaagaacgttgaga

SEQ ID NO: 18630 - DNA, 40 bp, Artificial Sequence
  PCR primer for ORF amplification
tggaagtggttcaggaatgcaaagcccatatccaatgaca

SEQ ID NO: 18631 - DNA, 40 bp, Artificial Sequence
  PCR primer for ORF amplification
tggaagtggttcaggaatggctcctattgaatacctactg

SEQ ID NO: 18632 - DNA, 40 bp, Artificial Sequence
  PCR primer for ORF amplification
tggaagtggttcaggaatgtttgaaatgcgctacgtctat

SEQ ID NO: 18633 - DNA, 40 bp, Artificial Sequence
  PCR primer for ORF amplification
tggaagtggttcaggaatgaagttgggtattataccttac

SEQ ID NO: 18634 - DNA, 40 bp, Artificial Sequence
  PCR primer for ORF amplification
tggaagtggttcaggaatgagtgaaggccccgtcaaattc

SEQ ID NO: 18635 - DNA, 40 bp, Artificial Sequence
  PCR primer for ORF amplification
tggaagtggttcaggaatgattgacgatactgagaactcc

SEQ ID NO: 18636 - DNA, 40 bp, Artificial Sequence
  PCR primer for ORF amplification
tggaagtggttcaggaatggatagccaagtagaaggcaaa

SEQ ID NO: 18637 - DNA, 40 bp, Artificial Sequence
  PCR primer for ORF amplification
tggaagtggttcaggaatggatctattcaaaagaaaagtt

SEQ ID NO: 18638 - DNA, 40 bp, Artificial Sequence
  PCR primer for ORF amplification
tggaagtggttcaggaatggctaccccgtcaaataaacgt

SEQ ID NO: 18639 - DNA, 40 bp, Artificial Sequence
  PCR primer for ORF amplification
tggaagtggttcaggaatgcctaccttgtatactgatatc

SEQ ID NO: 18640 - DNA, 40 bp, Artificial Sequence; identical to SEQ ID NO: 18639
  PCR primer for ORF amplification

SEQ ID NO: 18641 - DNA, 40 bp, Artificial Sequence
  PCR primer for ORF amplification
tggaagtggttcaggaatgccagagtccagattgcagaga

SEQ ID NO: 18642 - DNA, 40 bp, Artificial Sequence
  PCR primer for ORF amplification
tggaagtggttcaggaatggaatcgacagcaatagtgcct

SEQ ID NO: 18643 - DNA, 40 bp, Artificial Sequence
  PCR primer for ORF amplification
tggaagtggttcaggaatggatccatttttagagttcaga

SEQ ID NO: 18644 - DNA, 40 bp, Artificial Sequence
  PCR primer for ORF amplification
tggaagtggttcaggaatggccattgattactctaagtgg

SEQ ID NO: 18645 - DNA, 40 bp, Artificial Sequence
  PCR primer for ORF amplification
tggaagtggttcaggaatggcttcaatgttcagaccacca

SEQ ID NO: 18646 - DNA, 40 bp, Artificial Sequence
  PCR primer for ORF amplification
tggaagtggttcaggaatgggttccatcaataataacttc

SEQ ID NO: 18647 - DNA, 40 bp, Artificial Sequence
  PCR primer for ORF amplification
tggaagtggttcaggaatgaaagtgcttgacctactaacg

SEQ ID NO: 18648 - DNA, 40 bp, Artificial Sequence
  PCR primer for ORF amplification
tggaagtggttcaggaatgacaaatgcaaagattttagta

SEQ ID NO: 18649 - DNA, 40 bp, Artificial Sequence
  PCR primer for ORF amplification
tggaagtggttcaggaatgacaagcaaaacgaagaatatc

SEQ ID NO: 18650 - DNA, 40 bp, Artificial Sequence
  PCR primer for ORF amplification
tggaagtggttcaggaatgacaatgacacaccaacaggat

SEQ ID NO: 18651 - DNA, 40 bp, Artificial Sequence
  PCR primer for ORF amplification
tggaagtggttcaggaatgaccgcttccatcaaaattcaa

SEQ ID NO: 18652 - DNA, 40 bp, Artificial Sequence
  PCR primer for ORF amplification
tggaagtggttcaggaatgactaaatctgagcagcaagcc

SEQ ID NO: 18653 - DNA, 40 bp, Artificial Sequence
  PCR primer for ORF amplification
tggaagtggttcaggaatgataacaccaagattctctata

SEQ ID NO: 18654 - DNA, 40 bp, Artificial Sequence
  PCR primer for ORF amplification
tggaagtggttcaggaatgtttgaagtccctataacttta

SEQ ID NO: 18655 - DNA, 40 bp, Artificial Sequence
  PCR primer for ORF amplification
tggaagtggttcaggaatgaaacttcaattggcggcagtg

SEQ ID NO: 18656 - DNA, 40 bp, Artificial Sequence
  PCR primer for ORF amplification
tggaagtggttcaggaatgaagtatctaaacttagttttc

SEQ ID NO: 18657 - DNA, 40 bp, Artificial Sequence
  PCR primer for ORF amplification
tggaagtggttcaggaatgaatacagtttcaccagccaaa

SEQ ID NO: 18658 - DNA, 40 bp, Artificial Sequence
  PCR primer for ORF amplification
tggaagtggttcaggaatggcttcactgttcagaccccca

SEQ ID NO: 18659 - DNA, 40 bp, Artificial Sequence
  PCR primer for ORF amplification
tggaagtggttcaggaatgatcgctttgaagcccaatgct

SEQ ID NO: 18660 - DNA, 40 bp, Artificial Sequence
  PCR primer for ORF amplification
tggaagtggttcaggaatgccaaatgtgctttctgatgat

SEQ ID NO: 18661 - DNA, 40 bp, Artificial Sequence
  PCR primer for ORF amplification
tggaagtggttcaggaatgaaggccgttttcaaagtaacg

SEQ ID NO: 18662 - DNA, 40 bp, Artificial Sequence
  PCR primer for ORF amplification
tggaagtggttcaggaatgacttcatctctagatgatata

SEQ ID NO: 18663 - DNA, 40 bp, Artificial Sequence
  PCR primer for ORF amplification
tggaagtggttcaggaatgacttccaaaacgtcagaaagt

SEQ ID NO: 18664 - DNA, 40 bp, Artificial Sequence
  PCR primer for ORF amplification
tggaagtggttcaggaatgcacgttttctttcctttgctt

SEQ ID NO: 18665 - DNA, 40 bp, Artificial Sequence
  PCR primer for ORF amplification
tggaagtggttcaggaatgccaacttctggaactactatt

SEQ ID NO: 18666 - DNA, 40 bp, Artificial Sequence
  PCR primer for ORF amplification
tggaagtggttcaggaatgtgtggtattttaggtattgta

SEQ ID NO: 18667 - DNA, 40 bp, Artificial Sequence
  PCR primer for ORF amplification
tggaagtggttcaggaatgttaagaatctgcgtaaaaagg

SEQ ID NO: 18668 - DNA, 40 bp, Artificial Sequence
  PCR primer for ORF amplification
tggaagtggttcaggaatgcctgctcctcacggtggtatt

SEQ ID NO: 18669 - DNA, 40 bp, Artificial Sequence
  PCR primer for ORF amplification
tggaagtggttcaggaatggacaattacgaaggcagtgat

SEQ ID NO: 18670 - DNA, 40 bp, Artificial Sequence
  PCR primer for ORF amplification
tggaagtggttcaggaatggcttacgttttaactgaaact

SEQ ID NO: 18671 - DNA, 40 bp, Artificial Sequence
  PCR primer for ORF amplification
tggaagtggttcaggaatggctttccaacaaggtgtattg

SEQ ID NO: 18672 - DNA, 40 bp, Artificial Sequence
  PCR primer for ORF amplification
tggaagtggttcaggaatggtaggacactcagctcagcac

SEQ ID NO: 18673 - DNA, 40 bp, Artificial Sequence
  PCR primer for ORF amplification
tggaagtggttcaggaatggttttgccaagactatatact

SEQ ID NO: 18674 - DNA, 40 bp, Artificial Sequence
  PCR primer for ORF amplification
tggaagtggttcaggaatgtcgaaaaggtctatcgaggtc

SEQ ID NO: 18675 - DNA, 40 bp, Artificial Sequence
  PCR primer for ORF amplification
tggaagtggttcaggaatgttacataggataaacccagta

SEQ ID NO: 18676 - DNA, 40 bp, Artificial Sequence
  PCR primer for ORF amplification
tggaagtggttcaggaatgaagtcaaaagggagtcggttg

SEQ ID NO: 18677 - DNA, 40 bp, Artificial Sequence
  PCR primer for ORF amplification
tggaagtggttcaggaatgatgaaggaatcgaaatctatc

SEQ ID NO: 18678 - DNA, 40 bp, Artificial Sequence
  PCR primer for ORF amplification
tggaagtggttcaggaatggtagcaacaataatgcagacg

SEQ ID NO: 18679 - DNA, 40 bp, Artificial Sequence
  PCR primer for ORF amplification
tggaagtggttcaggaatgtcagtaaacccagaatttata

SEQ ID NO: 18680 - DNA, 40 bp, Artificial Sequence
  PCR primer for ORF amplification
tggaagtggttcaggaatgtccatgactatttgctcaaat

SEQ ID NO: 18681 - DNA, 40 bp, Artificial Sequence
  PCR primer for ORF amplification
tggaagtggttcaggaatgaagcaattcaagttggttaat

SEQ ID NO: 18682 - DNA, 40 bp, Artificial Sequence
  PCR primer for ORF amplification
tggaagtggttcaggaatgactgctggttctgccccccct

SEQ ID NO: 18683 - DNA, 40 bp, Artificial Sequence
  PCR primer for ORF amplification
tggaagtggttcaggaatgagtgactattccctgaagcat

SEQ ID NO: 18684 - DNA, 40 bp, Artificial Sequence
  PCR primer for ORF amplification
tggaagtggttcaggaatgagtttgtccacgaaaagagag

SEQ ID NO: 18685 - DNA, 40 bp, Artificial Sequence
  PCR primer for ORF amplification
tggaagtggttcaggaatgctatcgaagaatttgtatagt

SEQ ID NO: 18686 - DNA, 40 bp, Artificial Sequence
  PCR primer for ORF amplification
tggaagtggttcaggaatggcagataaattaatggacaaa

SEQ ID NO: 18687 - DNA, 40 bp, Artificial Sequence
  PCR primer for ORF amplification
tggaagtggttcaggaatggtatcgaggctatcaaagaga

SEQ ID NO: 18688 - DNA, 40 bp, Artificial Sequence
  PCR primer for ORF amplification
tggaagtggttcaggaatgtcaacacccacagcagcagat

SEQ ID NO: 18689 - DNA, 40 bp, Artificial Sequence
  PCR primer for ORF amplification
tggaagtggttcaggaatgtcagaaaaccaaaaggaggta

SEQ ID NO: 18690 - DNA, 40 bp, Artificial Sequence
  PCR primer for ORF amplification
tggaagtggttcaggaatgtcagctataccaataactcca

SEQ ID NO: 18691 - DNA, 40 bp, Artificial Sequence
  PCR primer for ORF amplification
tggaagtggttcaggaatgtcgactgctaggcctagaata

SEQ ID NO: 18692 - DNA, 40 bp, Artificial Sequence
  PCR primer for ORF amplification
tggaagtggttcaggaatgaacgaagttacttgttccata

SEQ ID NO: 18693 - DNA, 40 bp, Artificial Sequence
  PCR primer for ORF amplification
tggaagtggttcaggaatgcctaacgcttcccaagtttac

SEQ ID NO: 18694 - DNA, 40 bp, Artificial Sequence
  PCR primer for ORF amplification
tggaagtggttcaggaatggaggaacaacgtgaaatactg

SEQ ID NO: 18695 - DNA, 40 bp, Artificial Sequence
  PCR primer for ORF amplification
tggaagtggttcaggaatggttgcagaatttcaaatagcg

SEQ ID NO: 18696 - DNA, 40 bp, Artificial Sequence
  PCR primer for ORF amplification
tggaagtggttcaggaatgtctactttcataagaggtccc

SEQ ID NO: 18697 - DNA, 40 bp, Artificial Sequence
  PCR primer for ORF amplification
tggaagtggttcaggaatgaaagcgtacgcaaagaaacgt

SEQ ID NO: 18698 - DNA, 40 bp, Artificial Sequence
  PCR primer for ORF amplification
tggaagtggttcaggaatgacacaagacaaagaagtcaaa

SEQ ID NO: 18699 - DNA, 40 bp, Artificial Sequence
  PCR primer for ORF amplification
tggaagtggttcaggaatggatcttgaaaatgtttcatgt

SEQ ID NO: 18700 - DNA, 40 bp, Artificial Sequence
  PCR primer for ORF amplification
tggaagtggttcaggaatgggtgttaccgttcaagacata

SEQ ID NO: 18701 - DNA, 40 bp, Artificial Sequence
  PCR primer for ORF amplification
tggaagtggttcaggaatgtcaactagctcctccgtaacg

SEQ ID NO: 18702 - DNA, 40 bp, Artificial Sequence
  PCR primer for ORF amplification
tggaagtggttcaggaatgtccaccctgattcctccacct

SEQ ID NO: 18703 - DNA, 40 bp, Artificial Sequence
  PCR primer for ORF amplification
tggaagtggttcaggaatgtcgaaattgggacaagaaaaa

SEQ ID NO: 18704 - DNA, 40 bp, Artificial Sequence
  PCR primer for ORF amplification
tggaagtggttcaggaatgtttcaacgaaagactttacag

SEQ ID NO: 18705 - DNA, 40 bp, Artificial Sequence
  PCR primer for ORF amplification
tggaagtggttcaggaatgaattccggaggtgaagaacca

SEQ ID NO: 18706 - DNA, 40 bp, Artificial Sequence
  PCR primer for ORF amplification
tggaagtggttcaggaatgatgaggtatcaatggtggctt

SEQ ID NO: 18707 - DNA, 40 bp, Artificial Sequence
  PCR primer for ORF amplification
tggaagtggttcaggaatggcagagaaatcaatatttaat

SEQ ID NO: 18708 - DNA, 40 bp, Artificial Sequence
  PCR primer for ORF amplification
tggaagtggttcaggaatgtccactgagtatgtcaaaaac

SEQ ID NO: 18709 - DNA, 40 bp, Artificial Sequence
  PCR primer for ORF amplification
tggaagtggttcaggaatgtctacacagcagcaatcttac

SEQ ID NO: 18710 - DNA, 40 bp, Artificial Sequence
  PCR primer for ORF amplification
tggaagtggttcaggaatgtttttagccaaaaatctaaaa

SEQ ID NO: 18711 - DNA, 40 bp, Artificial Sequence
  PCR primer for ORF amplification
tggaagtggttcaggaatgactacgtttaggccactatca

SEQ ID NO: 18712 - DNA, 40 bp, Artificial Sequence
  PCR primer for ORF amplification
tggaagtggttcaggaatgagtactagtgcggacactgat

SEQ ID NO: 18713 - DNA, 40 bp, Artificial Sequence
  PCR primer for ORF amplification
tggaagtggttcaggaatgcaagtgaccacaagatttata

SEQ ID NO: 18714 - DNA, 40 bp, Artificial Sequence
  PCR primer for ORF amplification
tggaagtggttcaggaatggctataagattgaatccaaaa

SEQ ID NO: 18715 - DNA, 40 bp, Artificial Sequence
  PCR primer for ORF amplification
tggaagtggttcaggaatggttttgtctgataaggagttg

SEQ ID NO: 18716 - DNA, 40 bp, Artificial Sequence
  PCR primer for ORF amplification
tggaagtggttcaggaatgacttatgaaattggggacaga

SEQ ID NO: 18717 - DNA, 40 bp, Artificial Sequence
  PCR primer for ORF amplification
tggaagtggttcaggaatgattactacagtgcaagaaatc

SEQ ID NO: 18718 - DNA, 40 bp, Artificial Sequence
  PCR primer for ORF amplification
tggaagtggttcaggaatggaagacaaagatatcacatcg

SEQ ID NO: 18719 - DNA, 40 bp, Artificial Sequence
  PCR primer for ORF amplification
tggaagtggttcaggaatggaattcacacctatagatccg

SEQ ID NO: 18720 - DNA, 40 bp, Artificial Sequence
  PCR primer for ORF amplification
tggaagtggttcaggaatggatgaatatagtagtatatat

SEQ ID NO: 18721 - DNA, 40 bp, Artificial Sequence
  PCR primer for ORF amplification
tggaagtggttcaggaatggcgcccatctttagaaattac

SEQ ID NO: 18722 - DNA, 40 bp, Artificial Sequence
  PCR primer for ORF amplification
tggaagtggttcaggaatggctccaaaaatttcaatatcc

SEQ ID NO: 18723 - DNA, 40 bp, Artificial Sequence
  PCR primer for ORF amplification
tggaagtggttcaggaatgtcgatagcttggtctagcgtt

SEQ ID NO: 18724 - DNA, 40 bp, Artificial Sequence
  PCR primer for ORF amplification
tggaagtggttcaggaatgccctctaccacgctactgttt

SEQ ID NO: 18725 - DNA, 40 bp, Artificial Sequence
  PCR primer for ORF amplification
tggaagtggttcaggaatgccttccgaatcatccgtctct

SEQ ID NO: 18726 - DNA, 40 bp, Artificial Sequence
  PCR primer for ORF amplification
tggaagtggttcaggaatggtcgctataatacctcatgct

SEQ ID NO: 18727 - DNA, 40 bp, Artificial Sequence
  PCR primer for ORF amplification
tggaagtggttcaggaatgttacgctctcttcattctgcg

SEQ ID NO: 18728 - DNA, 40 bp, Artificial Sequence
  PCR primer for ORF amplification
tggaagtggttcaggaatgttcagtagatctacgctctgc

SEQ ID NO: 18729 - DNA, 40 bp, Artificial Sequence
  PCR primer for ORF amplification
tggaagtggttcaggaatgaatacaaacgttccaatattc

SEQ ID NO: 18730 - DNA, 40 bp, Artificial Sequence
  PCR primer for ORF amplification
tggaagtggttcaggaatgagagtcagaaagcgccaatct

SEQ ID NO: 18731 - DNA, 40 bp, Artificial Sequence
  PCR primer for ORF amplification
tggaagtggttcaggaatgagtttaaaggaggaacaagtg

SEQ ID NO: 18732 - DNA, 40 bp, Artificial Sequence
  PCR primer for ORF amplification
tggaagtggttcaggaatgctttctcgcacaagagctgca

SEQ ID NO: 18733 - DNA, 40 bp, Artificial Sequence
  PCR primer for ORF amplification
tggaagtggttcaggaatgtcatcaagcgaaaacacgtta

SEQ ID NO: 18734 - DNA, 40 bp, Artificial Sequence
  PCR primer for ORF amplification
tggaagtggttcaggaatgttgaaatctgcaagccaaaac

SEQ ID NO: 18735 - DNA, 40 bp, Artificial Sequence
  PCR primer for ORF amplification
tggaagtggttcaggaatgttgcataaaagcccttcaaga

SEQ ID NO: 18736 - DNA, 40 bp, Artificial Sequence
  PCR primer for ORF amplification
tggaagtggttcaggaatgtcccaaggtactttatacatt

SEQ ID NO: 18737 - DNA, 40 bp, Artificial Sequence
  PCR primer for ORF amplification
tggaagtggttcaggaatgacgactcgtttgctccaactc

SEQ ID NO: 18738 - DNA, 40 bp, Artificial Sequence
  PCR primer for ORF amplification
tggaagtggttcaggaatgagctcagacagtttaacgcct

SEQ ID NO: 18739 - DNA, 40 bp, Artificial Sequence
  PCR primer for ORF amplification
tggaagtggttcaggaatgtcccatctcttcccaccatca

SEQ ID NO: 18740 - DNA, 40 bp, Artificial Sequence
  PCR primer for ORF amplification
tggaagtggttcaggaatgaagttttctgctggtgccgtc

SEQ ID NO: 18741 - DNA, 40 bp, Artificial Sequence
  PCR primer for ORF amplification
tggaagtggttcaggaatgccggaattaacagaatttcag

SEQ ID NO: 18742 - DNA, 40 bp, Artificial Sequence
  PCR primer for ORF amplification
tggaagtggttcaggaatggcattggcaaattccagacct

SEQ ID NO: 18743 - DNA, 40 bp, Artificial Sequence
  PCR primer for ORF amplification
tggaagtggttcaggaatgtacacgcctatccctgctaat

SEQ ID NO: 18744 - DNA, 40 bp, Artificial Sequence
  PCR primer for ORF amplification
tggaagtggttcaggaatgttgctaataagaaggacgata

SEQ ID NO: 18745 - DNA, 40 bp, Artificial Sequence
  PCR primer for ORF amplification
tggaagtggttcaggaatgaaaaacatgtcacaacgatcc

SEQ ID NO: 18746 - DNA, 40 bp, Artificial Sequence
  PCR primer for ORF amplification
tggaagtggttcaggaatgaaacatccgtatgaggaattc

SEQ ID NO: 18747 - DNA, 40 bp, Artificial Sequence
  PCR primer for ORF amplification
tggaagtggttcaggaatgacaaaggaagaaatcgcagac

SEQ ID NO: 18748 - DNA, 40 bp, Artificial Sequence
  PCR primer for ORF amplification
tggaagtggttcaggaatgagagtatatcagttttgccga

SEQ ID NO: 18749 - DNA, 40 bp, Artificial Sequence
  PCR primer for ORF amplification
tggaagtggttcaggaatgagtggtaacacaactaacgtg

SEQ ID NO: 18750 - DNA, 40 bp, Artificial Sequence
  PCR primer for ORF amplification
tggaagtggttcaggaatggatccctttcacaatggcaat

SEQ ID NO: 18751 - DNA, 40 bp, Artificial Sequence
  PCR primer for ORF amplification
tggaagtggttcaggaatggccgccattagagactacaag

SEQ ID NO: 18752 - DNA, 40 bp, Artificial Sequence
  PCR primer for ORF amplification
tggaagtggttcaggaatggccgccgttagagactacaag

SEQ ID NO: 18753 - DNA, 40 bp, Artificial Sequence
  PCR primer for ORF amplification
tggaagtggttcaggaatggctagcactgcagtaatgatg

SEQ ID NO: 18754 - DNA, 40 bp, Artificial Sequence
  PCR primer for ORF amplification
tggaagtggttcaggaatggctattaaccaggcacatgtt

SEQ ID NO: 18755 - DNA, 40 bp, Artificial Sequence
  PCR primer for ORF amplification
tggaagtggttcaggaatgggtgaagattttatgcaccca

SEQ ID NO: 18756 - DNA, 40 bp, Artificial Sequence
  PCR primer for ORF amplification
tggaagtggttcaggaatgtaccaaaataatgtattgaat

SEQ ID NO: 18757 - DNA, 40 bp, Artificial Sequence
  PCR primer for ORF amplification
tggaagtggttcaggaatgtcctataaacaaacaacatat

SEQ ID NO: 18758 - DNA, 40 bp, Artificial Sequence
  PCR primer for ORF amplification
tggaagtggttcaggaatgttgttttcgtcttcatcttct

SEQ ID NO: 18759 - DNA, 40 bp, Artificial Sequence
  PCR primer for ORF amplification
tggaagtggttcaggaatgcaactatctaaaagtatacta

SEQ ID NO: 18760 - DNA, 40 bp, Artificial Sequence
  PCR primer for ORF amplification
tggaagtggttcaggaatggaacaccaagcacttcgaagg

SEQ ID NO: 18761 - DNA, 40 bp, Artificial Sequence
  PCR primer for ORF amplification
tggaagtggttcaggaatggagaaagatcaaatccagcct

SEQ ID NO: 18762 - DNA, 40 bp, Artificial Sequence
  PCR primer for ORF amplification
tggaagtggttcaggaatgggtatcaataatccaattcct

SEQ ID NO: 18763 - DNA, 40 bp, Artificial Sequence
  PCR primer for ORF amplification
tggaagtggttcaggaatgtcccaacgatcttcacaacac

SEQ ID NO: 18764 - DNA, 40 bp, Artificial Sequence
  PCR primer for ORF amplification
tggaagtggttcaggaatgaatgaaatcgatgagaaaaat

SEQ ID NO: 18765 - DNA, 40 bp, Artificial Sequence
  PCR primer for ORF amplification
tggaagtggttcaggaatgacgttgccgaaactcagtagc

SEQ ID NO: 18766 - DNA, 40 bp, Artificial Sequence
  PCR primer for ORF amplification
tggaagtggttcaggaatgattttctcactagatgaagaa

SEQ ID NO: 18767 - DNA, 40 bp, Artificial Sequence
  PCR primer for ORF amplification
tggaagtggttcaggaatgccaaaaaatcgtggtgtcttg

SEQ ID NO: 18768 - DNA, 40 bp, Artificial Sequence
  PCR primer for ORF amplification
tggaagtggttcaggaatggatgcaaagaaaaatactggt

SEQ ID NO: 18769 - DNA, 40 bp, Artificial Sequence
  PCR primer for ORF amplification
tggaagtggttcaggaatggctgccggtgaacaagtttct

SEQ ID NO: 18770 - DNA, 40 bp, Artificial Sequence
  PCR primer for ORF amplification
tggaagtggttcaggaatgtctcaagaacagtacacagaa

SEQ ID NO: 18771 - DNA, 40 bp, Artificial Sequence
  PCR primer for ORF amplification
tggaagtggttcaggaatgtgcgggattctattgcattat

SEQ ID NO: 18772 - DNA, 40 bp, Artificial Sequence
  PCR primer for ORF amplification
tggaagtggttcaggaatgaatagtgcatctttcttacaa

SEQ ID NO: 18773 - DNA, 40 bp, Artificial Sequence
  PCR primer for ORF amplification
tggaagtggttcaggaatgacaatttctaatttgttaaag

SEQ ID NO: 18774 - DNA, 40 bp, Artificial Sequence
  PCR primer for ORF amplification
tggaagtggttcaggaatgacattgactatcaaaatagga

SEQ ID NO: 18775 - DNA, 40 bp, Artificial Sequence
  PCR primer for ORF amplification
tggaagtggttcaggaatgcctgactctaagtacacaatg

SEQ ID NO: 18776 - DNA, 40 bp, Artificial Sequence
  PCR primer for ORF amplification
tggaagtggttcaggaatggcacaaaacaattttgatttt

SEQ ID NO: 18777 - DNA, 40 bp, Artificial Sequence
  PCR primer for ORF amplification
tggaagtggttcaggaatgtccaccctttttctgattgga

SEQ ID NO: 18778 - DNA, 40 bp, Artificial Sequence
  PCR primer for ORF amplification
tggaagtggttcaggaatgtctactatcccatttagaaag

SEQ ID NO: 18779 - DNA, 40 bp, Artificial Sequence
  PCR primer for ORF amplification
tggaagtggttcaggaatgtggatactcatatacctattt

SEQ ID NO: 18780 - DNA, 40 bp, Artificial Sequence
  PCR primer for ORF amplification
tggaagtggttcaggaatgaatgtcatattttctttggcg

SEQ ID NO: 18781 - DNA, 40 bp, Artificial Sequence
  PCR primer for ORF amplification
tggaagtggttcaggaatgagtctctcgcaggtgtcacct

SEQ ID NO: 18782 - DNA, 40 bp, Artificial Sequence
  PCR primer for ORF amplification
tggaagtggttcaggaatgagtgacttacaagaccaagaa

SEQ ID NO: 18783 - DNA, 40 bp, Artificial Sequence
  PCR primer for ORF amplification
tggaagtggttcaggaatgagtgtacagatatttggagac

SEQ ID NO: 18784 - DNA, 40 bp, Artificial Sequence
  PCR primer for ORF amplification
tggaagtggttcaggaatgccaatggatttccaacctaca

SEQ ID NO: 18785 - DNA, 40 bp, Artificial Sequence
  PCR primer for ORF amplification
tggaagtggttcaggaatgcctcaaaatacaagacacacg

SEQ ID NO: 18786 - DNA, 40 bp, Artificial Sequence
  PCR primer for ORF amplification
tggaagtggttcaggaatggctgatgaaaagagactggag

SEQ ID NO: 18787 - DNA, 40 bp, Artificial Sequence
  PCR primer for ORF amplification
tggaagtggttcaggaatggcttctacttcgaacacgttc

SEQ ID NO: 18788 - DNA, 40 bp, Artificial Sequence
  PCR primer for ORF amplification
tggaagtggttcaggaatgaaattgtcttccgcttttgta

SEQ ID NO: 18789 - DNA, 40 bp, Artificial Sequence
  PCR primer for ORF amplification
tggaagtggttcaggaatgaattatggcgtggagaagctg

SEQ ID NO: 18790 - DNA, 40 bp, Artificial Sequence
  PCR primer for ORF amplification
tggaagtggttcaggaatgactaaatctcattcagaagaa

SEQ ID NO: 18791 - DNA, 40 bp, Artificial Sequence
  PCR primer for ORF amplification
tggaagtggttcaggaatgagctatggaactataaatgat

SEQ ID NO: 18792 - DNA, 40 bp, Artificial Sequence
  PCR primer for ORF amplification
tggaagtggttcaggaatgcaaaatgctcaaataaagagc

SEQ ID NO: 18793 - DNA, 40 bp, Artificial Sequence
  PCR primer for ORF amplification
tggaagtggttcaggaatgcaacaaaacacgtctttatat

SEQ ID NO: 18794 - DNA, 40 bp, Artificial Sequence
  PCR primer for ORF amplification
tggaagtggttcaggaatgcctcaaacgcacgaaatgtcc

SEQ ID NO: 18795 - DNA, 40 bp, Artificial Sequence
  PCR primer for ORF amplification
tggaagtggttcaggaatgtcctacaataatggcaatact

SEQ ID NO: 18796 - DNA, 40 bp, Artificial Sequence
  PCR primer for ORF amplification
tggaagtggttcaggaatgtctgctaaagttccatctaac

SEQ ID NO: 18797 - DNA, 40 bp, Artificial Sequence
  PCR primer for ORF amplification
tggaagtggttcaggaatgttcaggcagtcaaaaagaaga

SEQ ID NO: 18798 - DNA, 40 bp, Artificial Sequence
  PCR primer for ORF amplification
tggaagtggttcaggaatgtttggaatacgttcaggcaat

SEQ ID NO: 18799 - DNA, 40 bp, Artificial Sequence
  PCR primer for ORF amplification
tggaagtggttcaggaatgactataagcgaagctcgtcta

SEQ ID NO: 18800 - DNA, 40 bp, Artificial Sequence
  PCR primer for ORF amplification
tggaagtggttcaggaatggttttggaataccaacaaagg

SEQ ID NO: 18801 - DNA, 40 bp, Artificial Sequence
  PCR primer for ORF amplification
tggaagtggttcaggaatgtgcactccagatgaaaacgat

SEQ ID NO: 18802 - DNA, 40 bp, Artificial Sequence
  PCR primer for ORF amplification
tggaagtggttcaggaatgaaggagaatgacatgaataat

SEQ ID NO: 18803 - DNA, 40 bp, Artificial Sequence
  PCR primer for ORF amplification
tggaagtggttcaggaatgaatttacttgaaacaaggagg

SEQ ID NO: 18804 - DNA, 40 bp, Artificial Sequence
  PCR primer for ORF amplification
tggaagtggttcaggaatgacaagaaagcaggctattgac

SEQ ID NO: 18805 - DNA, 40 bp, Artificial Sequence
  PCR primer for ORF amplification
tggaagtggttcaggaatgattagctcagaattaacgaat

SEQ ID NO: 18806 - DNA, 40 bp, Artificial Sequence
  PCR primer for ORF amplification
tggaagtggttcaggaatgccagaaaagttagccatgtca

SEQ ID NO: 18807 - DNA, 40 bp, Artificial Sequence
  PCR primer for ORF amplification
tggaagtggttcaggaatgctaagaaacattttggtgaga

SEQ ID NO: 18808 - DNA, 40 bp, Artificial Sequence
  PCR primer for ORF amplification
tggaagtggttcaggaatgtctgctaccaagtcaatcgtt

SEQ ID NO: 18809 - DNA, 40 bp, Artificial Sequence
  PCR primer for ORF amplification
tggaagtggttcaggaatggcttctacggaacttagccta

SEQ ID NO: 18810 - DNA, 40 bp, Artificial Sequence
  PCR primer for ORF amplification
tggaagtggttcaggaatgtcaaaagttgacgtaaaaatt

SEQ ID NO: 18811 - DNA, 40 bp, Artificial Sequence
  PCR primer for ORF amplification
tggaagtggttcaggaatgaaagcattcaccagtttacta

SEQ ID NO: 18812 - DNA, 40 bp, Artificial Sequence
  PCR primer for ORF amplification
tggaagtggttcaggaatgcttttgcaagctttccttttc

SEQ ID NO: 18813 - DNA, 40 bp, Artificial Sequence
  PCR primer for ORF amplification
tggaagtggttcaggaatggatagaacgtggctattactg

SEQ ID NO: 18814 - DNA, 40 bp, Artificial Sequence
  PCR primer for ORF amplification
tggaagtggttcaggaatgtcaaacgacggctcaaaaata

SEQ ID NO: 18815 - DNA, 40 bp, Artificial Sequence
  PCR primer for ORF amplification
tggaagtggttcaggaatgaacttgtggagacatagtcca

SEQ ID NO: 18816 - DNA, 40 bp, Artificial Sequence
  PCR primer for ORF amplification
tggaagtggttcaggaatgacagaagataatattgctcca

SEQ ID NO: 18817 - DNA, 40 bp, Artificial Sequence
  PCR primer for ORF amplification
tggaagtggttcaggaatggagcgattgaagcaactggag

SEQ ID NO: 18818 - DNA, 40 bp, Artificial Sequence
  PCR primer for ORF amplification
tggaagtggttcaggaatgtcagcacctgttcctcaatta

SEQ ID NO: 18819 - DNA, 40 bp, Artificial Sequence
  PCR primer for ORF amplification
tggaagtggttcaggaatgttggaagagggaaataatgtt

SEQ ID NO: 18820 - DNA, 40 bp, Artificial Sequence
  PCR primer for ORF amplification
tggaagtggttcaggaatgagcaacaaatttacaatggag

SEQ ID NO: 18821 - DNA, 40 bp, Artificial Sequence
  PCR primer for ORF amplification
tggaagtggttcaggaatgagctctgacgaagaagatttc

SEQ ID NO: 18822 - DNA, 40 bp, Artificial Sequence
  PCR primer for ORF amplification
tggaagtggttcaggaatgcaagctccagtggtatttatg

SEQ ID NO: 18823 - DNA, 40 bp, Artificial Sequence
  PCR primer for ORF amplification
tggaagtggttcaggaatgcatcaccaaactaagttagat

SEQ ID NO: 18824 - DNA, 40 bp, Artificial Sequence
  PCR primer for ORF amplification
tggaagtggttcaggaatggaaaaatcactagcggatcaa

SEQ ID NO: 18825 - DNA, 40 bp, Artificial Sequence
  PCR primer for ORF amplification
tggaagtggttcaggaatggaagttgcaccggccttatcg

SEQ ID NO: 18826 - DNA, 40 bp, Artificial Sequence
  PCR primer for ORF amplification
tggaagtggttcaggaatgtacaccaattattcacttaca

SEQ ID NO: 18827 - DNA, 40 bp, Artificial Sequence
  PCR primer for ORF amplification
tggaagtggttcaggaatgtccaatgcaaatctaagaaaa

SEQ ID NO: 18828 - DNA, 40 bp, Artificial Sequence
  PCR primer for ORF amplification
tggaagtggttcaggaatgagtataacaagtgaagaacta

SEQ ID NO: 18829 - DNA, 40 bp, Artificial Sequence
  PCR primer for ORF amplification
tggaagtggttcaggaatggaagatatagaaggatacgaa

SEQ ID NO: 18830 - DNA, 40 bp, Artificial Sequence
  PCR primer for ORF amplification
tggaagtggttcaggaatgggcatgttttttaatttaagg

SEQ ID NO: 18831 - DNA, 40 bp, Artificial Sequence
  PCR primer for ORF amplification
tggaagtggttcaggaatgtgccttgaaccaatctctctt

SEQ ID NO: 18832 - DNA, 40 bp, Artificial Sequence
  PCR primer for ORF amplification
tggaagtggttcaggaatgacatttactagcaacttgccc

SEQ ID NO: 18833 - DNA, 40 bp, Artificial Sequence
  PCR primer for ORF amplification
tggaagtggttcaggaatgatcatgttgagaataccgaca

SEQ ID NO: 18834 - DNA, 40 bp, Artificial Sequence
  PCR primer for ORF amplification
tggaagtggttcaggaatgcaattgatttccatcctctct

SEQ ID NO: 18835 - DNA, 40 bp, Artificial Sequence
  PCR primer for ORF amplification
tggaagtggttcaggaatgcacttttctttgaagcaattg

SEQ ID NO: 18836 - DNA, 40 bp, Artificial Sequence
  PCR primer for ORF amplification
tggaagtggttcaggaatgagatttgtgttcgatgaggtt

SEQ ID NO: 18837 - DNA, 40 bp, Artificial Sequence
  PCR primer for ORF amplification
tggaagtggttcaggaatgagttctgtcgcagaaaatata

SEQ ID NO: 18838 - DNA, 40 bp, Artificial Sequence
  PCR primer for ORF amplification
tggaagtggttcaggaatggccaccaccacgcaaccacaa

SEQ ID NO: 18839 - DNA, 40 bp, Artificial Sequence
  PCR primer for ORF amplification
tggaagtggttcaggaatggtaaataaggtggttgatgag

SEQ ID NO: 18840 - DNA, 40 bp, Artificial Sequence
  PCR primer for ORF amplification
tggaagtggttcaggaatgtccatgcccatagcaagtacc

SEQ ID NO: 18841 - DNA, 40 bp, Artificial Sequence
  PCR primer for ORF amplification
tggaagtggttcaggaatgtcctctccagtgattggtatc

SEQ ID NO: 18842 - DNA, 40 bp, Artificial Sequence
  PCR primer for ORF amplification
tggaagtggttcaggaatgagtaccaataagttcgttgta

SEQ ID NO: 18843 - DNA, 40 bp, Artificial Sequence
  PCR primer for ORF amplification
tggaagtggttcaggaatgcaattcaagaacgctttgact

SEQ ID NO: 18844 - DNA, 40 bp, Artificial Sequence
  PCR primer for ORF amplification
tggaagtggttcaggaatgcatcgtaaatcattgaggagg

SEQ ID NO: 18845 - DNA, 40 bp, Artificial Sequence
  PCR primer for ORF amplification
tggaagtggttcaggaatgccattgaatgaaaaatacgag

SEQ ID NO: 18846 - DNA, 40 bp, Artificial Sequence
  PCR primer for ORF amplification
tggaagtggttcaggaatgtcttccaatccagaaaattct

SEQ ID NO: 18847 - DNA, 40 bp, Artificial Sequence
  PCR primer for ORF amplification
tggaagtggttcaggaatgttattaccattaacaaagcta

SEQ ID NO: 18848 - DNA, 40 bp, Artificial Sequence
  PCR primer for ORF amplification
tggaagtggttcaggaatgacagcaatgaaagctattgtc

SEQ ID NO: 18849 - DNA, 40 bp, Artificial Sequence
  PCR primer for ORF amplification
tggaagtggttcaggaatgactgctcagattccgtatcaa

SEQ ID NO: 18850 - DNA, 40 bp, Artificial Sequence
  PCR primer for ORF amplification
tggaagtggttcaggaatgatgctaagaactactgcctca

SEQ ID NO: 18851 - DNA, 40 bp, Artificial Sequence
  PCR primer for ORF amplification
tggaagtggttcaggaatggtatttactaaggaagaagtt

SEQ ID NO: 18852 - DNA, 40 bp, Artificial Sequence
  PCR primer for ORF amplification
tggaagtggttcaggaatgttttcaatcttcaaaaagaaa

SEQ ID NO: 18853 - DNA, 40 bp, Artificial Sequence
  PCR primer for ORF amplification
tggaagtggttcaggaatgcctatcttatcactatcttca

SEQ ID NO: 18854 - DNA, 40 bp, Artificial Sequence
  PCR primer for ORF amplification
tggaagtggttcaggaatggttttggctgatttggggaag

SEQ ID NO: 18855 - DNA, 40 bp, Artificial Sequence
  PCR primer for ORF amplification
tggaagtggttcaggaatgtctgaattcgctactagccgc

SEQ ID NO: 18856 - DNA, 40 bp, Artificial Sequence
  PCR primer for ORF amplification
tggaagtggttcaggaatgttgcggcttgcacgtttttat

SEQ ID NO: 18857 - DNA, 40 bp, Artificial Sequence
  PCR primer for ORF amplification
tggaagtggttcaggaatgtttggtttcagcggtagtaat

SEQ ID NO: 18858 - DNA, 40 bp, Artificial Sequence
  PCR primer for ORF amplification
tggaagtggttcaggaatgaatagcagtctgcaagttggc

SEQ ID NO: 18859 - DNA, 40 bp, Artificial Sequence
  PCR primer for ORF amplification
tggaagtggttcaggaatgatttcacccataagctttcta

SEQ ID NO: 18860 - DNA, 40 bp, Artificial Sequence
  PCR primer for ORF amplification
tggaagtggttcaggaatgcaagctaaaattatatatgct

SEQ ID NO: 18861 - DNA, 40 bp, Artificial Sequence
  PCR primer for ORF amplification
tggaagtggttcaggaatggataatggtacagattcttcc

SEQ ID NO: 18862 - DNA, 40 bp, Artificial Sequence
  PCR primer for ORF amplification
tggaagtggttcaggaatggcaggagcaacatcaagtata

SEQ ID NO: 18863 - DNA, 40 bp, Artificial Sequence
  PCR primer for ORF amplification
tggaagtggttcaggaatgggcaatcagtcattagttgtg

SEQ ID NO: 18864 - DNA, 40 bp, Artificial Sequence
  PCR primer for ORF amplification
tggaagtggttcaggaatgtccgtacaaaaagaagaatac

SEQ ID NO: 18865 - DNA, 40 bp, Artificial Sequence
  PCR primer for ORF amplification
tggaagtggttcaggaatgtcgttactgagactgtggaac

SEQ ID NO: 18866 - DNA, 40 bp, Artificial Sequence
  PCR primer for ORF amplification
tggaagtggttcaggaatgaagagtactttgagtttaact

SEQ ID NO: 18867 - DNA, 40 bp, Artificial Sequence
  PCR primer for ORF amplification
tggaagtggttcaggaatgacaagtgccgctactgttact

SEQ ID NO: 18868 - DNA, 40 bp, Artificial Sequence
  PCR primer for ORF amplification
tggaagtggttcaggaatgacagcagaagatatactcctt

SEQ ID NO: 18869 - DNA, 40 bp, Artificial Sequence
  PCR primer for ORF amplification
tggaagtggttcaggaatgatggactcgtcaagcaaaagc

SEQ ID NO: 18870 - DNA, 40 bp, Artificial Sequence
  PCR primer for ORF amplification
tggaagtggttcaggaatgtcagcggatgctagtacaaat

SEQ ID NO: 18871 - DNA, 40 bp, Artificial Sequence
  PCR primer for ORF amplification
tggaagtggttcaggaatggataaatatactgctttgatt

SEQ ID NO: 18872 - DNA, 40 bp, Artificial Sequence
  PCR primer for ORF amplification
tggaagtggttcaggaatggccattggcaaaaggttactg

SEQ ID NO: 18873 - DNA, 40 bp, Artificial Sequence
  PCR primer for ORF amplification
tggaagtggttcaggaatgtcacgagaaacaaatttcaat

SEQ ID NO: 18874 - DNA, 40 bp, Artificial Sequence
  PCR primer for ORF amplification
tggaagtggttcaggaatgtctgaagagaatttgaggcct

SEQ ID NO: 18875 - DNA, 40 bp, Artificial Sequence
  PCR primer for ORF amplification
tggaagtggttcaggaatgagagaggtcattagtattaat

SEQ ID NO: 18876 - DNA, 40 bp, Artificial Sequence
  PCR primer for ORF amplification
tggaagtggttcaggaatgctgcccagacttggttttgcg

SEQ ID NO: 18877 - DNA, 40 bp, Artificial Sequence
  PCR primer for ORF amplification
tggaagtggttcaggaatggcaacagacctaaatcgtaaa

SEQ ID NO: 18878 - DNA, 40 bp, Artificial Sequence
  PCR primer for ORF amplification
tggaagtggttcaggaatggctagtgctgaaccaagaccc

SEQ ID NO: 18879 - DNA, 40 bp, Artificial Sequence
  PCR primer for ORF amplification
tggaagtggttcaggaatgttggctcgtactgctgctatt

SEQ ID NO: 18880 - DNA, 40 bp, Artificial Sequence
  PCR primer for ORF amplification
tggaagtggttcaggaatgaaccactcagaagtgaaaact

SEQ ID NO: 18881 - DNA, 40 bp, Artificial Sequence
  PCR primer for ORF amplification
tggaagtggttcaggaatgctacggtctactatatctcta

SEQ ID NO: 18882 - DNA, 40 bp, Artificial Sequence
  PCR primer for ORF amplification
tggaagtggttcaggaatgcttagtagatcactaaataaa

SEQ ID NO: 18883 - DNA, 40 bp, Artificial Sequence
  PCR primer for ORF amplification
tggaagtggttcaggaatggaaccgctgctttttaatagt

SEQ ID NO: 18884 - DNA, 40 bp, Artificial Sequence
  PCR primer for ORF amplification
tggaagtggttcaggaatggcatccccaggatcgacagca

SEQ ID NO: 18885 - DNA, 40 bp, Artificial Sequence
  PCR primer for ORF amplification
tggaagtggttcaggaatggtggttttggctgcttctatc

SEQ ID NO: 18886 - DNA, 40 bp, Artificial Sequence
  PCR primer for ORF amplification
tggaagtggttcaggaatggttagttcaagtgtttccatt

SEQ ID NO: 18887 - DNA, 40 bp, Artificial Sequence
  PCR primer for ORF amplification
tggaagtggttcaggaatgtcattgcaattgttgaatccg

SEQ ID NO: 18888 - DNA, 40 bp, Artificial Sequence
  PCR primer for ORF amplification
tggaagtggttcaggaatgtctcaagtgcaaagtcctttg

SEQ ID NO: 18889 - DNA, 40 bp, Artificial Sequence
  PCR primer for ORF amplification
tggaagtggttcaggaatgacgaaaataaccagagatgtt

SEQ ID NO: 18890 - DNA, 40 bp, Artificial Sequence
  PCR primer for ORF amplification
tggaagtggttcaggaatgactaaatcggttggtgatgaa

SEQ ID NO: 18891 - DNA, 40 bp, Artificial Sequence
  PCR primer for ORF amplification
tggaagtggttcaggaatggtaaagaaacaccaaaatagt

SEQ ID NO: 18892 - DNA, 40 bp, Artificial Sequence
  PCR primer for ORF amplification
tggaagtggttcaggaatggtccgattaaatcatgcagca

SEQ ID NO: 18893 - DNA, 40 bp, Artificial Sequence
  PCR primer for ORF amplification
tggaagtggttcaggaatgatagtgtggcaagcactattc

SEQ ID NO: 18894 - DNA, 40 bp, Artificial Sequence
  PCR primer for ORF amplification
tggaagtggttcaggaatgcaacgctccatttttgcgagg

SEQ ID NO: 18895 - DNA, 40 bp, Artificial Sequence
  PCR primer for ORF amplification
tggaagtggttcaggaatgcataaaggaaaaaaaaattac

SEQ ID NO: 18896 - DNA, 40 bp, Artificial Sequence
  PCR primer for ORF amplification
tggaagtggttcaggaatgggcagtgcttggacaaactac

SEQ ID NO: 18897 - DNA, 40 bp, Artificial Sequence
  PCR primer for ORF amplification
tggaagtggttcaggaatggtatacacttcaacgtacaga

SEQ ID NO: 18898 - DNA, 40 bp, Artificial Sequence
  PCR primer for ORF amplification
tggaagtggttcaggaatgtacttcccctttttaggcaga

SEQ ID NO: 18899 - DNA, 40 bp, Artificial Sequence
  PCR primer for ORF amplification
tggaagtggttcaggaatgtatataaaggcagaacagaaa

SEQ ID NO: 18900 - DNA, 40 bp, Artificial Sequence
  PCR primer for ORF amplification
tggaagtggttcaggaatgttggaatgtctaagcgctctg

SEQ ID NO: 18901 - DNA, 40 bp, Artificial Sequence
  PCR primer for ORF amplification
tggaagtggttcaggaatgaaactagaacgcgtaagcagc

SEQ ID NO: 18902 - DNA, 40 bp, Artificial Sequence
  PCR primer for ORF amplification
tggaagtggttcaggaatgaagaactctgtcggtatttca

SEQ ID NO: 18903 - DNA, 40 bp, Artificial Sequence
  PCR primer for ORF amplification
tggaagtggttcaggaatgacgtcccaagaatatgaacct

SEQ ID NO: 18904 - DNA, 40 bp, Artificial Sequence
  PCR primer for ORF amplification
tggaagtggttcaggaatgactgtgcactcaacgtggaag

SEQ ID NO: 18905 - DNA, 40 bp, Artificial Sequence
  PCR primer for ORF amplification
tggaagtggttcaggaatgagaagaagcccgtccagatca

SEQ ID NO: 18906 - DNA, 40 bp, Artificial Sequence
  PCR primer for ORF amplification
tggaagtggttcaggaatgagttacactgacaaccctcct

SEQ ID NO: 18907 - DNA, 40 bp, Artificial Sequence
  PCR primer for ORF amplification
tggaagtggttcaggaatggattatatgaaattggggctt

SEQ ID NO: 18908 - DNA, 40 bp, Artificial Sequence
  PCR primer for ORF amplification
tggaagtggttcaggaatggcaagacaaaagatgttttat

SEQ ID NO: 18909 - DNA, 40 bp, Artificial Sequence
  PCR primer for ORF amplification
tggaagtggttcaggaatgtccccttctaaaatgaatgct

SEQ ID NO: 18910 - DNA, 40 bp, Artificial Sequence
  PCR primer for ORF amplification
tggaagtggttcaggaatgaactttggaagccaaacacct

SEQ ID NO: 18911 - DNA, 40 bp, Artificial Sequence
  PCR primer for ORF amplification
tggaagtggttcaggaatgtcattcaagtttctgatagaa

SEQ ID NO: 18912 - DNA, 40 bp, Artificial Sequence
  PCR primer for ORF amplification
tggaagtggttcaggaatgaagaaaaattcttcggtagtt

SEQ ID NO: 18913 - DNA, 40 bp, Artificial Sequence
  PCR primer for ORF amplification
tggaagtggttcaggaatgacctattctacagttaatatt

SEQ ID NO: 18914 - DNA, 40 bp, Artificial Sequence
  PCR primer for ORF amplification
tggaagtggttcaggaatgacctattctacagttagcatc

SEQ ID NO: 18915 - DNA, 40 bp, Artificial Sequence
  PCR primer for ORF amplification
tggaagtggttcaggaatgacttcggctgtaccttatgat

SEQ ID NO: 18916 - DNA, 40 bp, Artificial Sequence
  PCR primer for ORF amplification
tggaagtggttcaggaatgagcactgcttcaacaccgcca

SEQ ID NO: 18917 - DNA, 40 bp, Artificial Sequence
  PCR primer for ORF amplification
tggaagtggttcaggaatgagtagtggtaccgaaaatgat

SEQ ID NO: 18918 - DNA, 40 bp, Artificial Sequence
  PCR primer for ORF amplification
tggaagtggttcaggaatgcgtaggagtgtatacctcgac

SEQ ID NO: 18919 - DNA, 40 bp, Artificial Sequence
  PCR primer for ORF amplification
tggaagtggttcaggaatgcgttggtctgtccttgataca

SEQ ID NO: 18920 - DNA, 40 bp, Artificial Sequence
  PCR primer for ORF amplification
tggaagtggttcaggaatgctgaaaaacttcaaactctca

SEQ ID NO: 18921 - DNA, 40 bp, Artificial Sequence
  PCR primer for ORF amplification
tggaagtggttcaggaatggcaagctgcaatccgaccagg

SEQ ID NO: 18922 - DNA, 40 bp, Artificial Sequence
  PCR primer for ORF amplification
tggaagtggttcaggaatggcatcgcaggctacaactctt

SEQ ID NO: 18923 - DNA, 40 bp, Artificial Sequence
  PCR primer for ORF amplification
tggaagtggttcaggaatggtgccagaaaatagaaggaaa

SEQ ID NO: 18924 - DNA, 40 bp, Artificial Sequence
  PCR primer for ORF amplification
tggaagtggttcaggaatgtcacaatttgttggtttcgga

SEQ ID NO: 18925 - DNA, 40 bp, Artificial Sequence
  PCR primer for ORF amplification
tggaagtggttcaggaatgtttgcatccgctggacaacaa

SEQ ID NO: 18926 - DNA, 40 bp, Artificial Sequence
  PCR primer for ORF amplification
tggaagtggttcaggaatgagtaccgactttgatagaatt

SEQ ID NO: 18927 - DNA, 40 bp, Artificial Sequence
  PCR primer for ORF amplification
tggaagtggttcaggaatgccggtcgttcacgtgattgac

SEQ ID NO: 18928 - DNA, 40 bp, Artificial Sequence
  PCR primer for ORF amplification
tggaagtggttcaggaatggaggcacttatcgtatttata

SEQ ID NO: 18929 - DNA, 40 bp, Artificial Sequence
  PCR primer for ORF amplification
tggaagtggttcaggaatgggtaaaattgcagagtttctc

SEQ ID NO: 18930 - DNA, 40 bp, Artificial Sequence
  PCR primer for ORF amplification
tggaagtggttcaggaatggtattgcttatatcagaaatt

SEQ ID NO: 18931 - DNA, 40 bp, Artificial Sequence
  PCR primer for ORF amplification
tggaagtggttcaggaatgtccgtaacttttaaggacgat

SEQ ID NO: 18932 - DNA, 40 bp, Artificial Sequence
  PCR primer for ORF amplification
tggaagtggttcaggaatgcaagtagaagggcctgacact

SEQ ID NO: 18933 - DNA, 40 bp, Artificial Sequence
  PCR primer for ORF amplification
tggaagtggttcaggaatggcattccaagatcaagatata

SEQ ID NO: 18934 - DNA, 40 bp, Artificial Sequence
  PCR primer for ORF amplification
tggaagtggttcaggaatggccgctgagtatgtatacgaa

SEQ ID NO: 18935 - DNA, 40 bp, Artificial Sequence
  PCR primer for ORF amplification
tggaagtggttcaggaatgtcgaaagacttgaattcttca

SEQ ID NO: 18936 - DNA, 40 bp, Artificial Sequence
  PCR primer for ORF amplification
tggaagtggttcaggaatgaacaatatatttcatggaact

SEQ ID NO: 18937 - DNA, 40 bp, Artificial Sequence
  PCR primer for ORF amplification
tggaagtggttcaggaatgacacctaacttaccagggttt

SEQ ID NO: 18938 - DNA, 40 bp, Artificial Sequence
  PCR primer for ORF amplification
tggaagtggttcaggaatgaccgcaaagacttttctacta

SEQ ID NO: 18939 - DNA, 40 bp, Artificial Sequence
  PCR primer for ORF amplification
tggaagtggttcaggaatggacagagatataagctaccag

SEQ ID NO: 18940 - DNA, 40 bp, Artificial Sequence
  PCR primer for ORF amplification
tggaagtggttcaggaatggactcggtgacaaattttttc

SEQ ID NO: 18941 - DNA, 40 bp, Artificial Sequence
  PCR primer for ORF amplification
tggaagtggttcaggaatgggtcacaagaagaacggtcac

SEQ ID NO: 18942 - DNA, 40 bp, Artificial Sequence
  PCR primer for ORF amplification
tggaagtggttcaggaatggtgaagataagcttggacaac

SEQ ID NO: 18943 - DNA, 40 bp, Artificial Sequence
  PCR primer for ORF amplification
tggaagtggttcaggaatggttaaggtcagtttggataac

SEQ ID NO: 18944 - DNA, 40 bp, Artificial Sequence
  PCR primer for ORF amplification
tggaagtggttcaggaatgtcatctttgtacattaaggag

SEQ ID NO: 18945 - DNA, 40 bp, Artificial Sequence
  PCR primer for ORF amplification
tggaagtggttcaggaatgtccaataactcattcactaac

SEQ ID NO: 18946 - DNA, 40 bp, Artificial Sequence
  PCR primer for ORF amplification
tggaagtggttcaggaatgaacaagaaacaaaatttttac

SEQ ID NO: 18947 - DNA, 40 bp, Artificial Sequence
  PCR primer for ORF amplification
tggaagtggttcaggaatgaattgcaaggcggtaaccatt

SEQ ID NO: 18948 - DNA, 40 bp, Artificial Sequence
  PCR primer for ORF amplification
tggaagtggttcaggaatggatgagcaagttatttttaca

SEQ ID NO: 18949 - DNA, 40 bp, Artificial Sequence
  PCR primer for ORF amplification
tggaagtggttcaggaatgtataatggcaaggatagagca

SEQ ID NO: 18950 - DNA, 40 bp, Artificial Sequence
  PCR primer for ORF amplification
tggaagtggttcaggaatgtcaaacgaggatgaaacaact

SEQ ID NO: 18951 - DNA, 40 bp, Artificial Sequence
  PCR primer for ORF amplification
tggaagtggttcaggaatgtctacagatgaaagtgaagac

SEQ ID NO: 18952 - DNA, 40 bp, Artificial Sequence
  PCR primer for ORF amplification
tggaagtggttcaggaatgcaacacaaggatacggcagta

SEQ ID NO: 18953 - DNA, 40 bp, Artificial Sequence
  PCR primer for ORF amplification
tggaagtggttcaggaatggaaagagtatggtttgcaaaa

SEQ ID NO: 18954 - DNA, 40 bp, Artificial Sequence
  PCR primer for ORF amplification
tggaagtggttcaggaatggatggtgcgttgataaattcc

SEQ ID NO: 18955 - DNA, 40 bp, Artificial Sequence
  PCR primer for ORF amplification
tggaagtggttcaggaatgttgaatctgtgtcatgctctt

SEQ ID NO: 18956 - DNA, 40 bp, Artificial Sequence
  PCR primer for ORF amplification
tggaagtggttcaggaatgtttgataagttaccttatgag

SEQ ID NO: 18957 - DNA, 40 bp, Artificial Sequence
  PCR primer for ORF amplification
tggaagtggttcaggaatgaaggttgattacgagcaattg

SEQ ID NO: 18958 - DNA, 40 bp, Artificial Sequence
  PCR primer for ORF amplification
tggaagtggttcaggaatgaagtgccaaacatgtcactta

SEQ ID NO: 18959 - DNA, 40 bp, Artificial Sequence
  PCR primer for ORF amplification
tggaagtggttcaggaatgagcgacactgaaaaggataag

SEQ ID NO: 18960 - DNA, 40 bp, Artificial Sequence
  PCR primer for ORF amplification
tggaagtggttcaggaatgccacaaagaattgagcttacc

SEQ ID NO: 18961 - DNA, 40 bp, Artificial Sequence
  PCR primer for ORF amplification
tggaagtggttcaggaatgcctatccccgttggaaatacg

SEQ ID NO: 18962 - DNA, 40 bp, Artificial Sequence
  PCR primer for ORF amplification
tggaagtggttcaggaatggctcgtcatggaaaaggccca

SEQ ID NO: 18963 - DNA, 40 bp, Artificial Sequence
  PCR primer for ORF amplification
tggaagtggttcaggaatgtctcaagacgaaaatattgtc

SEQ ID NO: 18964 - DNA, 40 bp, Artificial Sequence
  PCR primer for ORF amplification
tggaagtggttcaggaatgagaagaaaaaatcgactgttt

SEQ ID NO: 18965 - DNA, 40 bp, Artificial Sequence
  PCR primer for ORF amplification
tggaagtggttcaggaatggcacacatcccagaggtttta

SEQ ID NO: 18966 - DNA, 40 bp, Artificial Sequence
  PCR primer for ORF amplification
tggaagtggttcaggaatggcagtccttaacttgaaacgt

SEQ ID NO: 18967 - DNA, 40 bp, Artificial Sequence
  PCR primer for ORF amplification
tggaagtggttcaggaatgggacctccgaaaaatttcaag

SEQ ID NO: 18968 - DNA, 40 bp, Artificial Sequence
  PCR primer for ORF amplification
tggaagtggttcaggaatgtctgatttagatgaggattta

SEQ ID NO: 18969 - DNA, 40 bp, Artificial Sequence
  PCR primer for ORF amplification
tggaagtggttcaggaatgatggaagaattctcgtacgat

SEQ ID NO: 18970 - DNA, 40 bp, Artificial Sequence
  PCR primer for ORF amplification
tggaagtggttcaggaatgtcccaattattcaataactcg

SEQ ID NO: 18971 - DNA, 40 bp, Artificial Sequence
  PCR primer for ORF amplification
tggaagtggttcaggaatgttgtttaaatccctttcaaag

SEQ ID NO: 18972 - DNA, 40 bp, Artificial Sequence
  PCR primer for ORF amplification
tggaagtggttcaggaatgaattggtcttttctactacag

SEQ ID NO: 18973 - DNA, 40 bp, Artificial Sequence
  PCR primer for ORF amplification
tggaagtggttcaggaatgaccacgaccgctacccaacac

SEQ ID NO: 18974 - DNA, 40 bp, Artificial Sequence
  PCR primer for ORF amplification
tggaagtggttcaggaatgacttcaccggaatcactatct

SEQ ID NO: 18975 - DNA, 40 bp, Artificial Sequence
  PCR primer for ORF amplification
tggaagtggttcaggaatgattagacaatcattaatgaaa

SEQ ID NO: 18976 - DNA, 40 bp, Artificial Sequence
  PCR primer for ORF amplification
tggaagtggttcaggaatgcaagcccccaatatctacccc

SEQ ID NO: 18977 - DNA, 40 bp, Artificial Sequence
  PCR primer for ORF amplification
tggaagtggttcaggaatggaacctaagcgaaagagcggg

SEQ ID NO: 18978 - DNA, 40 bp, Artificial Sequence
  PCR primer for ORF amplification
tggaagtggttcaggaatggaatgttttgtaccgctgcgt

SEQ ID NO: 18979 - DNA, 40 bp, Artificial Sequence
  PCR primer for ORF amplification
tggaagtggttcaggaatggtactacttaaagaacctgtt

SEQ ID NO: 18980 - DNA, 40 bp, Artificial Sequence
  PCR primer for ORF amplification
tggaagtggttcaggaatgtcgctgatcagcatcctgtct

SEQ ID NO: 18981 - DNA, 40 bp, Artificial Sequence
  PCR primer for ORF amplification
tggaagtggttcaggaatgtctcaaagaaagctacaacag

SEQ ID NO: 18982 - DNA, 40 bp, Artificial Sequence
  PCR primer for ORF amplification
tggaagtggttcaggaatgaacagagtaggggcagtgttc

SEQ ID NO: 18983 - DNA, 40 bp, Artificial Sequence
  PCR primer for ORF amplification
tggaagtggttcaggaatgagtactcctgcaaactatacc

SEQ ID NO: 18984 - DNA, 40 bp, Artificial Sequence
  PCR primer for ORF amplification
tggaagtggttcaggaatgggcattttggactcgctgaaa

SEQ ID NO: 18985 - DNA, 40 bp, Artificial Sequence
  PCR primer for ORF amplification
tggaagtggttcaggaatgtcgctttttttcaagccagta

SEQ ID NO: 18986 - DNA, 40 bp, Artificial Sequence
  PCR primer for ORF amplification
tggaagtggttcaggaatgaacgtgttcggtaaaaaagaa

SEQ ID NO: 18987 - DNA, 40 bp, Artificial Sequence
  PCR primer for ORF amplification
tggaagtggttcaggaatgaccatcccacatatgaaatac

SEQ ID NO: 18988 - DNA, 40 bp, Artificial Sequence
  PCR primer for ORF amplification
tggaagtggttcaggaatgactgccgtcgcctctactagc

SEQ ID NO: 18989 - DNA, 40 bp, Artificial Sequence
  PCR primer for ORF amplification
tggaagtggttcaggaatgcaaacactagacgagacttca

SEQ ID NO: 18990 - DNA, 40 bp, Artificial Sequence
  PCR primer for ORF amplification
tggaagtggttcaggaatgcctttgaagtcgttttttttt

SEQ ID NO: 18991 - DNA, 40 bp, Artificial Sequence
  PCR primer for ORF amplification
tggaagtggttcaggaatggattcgcaagtgcccaataat

SEQ ID NO: 18992 - DNA, 40 bp, Artificial Sequence
  PCR primer for ORF amplification
tggaagtggttcaggaatggctgctcgtccacaacaacct

SEQ ID NO: 18993 - DNA, 40 bp, Artificial Sequence
  PCR primer for ORF amplification
tggaagtggttcaggaatgtcactcctttacatcattctt

SEQ ID NO: 18994 - DNA, 40 bp, Artificial Sequence
  PCR primer for ORF amplification
tggaagtggttcaggaatgaccaaacaacaaacttctgta

SEQ ID NO: 18995 - DNA, 40 bp, Artificial Sequence
  PCR primer for ORF amplification
tggaagtggttcaggaatgagattaagaaccgccattgcc

SEQ ID NO: 18996 - DNA, 40 bp, Artificial Sequence
  PCR primer for ORF amplification
tggaagtggttcaggaatgagtattcggaatgataatgct

SEQ ID NO: 18997 - DNA, 40 bp, Artificial Sequence
  PCR primer for ORF amplification
tggaagtggttcaggaatgcctatgaacaattttctagat

SEQ ID NO: 18998 - DNA, 40 bp, Artificial Sequence
  PCR primer for ORF amplification
tggaagtggttcaggaatgtctgaaataaccttaggtaaa

SEQ ID NO: 18999 - DNA, 40 bp, Artificial Sequence
  PCR primer for ORF amplification
tggaagtggttcaggaatgtctgaaattactcttggaaaa

SEQ ID NO: 19000 - DNA, 40 bp, Artificial Sequence
  PCR primer for ORF amplification
tggaagtggttcaggaatgtctgaaattactttgggtaaa

SEQ ID NO: 19001 - DNA, 40 bp, Artificial Sequence
  PCR primer for ORF amplification
tggaagtggttcaggaatgatgaatgaagacatatccatc

SEQ ID NO: 19002 - DNA, 40 bp, Artificial Sequence
  PCR primer for ORF amplification
tggaagtggttcaggaatgcaatcatccactgaaagtgat

SEQ ID NO: 19003 - DNA, 40 bp, Artificial Sequence
  PCR primer for ORF amplification
tggaagtggttcaggaatggatatttttagagtattaact

SEQ ID NO: 19004 - DNA, 40 bp, Artificial Sequence
  PCR primer for ORF amplification
tggaagtggttcaggaatgtctagtgcgcaatcctctatt

SEQ ID NO: 19005 - DNA, 40 bp, Artificial Sequence
  PCR primer for ORF amplification
tggaagtggttcaggaatgttttcacgaagtgatcgagag

SEQ ID NO: 19006 - DNA, 40 bp, Artificial Sequence
  PCR primer for ORF amplification
tggaagtggttcaggaatgaaaagaacggtaatatcttcc

SEQ ID NO: 19007 - DNA, 40 bp, Artificial Sequence
  PCR primer for ORF amplification
tggaagtggttcaggaatgtatcgcagtagaaaccgacca

SEQ ID NO: 19008 - DNA, 40 bp, Artificial Sequence
  PCR primer for ORF amplification
tggaagtggttcaggaatgtttaagaaggagcctcacata

SEQ ID NO: 19009 - DNA, 40 bp, Artificial Sequence
  PCR primer for ORF amplification
tggaagtggttcaggaatgacgaaaccgcgttacaatgac

SEQ ID NO: 19010 - DNA, 40 bp, Artificial Sequence
  PCR primer for ORF amplification
tggaagtggttcaggaatgatgactcacacattaccaagc

SEQ ID NO: 19011 - DNA, 40 bp, Artificial Sequence
  PCR primer for ORF amplification
tggaagtggttcaggaatgatgagtcccgcccaagataaa

SEQ ID NO: 19012 - DNA, 40 bp, Artificial Sequence
  PCR primer for ORF amplification
tggaagtggttcaggaatgcaggttcaaaaaatggtgaga

SEQ ID NO: 19013 - DNA, 40 bp, Artificial Sequence
  PCR primer for ORF amplification
tggaagtggttcaggaatggagtactggcattatgtggaa

SEQ ID NO: 19014 - DNA, 40 bp, Artificial Sequence
  PCR primer for ORF amplification
tggaagtggttcaggaatggtagaaggagactcttatgtg

SEQ ID NO: 19015 - DNA, 40 bp, Artificial Sequence
  PCR primer for ORF amplification
tggaagtggttcaggaatggttacagaaaatcctcaacgt

SEQ ID NO: 19016 - DNA, 40 bp, Artificial Sequence
  PCR primer for ORF amplification
tggaagtggttcaggaatgtccaaagtaatgaaacccagc

SEQ ID NO: 19017 - DNA, 40 bp, Artificial Sequence
  PCR primer for ORF amplification
tggaagtggttcaggaatgtccacaaacctgaacccattc

SEQ ID NO: 19018 - DNA, 40 bp, Artificial Sequence
  PCR primer for ORF amplification
tggaagtggttcaggaatggcaagcgaacagtcctcacca

SEQ ID NO: 19019 - DNA, 40 bp, Artificial Sequence
  PCR primer for ORF amplification
tggaagtggttcaggaatgaattcaactccagatttaata

SEQ ID NO: 19020 - DNA, 40 bp, Artificial Sequence
  PCR primer for ORF amplification
tggaagtggttcaggaatgactggcgacggtagtgcacat

SEQ ID NO: 19021 - DNA, 40 bp, Artificial Sequence
  PCR primer for ORF amplification
tggaagtggttcaggaatgggacagtcttcttcaatcagt

SEQ ID NO: 19022 - DNA, 40 bp, Artificial Sequence
  PCR primer for ORF amplification
tggaagtggttcaggaatgtcaggtgttaataatacatcc

SEQ ID NO: 19023 - DNA, 40 bp, Artificial Sequence
  PCR primer for ORF amplification
tggaagtggttcaggaatgtccggtgttaataatacatcc

SEQ ID NO: 19024 - DNA, 40 bp, Artificial Sequence
  PCR primer for ORF amplification
tggaagtggttcaggaatgagctctcaaaaggtttttggt

SEQ ID NO: 19025 - DNA, 40 bp, Artificial Sequence
  PCR primer for ORF amplification
tggaagtggttcaggaatgtcacttagattgccacaaaat

SEQ ID NO: 19026 - DNA, 40 bp, Artificial Sequence
  PCR primer for ORF amplification
tggaagtggttcaggaatgtctgatcaagaacgaggttca

SEQ ID NO: 19027 - DNA, 40 bp, Artificial Sequence
  PCR primer for ORF amplification
tggaagtggttcaggaatgtcttcattatatactaagttg

SEQ ID NO: 19028 - DNA, 40 bp, Artificial Sequence
  PCR primer for ORF amplification
tggaagtggttcaggaatgtttctggactattctggatat

SEQ ID NO: 19029 - DNA, 40 bp, Artificial Sequence
  PCR primer for ORF amplification
tggaagtggttcaggaatgaaactgaaaactgtaagatct

SEQ ID NO: 19030 - DNA, 40 bp, Artificial Sequence
  PCR primer for ORF amplification
tggaagtggttcaggaatgaaggatttaaaattatcgaat

SEQ ID NO: 19031 - DNA, 40 bp, Artificial Sequence
  PCR primer for ORF amplification
tggaagtggttcaggaatgactgatcgtaaaaccaacttg

SEQ ID NO: 19032 - DNA, 40 bp, Artificial Sequence
  PCR primer for ORF amplification
tggaagtggttcaggaatgatgaccaaagctttttttaac

SEQ ID NO: 19033 - DNA, 40 bp, Artificial Sequence
  PCR primer for ORF amplification
tggaagtggttcaggaatgtcatttcaaattgaaacggtt

SEQ ID NO: 19034 - DNA, 40 bp, Artificial Sequence
  PCR primer for ORF amplification
tggaagtggttcaggaatgtcacaagacgctgctattgca

SEQ ID NO: 19035 - DNA, 40 bp, Artificial Sequence; identical to SEQ ID NO: 19034
  PCR primer for ORF amplification

SEQ ID NO: 19036 - DNA, 40 bp, Artificial Sequence
  PCR primer for ORF amplification
tggaagtggttcaggaatgaaagaatcccctctcataacg

SEQ ID NO: 19037 - DNA, 40 bp, Artificial Sequence
  PCR primer for ORF amplification
tggaagtggttcaggaatgaattcaactcccgatctaata

SEQ ID NO: 19038 - DNA, 40 bp, Artificial Sequence
  PCR primer for ORF amplification
tggaagtggttcaggaatggaaggtttcttcaggataccc

SEQ ID NO: 19039 - DNA, 40 bp, Artificial Sequence
  PCR primer for ORF amplification
tggaagtggttcaggaatggacagcgtgtcaaaccttaag

SEQ ID NO: 19040 - DNA, 40 bp, Artificial Sequence
  PCR primer for ORF amplification
tggaagtggttcaggaatggttgccgctttaacgtatttg

SEQ ID NO: 19041 - DNA, 40 bp, Artificial Sequence
  PCR primer for ORF amplification
tggaagtggttcaggaatgtcacttctaatagattctgta

SEQ ID NO: 19042 - DNA, 40 bp, Artificial Sequence
  PCR primer for ORF amplification
tggaagtggttcaggaatgaatgatcctcgtgaaatttta

SEQ ID NO: 19043 - DNA, 40 bp, Artificial Sequence
  PCR primer for ORF amplification
tggaagtggttcaggaatgacggatgaaaaagtgaactca

SEQ ID NO: 19044 - DNA, 40 bp, Artificial Sequence
  PCR primer for ORF amplification
tggaagtggttcaggaatgagaagctctggcacatatgag

SEQ ID NO: 19045 - DNA, 40 bp, Artificial Sequence
  PCR primer for ORF amplification
tggaagtggttcaggaatgagtatgtcaagcaaaaacgag

SEQ ID NO: 19046 - DNA, 40 bp, Artificial Sequence
  PCR primer for ORF amplification
tggaagtggttcaggaatggattctagaacagttggtata

SEQ ID NO: 19047 - DNA, 40 bp, Artificial Sequence
  PCR primer for ORF amplification
tggaagtggttcaggaatgctatcaaaatcagaaaaaaat

SEQ ID NO: 19048 - DNA, 40 bp, Artificial Sequence
  PCR primer for ORF amplification
tggaagtggttcaggaatgctgaggaattgtttgaggaaa

SEQ ID NO: 19049 - DNA, 40 bp, Artificial Sequence
  PCR primer for ORF amplification
tggaagtggttcaggaatgggaagcgaaccgtttcagaaa

SEQ ID NO: 19050 - DNA, 40 bp, Artificial Sequence
  PCR primer for ORF amplification
tggaagtggttcaggaatggttatcatcctcctaggtctt

SEQ ID NO: 19051 - DNA, 40 bp, Artificial Sequence
  PCR primer for ORF amplification
tggaagtggttcaggaatgtctcccttaactagaaccgta

SEQ ID NO: 19052 - DNA, 40 bp, Artificial Sequence
  PCR primer for ORF amplification
tggaagtggttcaggaatgtgtggtatctttgcagccttc

SEQ ID NO: 19053 - DNA, 40 bp, Artificial Sequence
  PCR primer for ORF amplification
tggaagtggttcaggaatgtgtggtattttcgccgctttc

SEQ ID NO: 19054 - DNA, 40 bp, Artificial Sequence
  PCR primer for ORF amplification
tggaagtggttcaggaatgttgagatcatccgttgttcgt

SEQ ID NO: 19055 - DNA, 40 bp, Artificial Sequence
  PCR primer for ORF amplification
tggaagtggttcaggaatgcaagataccaaatactacgaa

SEQ ID NO: 19056 - DNA, 40 bp, Artificial Sequence
  PCR primer for ORF amplification
tggaagtggttcaggaatggatgaaactgtgaacatacaa

SEQ ID NO: 19057 - DNA, 40 bp, Artificial Sequence
  PCR primer for ORF amplification
tggaagtggttcaggaatgggtgtttctgcggtgttgaaa

SEQ ID NO: 19058 - DNA, 40 bp, Artificial Sequence
  PCR primer for ORF amplification
tggaagtggttcaggaatgtcagatgttacccaacagaaa

SEQ ID NO: 19059 - DNA, 40 bp, Artificial Sequence
  PCR primer for ORF amplification
tggaagtggttcaggaatgttacagcagggttcttcctcg

SEQ ID NO: 19060 - DNA, 40 bp, Artificial Sequence
  PCR primer for ORF amplification
tggaagtggttcaggaatgttgaatttcgcatcaagagcg

SEQ ID NO: 19061 - DNA, 40 bp, Artificial Sequence
  PCR primer for ORF amplification
tggaagtggttcaggaatggcagttgaggagaacaatatg

SEQ ID NO: 19062 - DNA, 40 bp, Artificial Sequence
  PCR primer for ORF amplification
tggaagtggttcaggaatggcgaaaaaaaactcacaattg

SEQ ID NO: 19063 - DNA, 40 bp, Artificial Sequence
  PCR primer for ORF amplification
tggaagtggttcaggaatggctttacatcaatttgactat

SEQ ID NO: 19064 - DNA, 40 bp, Artificial Sequence
  PCR primer for ORF amplification
tggaagtggttcaggaatgtcaattaggcctctcacgtta

SEQ ID NO: 19065 - DNA, 40 bp, Artificial Sequence
  PCR primer for ORF amplification
tggaagtggttcaggaatgtcggaaggaagaacgtttctg

SEQ ID NO: 19066 - DNA, 40 bp, Artificial Sequence
  PCR primer for ORF amplification
tggaagtggttcaggaatgtggaggagaatattcgcgcat

SEQ ID NO: 19067 - DNA, 40 bp, Artificial Sequence
  PCR primer for ORF amplification
tggaagtggttcaggaatgacggaaattgaatttgggcaa

SEQ ID NO: 19068 - DNA, 40 bp, Artificial Sequence
  PCR primer for ORF amplification
tggaagtggttcaggaatgattacaatgattaacaacaaa

SEQ ID NO: 19069 - DNA, 40 bp, Artificial Sequence
  PCR primer for ORF amplification
tggaagtggttcaggaatgcaatgtcgatcaattgtgcat

SEQ ID NO: 19070 - DNA, 40 bp, Artificial Sequence
  PCR primer for ORF amplification
tggaagtggttcaggaatgcagcaggacgacgattttcaa

SEQ ID NO: 19071 - DNA, 40 bp, Artificial Sequence
  PCR primer for ORF amplification
tggaagtggttcaggaatgctatcagcaaggtgcctcaaa

SEQ ID NO: 19072 - DNA, 40 bp, Artificial Sequence
  PCR primer for ORF amplification
tggaagtggttcaggaatgggctcctctttggatttggtg

SEQ ID NO: 19073 - DNA, 40 bp, Artificial Sequence
  PCR primer for ORF amplification
tggaagtggttcaggaatggtgaacgttggtccttctcat

SEQ ID NO: 19074 - DNA, 40 bp, Artificial Sequence
  PCR primer for ORF amplification
tggaagtggttcaggaatgaatgtgctgttaaaaagacgc

SEQ ID NO: 19075 - DNA, 40 bp, Artificial Sequence
  PCR primer for ORF amplification
tggaagtggttcaggaatgacaaaatatgagcgtgaccct

SEQ ID NO: 19076 - DNA, 40 bp, Artificial Sequence
  PCR primer for ORF amplification
tggaagtggttcaggaatgagtctggaacccacacaaacg

SEQ ID NO: 19077 - DNA, 40 bp, Artificial Sequence
  PCR primer for ORF amplification
tggaagtggttcaggaatgatcgccttaccagtagagaag

SEQ ID NO: 19078 - DNA, 40 bp, Artificial Sequence
  PCR primer for ORF amplification
tggaagtggttcaggaatgatttctgctactaattgggtt

SEQ ID NO: 19079 - DNA, 40 bp, Artificial Sequence
  PCR primer for ORF amplification
tggaagtggttcaggaatgtcagctactctactaaagcaa

SEQ ID NO: 19080 - DNA, 40 bp, Artificial Sequence
  PCR primer for ORF amplification
tggaagtggttcaggaatgtccctttctctgggtgccgct

SEQ ID NO: 19081 - DNA, 40 bp, Artificial Sequence
  PCR primer for ORF amplification
tggaagtggttcaggaatgtcgaatgagagcacacgagtt

SEQ ID NO: 19082 - DNA, 40 bp, Artificial Sequence
  PCR primer for ORF amplification
tggaagtggttcaggaatgtctgaagaagctgcctatcaa

SEQ ID NO: 19083 - DNA, 40 bp, Artificial Sequence
  PCR primer for ORF amplification
tggaagtggttcaggaatgttgaaatatcgtacattgtct

SEQ ID NO: 19084 - DNA, 40 bp, Artificial Sequence
  PCR primer for ORF amplification
tggaagtggttcaggaatgaaaggtgatcgttcgaggcaa

SEQ ID NO: 19085 - DNA, 40 bp, Artificial Sequence
  PCR primer for ORF amplification
tggaagtggttcaggaatgaacctttttgatgtggctgac

SEQ ID NO: 19086 - DNA, 40 bp, Artificial Sequence
  PCR primer for ORF amplification
tggaagtggttcaggaatggctgatattactgataagaca

SEQ ID NO: 19087 - DNA, 40 bp, Artificial Sequence
  PCR primer for ORF amplification
tggaagtggttcaggaatgggaaagctgataaagttaatc

SEQ ID NO: 19088 - DNA, 40 bp, Artificial Sequence
  PCR primer for ORF amplification
tggaagtggttcaggaatgtctaccgctaccatacaggat

SEQ ID NO: 19089 - DNA, 40 bp, Artificial Sequence
  PCR primer for ORF amplification
tggaagtggttcaggaatgaaatacgttgttgtttctggt

SEQ ID NO: 19090 - DNA, 40 bp, Artificial Sequence
  PCR primer for ORF amplification
tggaagtggttcaggaatgatccggttaccgaggctgtat

SEQ ID NO: 19091 - DNA, 40 bp, Artificial Sequence
  PCR primer for ORF amplification
tggaagtggttcaggaatgggttcatgttgtagttgcttg

SEQ ID NO: 19092 - DNA, 40 bp, Artificial Sequence
  PCR primer for ORF amplification
tggaagtggttcaggaatgtcaattcaggcttttgtcttt

SEQ ID NO: 19093 - DNA, 40 bp, Artificial Sequence
  PCR primer for ORF amplification
tggaagtggttcaggaatgaagtacgttgttgtttcaggt

SEQ ID NO: 19094 - DNA, 40 bp, Artificial Sequence
  PCR primer for ORF amplification
tggaagtggttcaggaatgaatagggacaacatggacaca

SEQ ID NO: 19095 - DNA, 40 bp, Artificial Sequence
  PCR primer for ORF amplification
tggaagtggttcaggaatgagtgagaccagctcaagtcgc

SEQ ID NO: 19096 - DNA, 40 bp, Artificial Sequence
  PCR primer for ORF amplification
tggaagtggttcaggaatggatgaaaacggtacagtaaag

SEQ ID NO: 19097 - DNA, 40 bp, Artificial Sequence
  PCR primer for ORF amplification
tggaagtggttcaggaatgtatgtcacttttaatgaggct

SEQ ID NO: 19098 - DNA, 40 bp, Artificial Sequence
  PCR primer for ORF amplification
tggaagtggttcaggaatgtccctttttaccaggcctttt

SEQ ID NO: 19099 - DNA, 40 bp, Artificial Sequence
  PCR primer for ORF amplification
tggaagtggttcaggaatgcttatcagatttagatcaaaa

SEQ ID NO: 19100 - DNA, 40 bp, Artificial Sequence
  PCR primer for ORF amplification
tggaagtggttcaggaatggccatattgaaggataccata

SEQ ID NO: 19101 - DNA, 40 bp, Artificial Sequence
  PCR primer for ORF amplification
tggaagtggttcaggaatggtattgcgcatacgaagaatt

SEQ ID NO: 19102 - DNA, 40 bp, Artificial Sequence
  PCR primer for ORF amplification
tggaagtggttcaggaatgtggataaatagactggttaaa

SEQ ID NO: 19103 - DNA, 40 bp, Artificial Sequence
  PCR primer for ORF amplification
tggaagtggttcaggaatgaactcgttagcttcaaacaca

SEQ ID NO: 19104 - DNA, 40 bp, Artificial Sequence
  PCR primer for ORF amplification
tggaagtggttcaggaatgacgatcatccataatcctaaa

SEQ ID NO: 19105 - DNA, 40 bp, Artificial Sequence
  PCR primer for ORF amplification
tggaagtggttcaggaatgactgatttcgatttaatgaat

SEQ ID NO: 19106 - DNA, 40 bp, Artificial Sequence
  PCR primer for ORF amplification
tggaagtggttcaggaatgtctaaacaatttagtcatacc

SEQ ID NO: 19107 - DNA, 40 bp, Artificial Sequence
  PCR primer for ORF amplification
tggaagtggttcaggaatggaggaaactaagtactcttcg

SEQ ID NO: 19108 - DNA, 40 bp, Artificial Sequence
  PCR primer for ORF amplification
tggaagtggttcaggaatgggcggtcaagaaagtatatca

SEQ ID NO: 19109 - DNA, 40 bp, Artificial Sequence
  PCR primer for ORF amplification
tggaagtggttcaggaatggtacaagaatcacgtccaggg

SEQ ID NO: 19110 - DNA, 40 bp, Artificial Sequence
  PCR primer for ORF amplification
tggaagtggttcaggaatgtctctaaagggtaaatttttc

SEQ ID NO: 19111 - DNA, 40 bp, Artificial Sequence
  PCR primer for ORF amplification
tggaagtggttcaggaatgcccaatacgcatactcaacat

SEQ ID NO: 19112 - DNA, 40 bp, Artificial Sequence
  PCR primer for ORF amplification
tggaagtggttcaggaatggatgaatttgaatctaccaaa

SEQ ID NO: 19113 - DNA, 40 bp, Artificial Sequence
  PCR primer for ORF amplification
tggaagtggttcaggaatgtcacaggtaatagaaccacaa

SEQ ID NO: 19114 - DNA, 40 bp, Artificial Sequence
  PCR primer for ORF amplification
tggaagtggttcaggaatgtcatcagatgcgttaaaagca

SEQ ID NO: 19115 - DNA, 40 bp, Artificial Sequence
  PCR primer for ORF amplification
tggaagtggttcaggaatgtcattcagattattcacgagg

SEQ ID NO: 19116 - DNA, 40 bp, Artificial Sequence
  PCR primer for ORF amplification
tggaagtggttcaggaatgtctatttggaaggaagctaaa

SEQ ID NO: 19117 - DNA, 40 bp, Artificial Sequence
  PCR primer for ORF amplification
tggaagtggttcaggaatgactatttctgatcatccagaa

SEQ ID NO: 19118 - DNA, 40 bp, Artificial Sequence
  PCR primer for ORF amplification
tggaagtggttcaggaatgccagtagtcaatcatgaggat

SEQ ID NO: 19119 - DNA, 40 bp, Artificial Sequence
  PCR primer for ORF amplification
tggaagtggttcaggaatgggaatacacataccatatctc

SEQ ID NO: 19120 - DNA, 40 bp, Artificial Sequence
  PCR primer for ORF amplification
tggaagtggttcaggaatgggggcaaagagtgtaacagcc

SEQ ID NO: 19121 - DNA, 40 bp, Artificial Sequence
  PCR primer for ORF amplification
tggaagtggttcaggaatgtccgctaaatcgtttgaagtc

SEQ ID NO: 19122 - DNA, 40 bp, Artificial Sequence
  PCR primer for ORF amplification
tggaagtggttcaggaatgtcgcgggaggcatttgatgta

SEQ ID NO: 19123 - DNA, 40 bp, Artificial Sequence
  PCR primer for ORF amplification
tggaagtggttcaggaatgatcacccaaactgagctagat

SEQ ID NO: 19124 - DNA, 40 bp, Artificial Sequence
  PCR primer for ORF amplification
tggaagtggttcaggaatgctgggccgggcactaatcaac

SEQ ID NO: 19125 - DNA, 40 bp, Artificial Sequence
  PCR primer for ORF amplification
tggaagtggttcaggaatggagaacgacaaggcgtcacat

SEQ ID NO: 19126 - DNA, 40 bp, Artificial Sequence
  PCR primer for ORF amplification
tggaagtggttcaggaatggaggaagtgttccgtttttac

SEQ ID NO: 19127 - DNA, 40 bp, Artificial Sequence
  PCR primer for ORF amplification
tggaagtggttcaggaatggatcaatttgagtatatcatt

SEQ ID NO: 19128 - DNA, 40 bp, Artificial Sequence
  PCR primer for ORF amplification
tggaagtggttcaggaatgggcttgttaacgaaagttgct

SEQ ID NO: 19129 - DNA, 40 bp, Artificial Sequence
  PCR primer for ORF amplification
tggaagtggttcaggaatgtcccatccgcactcacatagc

SEQ ID NO: 19130 - DNA, 40 bp, Artificial Sequence
  PCR primer for ORF amplification
tggaagtggttcaggaatgttacacaggcacggttctaag

SEQ ID NO: 19131 - DNA, 40 bp, Artificial Sequence
  PCR primer for ORF amplification
tggaagtggttcaggaatgactacagctagttcttctgct

SEQ ID NO: 19132 - DNA, 40 bp, Artificial Sequence
  PCR primer for ORF amplification
tggaagtggttcaggaatgctgattaggttaaagaagaga

SEQ ID NO: 19133 - DNA, 40 bp, Artificial Sequence
  PCR primer for ORF amplification
tggaagtggttcaggaatgctttctgaaaacacgactatt

SEQ ID NO: 19134 - DNA, 40 bp, Artificial Sequence
  PCR primer for ORF amplification
tggaagtggttcaggaatggacaaatataccaacagggat

SEQ ID NO: 19135 - DNA, 40 bp, Artificial Sequence
  PCR primer for ORF amplification
tggaagtggttcaggaatgtcacgaagtaacagtatatac

SEQ ID NO: 19136 - DNA, 40 bp, Artificial Sequence
  PCR primer for ORF amplification
tggaagtggttcaggaatgtcggatcattctcccatttct

SEQ ID NO: 19137 - DNA, 40 bp, Artificial Sequence
  PCR primer for ORF amplification
tggaagtggttcaggaatgttcattgaatactctagatta

SEQ ID NO: 19138 - DNA, 40 bp, Artificial Sequence
  PCR primer for ORF amplification
tggaagtggttcaggaatgttttcacttagttcgctatct

SEQ ID NO: 19139 - DNA, 40 bp, Artificial Sequence
  PCR primer for ORF amplification
tggaagtggttcaggaatgaacaaaacggaaaacctttct

SEQ ID NO: 19140 - DNA, 40 bp, Artificial Sequence
  PCR primer for ORF amplification
tggaagtggttcaggaatgaatagtcaaggttacgatgaa

SEQ ID NO: 19141 - DNA, 40 bp, Artificial Sequence
  PCR primer for ORF amplification
tggaagtggttcaggaatgagtaacaagaggacatctgta

SEQ ID NO: 19142 - DNA, 40 bp, Artificial Sequence
  PCR primer for ORF amplification
tggaagtggttcaggaatgagttccgtcaataaagatact

SEQ ID NO: 19143 - DNA, 40 bp, Artificial Sequence
  PCR primer for ORF amplification
tggaagtggttcaggaatgatgaatccacacgttcaagaa

SEQ ID NO: 19144 - DNA, 40 bp, Artificial Sequence
  PCR primer for ORF amplification
tggaagtggttcaggaatggacaagtatttgaattcattt

SEQ ID NO: 19145 - DNA, 40 bp, Artificial Sequence
  PCR primer for ORF amplification
tggaagtggttcaggaatggatatactcaagaggggaaat

SEQ ID NO: 19146 - DNA, 40 bp, Artificial Sequence
  PCR primer for ORF amplification
tggaagtggttcaggaatggcgaaccgtcttctcatatac

SEQ ID NO: 19147 - DNA, 40 bp, Artificial Sequence
  PCR primer for ORF amplification
tggaagtggttcaggaatgtctgcaattaatcatctttgt

SEQ ID NO: 19148 - DNA, 40 bp, Artificial Sequence
  PCR primer for ORF amplification
tggaagtggttcaggaatgttgtggaagcgtacttgcaca

SEQ ID NO: 19149 - DNA, 40 bp, Artificial Sequence
  PCR primer for ORF amplification
tggaagtggttcaggaatgtttactggtcaggagtatcat

SEQ ID NO: 19150 - DNA, 40 bp, Artificial Sequence
  PCR primer for ORF amplification
tggaagtggttcaggaatgaagcttctaaaggacttattg

SEQ ID NO: 19151 - DNA, 40 bp, Artificial Sequence
  PCR primer for ORF amplification
tggaagtggttcaggaatggcaagaccaatcgatgttagt

SEQ ID NO: 19152 - DNA, 40 bp, Artificial Sequence
  PCR primer for ORF amplification
tggaagtggttcaggaatgtcaacacttagcgatagtgat

SEQ ID NO: 19153 - DNA, 40 bp, Artificial Sequence
  PCR primer for ORF amplification
tggaagtggttcaggaatgtcaagcttatacatcaaaaca

SEQ ID NO: 19154 - DNA, 40 bp, Artificial Sequence
  PCR primer for ORF amplification
tggaagtggttcaggaatgactatttcttctgcacatcca

SEQ ID NO: 19155 - DNA, 40 bp, Artificial Sequence; identical to SEQ ID NO: 19154
  PCR primer for ORF amplification

SEQ ID NO: 19156 - DNA, 40 bp, Artificial Sequence
  PCR primer for ORF amplification
tggaagtggttcaggaatgagtggagtatcaaataaaaca

SEQ ID NO: 19157 - DNA, 40 bp, Artificial Sequence
  PCR primer for ORF amplification
tggaagtggttcaggaatgtcattgacagccgatgaatac

SEQ ID NO: 19158 - DNA, 40 bp, Artificial Sequence
  PCR primer for ORF amplification
tggaagtggttcaggaatgtttgatcatgacgtcgaatat

SEQ ID NO: 19159 - DNA, 40 bp, Artificial Sequence
  PCR primer for ORF amplification
tggaagtggttcaggaatgaagacctgctactatgagctt

SEQ ID NO: 19160 - DNA, 40 bp, Artificial Sequence
  PCR primer for ORF amplification
tggaagtggttcaggaatgacaaattcaaaagaagacgcc

SEQ ID NO: 19161 - DNA, 40 bp, Artificial Sequence
  PCR primer for ORF amplification
tggaagtggttcaggaatgccccccgtaccaatatacgtg

SEQ ID NO: 19162 - DNA, 40 bp, Artificial Sequence
  PCR primer for ORF amplification
tggaagtggttcaggaatgccgaagagaaaaattgctcct

SEQ ID NO: 19163 - DNA, 40 bp, Artificial Sequence
  PCR primer for ORF amplification
tggaagtggttcaggaatggctgttataagaattaaaaaa

SEQ ID NO: 19164 - DNA, 40 bp, Artificial Sequence
  PCR primer for ORF amplification
tggaagtggttcaggaatgccaagaaaaaagtctgccgct

SEQ ID NO: 19165 - DNA, 40 bp, Artificial Sequence
  PCR primer for ORF amplification
tggaagtggttcaggaatgctaaaatacaaacctttacta

SEQ ID NO: 19166 - DNA, 40 bp, Artificial Sequence
  PCR primer for ORF amplification
tggaagtggttcaggaatggaggactctaataatgaagcc

SEQ ID NO: 19167 - DNA, 40 bp, Artificial Sequence
  PCR primer for ORF amplification
tggaagtggttcaggaatgggcaaatataccaagactgcg

SEQ ID NO: 19168 - DNA, 40 bp, Artificial Sequence
  PCR primer for ORF amplification
tggaagtggttcaggaatgtctcaacaagataatgtcaaa

SEQ ID NO: 19169 - DNA, 40 bp, Artificial Sequence
  PCR primer for ORF amplification
tggaagtggttcaggaatgtctcacaaacaattcaaatca

SEQ ID NO: 19170 - DNA, 40 bp, Artificial Sequence
  PCR primer for ORF amplification
tggaagtggttcaggaatgaccgaagactttatttcttct

SEQ ID NO: 19171 - DNA, 40 bp, Artificial Sequence
  PCR primer for ORF amplification
tggaagtggttcaggaatggccaattacacaaaaaccgca

SEQ ID NO: 19172 - DNA, 40 bp, Artificial Sequence
  PCR primer for ORF amplification
tggaagtggttcaggaatggctttggaacctattgattat

SEQ ID NO: 19173 - DNA, 40 bp, Artificial Sequence
  PCR primer for ORF amplification
tggaagtggttcaggaatgtcggaacttgaaaacgctcat

SEQ ID NO: 19174 - DNA, 40 bp, Artificial Sequence
  PCR primer for ORF amplification
tggaagtggttcaggaatgttatcactgtctgccaaaaat

SEQ ID NO: 19175 - DNA, 40 bp, Artificial Sequence
  PCR primer for ORF amplification
tggaagtggttcaggaatgacaatttcgaataaatcgtgg

SEQ ID NO: 19176 - DNA, 40 bp, Artificial Sequence
  PCR primer for ORF amplification
tggaagtggttcaggaatggctctagctatctcccacgag

SEQ ID NO: 19177 - DNA, 40 bp, Artificial Sequence
  PCR primer for ORF amplification
tggaagtggttcaggaatggtacgagacttagtgacattg

SEQ ID NO: 19178 - DNA, 40 bp, Artificial Sequence
  PCR primer for ORF amplification
tggaagtggttcaggaatgtattcaattgttaaagagatt

SEQ ID NO: 19179 - DNA, 40 bp, Artificial Sequence
  PCR primer for ORF amplification
tggaagtggttcaggaatgtcagaactctttggagtattg

SEQ ID NO: 19180 - DNA, 40 bp, Artificial Sequence
  PCR primer for ORF amplification
tggaagtggttcaggaatgaataactccaaaattcctaaa

SEQ ID NO: 19181 - DNA, 40 bp, Artificial Sequence
  PCR primer for ORF amplification
tggaagtggttcaggaatgacaatggcaacaaccgcaatg

SEQ ID NO: 19182 - DNA, 40 bp, Artificial Sequence
  PCR primer for ORF amplification
tggaagtggttcaggaatgagctatgagaaaaagtctgtg

SEQ ID NO: 19183 - DNA, 40 bp, Artificial Sequence
  PCR primer for ORF amplification
tggaagtggttcaggaatgagtagtattgttaataaaagt

SEQ ID NO: 19184 - DNA, 40 bp, Artificial Sequence
  PCR primer for ORF amplification
tggaagtggttcaggaatgtctgtccgtacttcttcaaga

SEQ ID NO: 19185 - DNA, 40 bp, Artificial Sequence
  PCR primer for ORF amplification
tggaagtggttcaggaatgcctaccgtctccgtgaacaag

SEQ ID NO: 19186 - DNA, 40 bp, Artificial Sequence
  PCR primer for ORF amplification
tggaagtggttcaggaatgaaattatctgtcctcacattt

SEQ ID NO: 19187 - DNA, 40 bp, Artificial Sequence
  PCR primer for ORF amplification
tggaagtggttcaggaatgacaaaggaacgtatgaccatc

SEQ ID NO: 19188 - DNA, 40 bp, Artificial Sequence
  PCR primer for ORF amplification
tggaagtggttcaggaatgacatgcctaattttatggtat

SEQ ID NO: 19189 - DNA, 40 bp, Artificial Sequence
  PCR primer for ORF amplification
tggaagtggttcaggaatgccagtgtgtaagaactgtcac

SEQ ID NO: 19190 - DNA, 40 bp, Artificial Sequence
  PCR primer for ORF amplification
tggaagtggttcaggaatgaacaccggtatctcgcccaaa

SEQ ID NO: 19191 - DNA, 40 bp, Artificial Sequence
  PCR primer for ORF amplification
tggaagtggttcaggaatgctgcttaccaaaaggttttca

SEQ ID NO: 19192 - DNA, 40 bp, Artificial Sequence
  PCR primer for ORF amplification
tggaagtggttcaggaatgacaaagaggagaaacctcttt

SEQ ID NO: 19193 - DNA, 40 bp, Artificial Sequence
  PCR primer for ORF amplification
tggaagtggttcaggaatgagcttcagtagtatagtctct

SEQ ID NO: 19194 - DNA, 40 bp, Artificial Sequence
  PCR primer for ORF amplification
tggaagtggttcaggaatgagtttcggtagtaaagtctcc

SEQ ID NO: 19195 - DNA, 40 bp, Artificial Sequence
  PCR primer for ORF amplification
tggaagtggttcaggaatgaccgatgtgttgagaagccta

SEQ ID NO: 19196 - DNA, 40 bp, Artificial Sequence
  PCR primer for ORF amplification
tggaagtggttcaggaatgagcggatttcacaatgttgga

SEQ ID NO: 19197 - DNA, 40 bp, Artificial Sequence
  PCR primer for ORF amplification
tggaagtggttcaggaatgagtttcggtacgagaatctcc

SEQ ID NO: 19198 - DNA, 40 bp, Artificial Sequence
  PCR primer for ORF amplification
tggaagtggttcaggaatgatagatatcaacgttaataac

SEQ ID NO: 19199 - DNA, 40 bp, Artificial Sequence
  PCR primer for ORF amplification
tggaagtggttcaggaatggttgcctattctccaatcatt

SEQ ID NO: 19200 - DNA, 40 bp, Artificial Sequence
  PCR primer for ORF amplification
tggaagtggttcaggaatgaagatcacagaaaaattagag

SEQ ID NO: 19201 - DNA, 40 bp, Artificial Sequence
  PCR primer for ORF amplification
tggaagtggttcaggaatgattaacgataaactagtacat

SEQ ID NO: 19202 - DNA, 40 bp, Artificial Sequence
  PCR primer for ORF amplification
tggaagtggttcaggaatgttgtgttcagtaattcagaga

SEQ ID NO: 19203 - DNA, 40 bp, Artificial Sequence
  PCR primer for ORF amplification
tggaagtggttcaggaatgctcaaccatcccagccaaggc

SEQ ID NO: 19204 - DNA, 40 bp, Artificial Sequence
  PCR primer for ORF amplification
tggaagtggttcaggaatgagctacatagttgacctacaa

SEQ ID NO: 19205 - DNA, 40 bp, Artificial Sequence
  PCR primer for ORF amplification
tggaagtggttcaggaatgaaaaacttatcttttctcata

SEQ ID NO: 19206 - DNA, 40 bp, Artificial Sequence
  PCR primer for ORF amplification
tggaagtggttcaggaatgaacttgctaattgaccggatg

SEQ ID NO: 19207 - DNA, 40 bp, Artificial Sequence
  PCR primer for ORF amplification
tggaagtggttcaggaatgagtaatacttcttcgtacgag

SEQ ID NO: 19208 - DNA, 40 bp, Artificial Sequence
  PCR primer for ORF amplification
tggaagtggttcaggaatgatactaaagcttgtacactgt

SEQ ID NO: 19209 - DNA, 40 bp, Artificial Sequence
  PCR primer for ORF amplification
tggaagtggttcaggaatgcctgagcaagaaccattgagt

SEQ ID NO: 19210 - DNA, 40 bp, Artificial Sequence
  PCR primer for ORF amplification
tggaagtggttcaggaatgcgctcagtcactaatgcattt

SEQ ID NO: 19211 - DNA, 40 bp, Artificial Sequence
  PCR primer for ORF amplification
tggaagtggttcaggaatggacgaggttgacgatattcta

SEQ ID NO: 19212 - DNA, 40 bp, Artificial Sequence
  PCR primer for ORF amplification
tggaagtggttcaggaatgactggtatgaatgataataat

SEQ ID NO: 19213 - DNA, 40 bp, Artificial Sequence
  PCR primer for ORF amplification
tggaagtggttcaggaatgatacaatcagacgaagataat

SEQ ID NO: 19214 - DNA, 40 bp, Artificial Sequence
  PCR primer for ORF amplification
tggaagtggttcaggaatgcctagaaacccattgaaaaag

SEQ ID NO: 19215 - DNA, 40 bp, Artificial Sequence
  PCR primer for ORF amplification
tggaagtggttcaggaatgttaagtcctgaacgtagacca

SEQ ID NO: 19216 - DNA, 40 bp, Artificial Sequence
  PCR primer for ORF amplification
tggaagtggttcaggaatgagtgccaatagcccgacagga

SEQ ID NO: 19217 - DNA, 40 bp, Artificial Sequence
  PCR primer for ORF amplification
tggaagtggttcaggaatgagtggcacagctaatagtagg

SEQ ID NO: 19218 - DNA, 40 bp, Artificial Sequence
  PCR primer for ORF amplification
tggaagtggttcaggaatgcatttccccaaaaaaaagcat

SEQ ID NO: 19219 - DNA, 40 bp, Artificial Sequence
  PCR primer for ORF amplification
tggaagtggttcaggaatggctgaactgagcgaacaagtg

SEQ ID NO: 19220 - DNA, 40 bp, Artificial Sequence
  PCR primer for ORF amplification
tggaagtggttcaggaatggtaaaacattcgttcatagcg

SEQ ID NO: 19221 - DNA, 40 bp, Artificial Sequence
  PCR primer for ORF amplification
tggaagtggttcaggaatggtagaactggaaaaaagaaga

SEQ ID NO: 19222 - DNA, 40 bp, Artificial Sequence
  PCR primer for ORF amplification
tggaagtggttcaggaatgtcagatcctatagtaacgtct

SEQ ID NO: 19223 - DNA, 40 bp, Artificial Sequence
  PCR primer for ORF amplification
tggaagtggttcaggaatgtcttcagacgctataagaaat

SEQ ID NO: 19224 - DNA, 40 bp, Artificial Sequence
  PCR primer for ORF amplification
tggaagtggttcaggaatgagaatcaagaagaaaaacacc

SEQ ID NO: 19225 - DNA, 40 bp, Artificial Sequence
  PCR primer for ORF amplification
tggaagtggttcaggaatgcagacgtcaatggtgagcgca

SEQ ID NO: 19226 - DNA, 40 bp, Artificial Sequence
  PCR primer for ORF amplification
tggaagtggttcaggaatggagacgccgcaaatgaacgct

SEQ ID NO: 19227 - DNA, 40 bp, Artificial Sequence
  PCR primer for ORF amplification
tggaagtggttcaggaatgtcgtcaagcctttttatcctg

SEQ ID NO: 19228 - DNA, 40 bp, Artificial Sequence
  PCR primer for ORF amplification
tggaagtggttcaggaatgtctaataaacaactagtaaag

SEQ ID NO: 19229 - DNA, 40 bp, Artificial Sequence
  PCR primer for ORF amplification
tggaagtggttcaggaatgaatacattaaggtgtttgaca

SEQ ID NO: 19230 - DNA, 40 bp, Artificial Sequence
  PCR primer for ORF amplification
tggaagtggttcaggaatgctggaaactgatcactctagg

SEQ ID NO: 19231 - DNA, 40 bp, Artificial Sequence
  PCR primer for ORF amplification
tggaagtggttcaggaatggagcaacatctcaaatcaatt

SEQ ID NO: 19232 - DNA, 40 bp, Artificial Sequence
  PCR primer for ORF amplification
tggaagtggttcaggaatgtcaaagtcattggaatgggat

SEQ ID NO: 19233 - DNA, 40 bp, Artificial Sequence
  PCR primer for ORF amplification
tggaagtggttcaggaatgagtaacgaagcttaccagcat

SEQ ID NO: 19234 - DNA, 40 bp, Artificial Sequence
  PCR primer for ORF amplification
tggaagtggttcaggaatggacagatctaaggacgctaga

SEQ ID NO: 19235 - DNA, 40 bp, Artificial Sequence
  PCR primer for ORF amplification
tggaagtggttcaggaatggagctgatactaaacagcctc

SEQ ID NO: 19236 - DNA, 40 bp, Artificial Sequence
  PCR primer for ORF amplification
tggaagtggttcaggaatggctagcacagcaaatatgatt

SEQ ID NO: 19237 - DNA, 40 bp, Artificial Sequence
  PCR primer for ORF amplification
tggaagtggttcaggaatgaagatgcctctaaagaagatg

SEQ ID NO: 19238 - DNA, 40 bp, Artificial Sequence
  PCR primer for ORF amplification
tggaagtggttcaggaatgaaggtcattctccttaagccg

SEQ ID NO: 19239 - DNA, 40 bp, Artificial Sequence
  PCR primer for ORF amplification
tggaagtggttcaggaatgagtgataaaaacagtcgtatc

SEQ ID NO: 19240 - DNA, 40 bp, Artificial Sequence
  PCR primer for ORF amplification
tggaagtggttcaggaatgcacactaactcacccttacga

SEQ ID NO: 19241 - DNA, 40 bp, Artificial Sequence
  PCR primer for ORF amplification
tggaagtggttcaggaatgtttaaccgtaccactcaactg

SEQ ID NO: 19242 - DNA, 40 bp, Artificial Sequence; identical to SEQ ID NO: 19205
  PCR primer for ORF amplification

SEQ ID NO: 19243 - DNA, 40 bp, Artificial Sequence
  PCR primer for ORF amplification
tggaagtggttcaggaatgaagaattcgacagctgctagt

SEQ ID NO: 19244 - DNA, 40 bp, Artificial Sequence
  PCR primer for ORF amplification
tggaagtggttcaggaatgaattctagctatacacagaga

SEQ ID NO: 19245 - DNA, 40 bp, Artificial Sequence
  PCR primer for ORF amplification
tggaagtggttcaggaatgccaaattacattttctggcca

SEQ ID NO: 19246 - DNA, 40 bp, Artificial Sequence
  PCR primer for ORF amplification
tggaagtggttcaggaatgctatcttcagaagattttgga

SEQ ID NO: 19247 - DNA, 40 bp, Artificial Sequence
  PCR primer for ORF amplification
tggaagtggttcaggaatggataatattttaaaggcatca

SEQ ID NO: 19248 - DNA, 40 bp, Artificial Sequence
  PCR primer for ORF amplification
tggaagtggttcaggaatgtccagcttagccgatacagta

SEQ ID NO: 19249 - DNA, 40 bp, Artificial Sequence
  PCR primer for ORF amplification
tggaagtggttcaggaatgtcgatgttaagaatctggagt

SEQ ID NO: 19250 - DNA, 40 bp, Artificial Sequence
  PCR primer for ORF amplification
tggaagtggttcaggaatgacggagactaaggatttgttg

SEQ ID NO: 19251 - DNA, 40 bp, Artificial Sequence
  PCR primer for ORF amplification
tggaagtggttcaggaatgagtgaaagtggtcaagaacaa

SEQ ID NO: 19252 - DNA, 40 bp, Artificial Sequence
  PCR primer for ORF amplification
tggaagtggttcaggaatgatcctcacactggcctatttc

SEQ ID NO: 19253 - DNA, 40 bp, Artificial Sequence
  PCR primer for ORF amplification
tggaagtggttcaggaatgccaccagtatctgcgtcaaag

SEQ ID NO: 19254 - DNA, 40 bp, Artificial Sequence
  PCR primer for ORF amplification
tggaagtggttcaggaatgccagaaagctctagagataag

SEQ ID NO: 19255 - DNA, 40 bp, Artificial Sequence
  PCR primer for ORF amplification
tggaagtggttcaggaatgcttaaaataaaggcccttttc

SEQ ID NO: 19256 - DNA, 40 bp, Artificial Sequence
  PCR primer for ORF amplification
tggaagtggttcaggaatggtacgcaaaggctcaaacaga

SEQ ID NO: 19257 - DNA, 40 bp, Artificial Sequence
  PCR primer for ORF amplification
tggaagtggttcaggaatggagatattcaaggaagaagaa

SEQ ID NO: 19258 - DNA, 40 bp, Artificial Sequence
  PCR primer for ORF amplification
tggaagtggttcaggaatggcgcgtcaaaagcttactttc

SEQ ID NO: 19259 - DNA, 40 bp, Artificial Sequence
  PCR primer for ORF amplification
tggaagtggttcaggaatggcttacagtgactacagcgat

SEQ ID NO: 19260 - DNA, 40 bp, Artificial Sequence
  PCR primer for ORF amplification
tggaagtggttcaggaatgggcaggtttagtaacataata

SEQ ID NO: 19261 - DNA, 40 bp, Artificial Sequence
  PCR primer for ORF amplification
tggaagtggttcaggaatgtattctatttcaaacaaaaaa

SEQ ID NO: 19262 - DNA, 40 bp, Artificial Sequence
  PCR primer for ORF amplification
tggaagtggttcaggaatgtctacatctttccaggagttc

SEQ ID NO: 19263 - DNA, 40 bp, Artificial Sequence
  PCR primer for ORF amplification
tggaagtggttcaggaatgaataaattctgtctactacct

SEQ ID NO: 19264 - DNA, 40 bp, Artificial Sequence
  PCR primer for ORF amplification
tggaagtggttcaggaatggacgtaggaagttgctcagtg

SEQ ID NO: 19265 - DNA, 40 bp, Artificial Sequence
  PCR primer for ORF amplification
tggaagtggttcaggaatggctagacaattattcactcct

SEQ ID NO: 19266 - DNA, 40 bp, Artificial Sequence
  PCR primer for ORF amplification
tggaagtggttcaggaatggtggtttcttataacaataat

SEQ ID NO: 19267 - DNA, 40 bp, Artificial Sequence
  PCR primer for ORF amplification
tggaagtggttcaggaatgtcatttaaggcaactatcacc

SEQ ID NO: 19268 - DNA, 40 bp, Artificial Sequence
  PCR primer for ORF amplification
tggaagtggttcaggaatggctgaaggtgttttccaaggt

SEQ ID NO: 19269 - DNA, 40 bp, Artificial Sequence; identical to SEQ ID NO: 19268
  PCR primer for ORF amplification

SEQ ID NO: 19270 - DNA, 40 bp, Artificial Sequence
  PCR primer for ORF amplification
tggaagtggttcaggaatgaaaggcgaacctaagacttac

SEQ ID NO: 19271 - DNA, 40 bp, Artificial Sequence
  PCR primer for ORF amplification
tggaagtggttcaggaatgacacacatcacactgggacaa

SEQ ID NO: 19272 - DNA, 40 bp, Artificial Sequence
  PCR primer for ORF amplification
tggaagtggttcaggaatgtctaagcagtttgttcgttct

SEQ ID NO: 19273 - DNA, 40 bp, Artificial Sequence
  PCR primer for ORF amplification
tggaagtggttcaggaatgaagggattatcctcattaata

SEQ ID NO: 19274 - DNA, 40 bp, Artificial Sequence
  PCR primer for ORF amplification
tggaagtggttcaggaatgagtgatcaagaatctgttgtt

SEQ ID NO: 19275 - DNA, 40 bp, Artificial Sequence
  PCR primer for ORF amplification
tggaagtggttcaggaatggccttattggagaagttgcat

SEQ ID NO: 19276 - DNA, 40 bp, Artificial Sequence
  PCR primer for ORF amplification
tggaagtggttcaggaatgagttctagtgttgttggtgcc

SEQ ID NO: 19277 - DNA, 40 bp, Artificial Sequence; identical to SEQ ID NO: 19276
  PCR primer for ORF amplification

SEQ ID NO: 19278 - DNA, 40 bp, Artificial Sequence
  PCR primer for ORF amplification
tggaagtggttcaggaatgagactttcgtttggtaaacag

SEQ ID NO: 19279 - DNA, 40 bp, Artificial Sequence
  PCR primer for ORF amplification
tggaagtggttcaggaatgctaagctatttccaagggttt

SEQ ID NO: 19280 - DNA, 40 bp, Artificial Sequence
  PCR primer for ORF amplification
tggaagtggttcaggaatgtcatctatctctttgaaggaa

SEQ ID NO: 19281 - DNA, 40 bp, Artificial Sequence
  PCR primer for ORF amplification
tggaagtggttcaggaatgaaaaatatcatttcattggta

SEQ ID NO: 19282 - DNA, 40 bp, Artificial Sequence
  PCR primer for ORF amplification
tggaagtggttcaggaatgagcgaccttaaccaatccaaa

SEQ ID NO: 19283 - DNA, 40 bp, Artificial Sequence
  PCR primer for ORF amplification
tggaagtggttcaggaatgatcatcaataggcgtattttg

SEQ ID NO: 19284 - DNA, 40 bp, Artificial Sequence
  PCR primer for ORF amplification
tggaagtggttcaggaatggctcacgaggttcatagaata

SEQ ID NO: 19285 - DNA, 40 bp, Artificial Sequence
  PCR primer for ORF amplification
tggaagtggttcaggaatgtataagaagctggctattgcc

SEQ ID NO: 19286 - DNA, 40 bp, Artificial Sequence
  PCR primer for ORF amplification
tggaagtggttcaggaatgtcgtcgtcaattacagatgag

SEQ ID NO: 19287 - DNA, 40 bp, Artificial Sequence
  PCR primer for ORF amplification
tggaagtggttcaggaatgaagagcttcattacaaggaac

SEQ ID NO: 19288 - DNA, 40 bp, Artificial Sequence
  PCR primer for ORF amplification
tggaagtggttcaggaatggcagacttgccacagaaggta

SEQ ID NO: 19289 - DNA, 40 bp, Artificial Sequence
  PCR primer for ORF amplification
tggaagtggttcaggaatgaccaaaaaactaccttcagag

SEQ ID NO: 19290 - DNA, 40 bp, Artificial Sequence
  PCR primer for ORF amplification
tggaagtggttcaggaatgccagagtatacgctactggct

SEQ ID NO: 19291 - DNA, 40 bp, Artificial Sequence
  PCR primer for ORF amplification
tggaagtggttcaggaatgccgttaatgtccaattcggaa

SEQ ID NO: 19292 - DNA, 40 bp, Artificial Sequence
  PCR primer for ORF amplification
tggaagtggttcaggaatgggtagtagacgtcataagaac

SEQ ID NO: 19293 - DNA, 40 bp, Artificial Sequence
  PCR primer for ORF amplification
tggaagtggttcaggaatgatcataagattgcatttttac

SEQ ID NO: 19294 - DNA, 40 bp, Artificial Sequence
  PCR primer for ORF amplification
tggaagtggttcaggaatgcatagcgatactaacggtcga

SEQ ID NO: 19295 - DNA, 40 bp, Artificial Sequence
  PCR primer for ORF amplification
tggaagtggttcaggaatggacgatagtgtcagtttcatt

SEQ ID NO: 19296 - DNA, 40 bp, Artificial Sequence
  PCR primer for ORF amplification
tggaagtggttcaggaatggttaaagagagtattattgct

SEQ ID NO: 19297 - DNA, 40 bp, Artificial Sequence
  PCR primer for ORF amplification
tggaagtggttcaggaatgtacaatcctgtggacgctgtt

SEQ ID NO: 19298 - DNA, 40 bp, Artificial Sequence
  PCR primer for ORF amplification
tggaagtggttcaggaatgagagactctaatcatcgatca

SEQ ID NO: 19299 - DNA, 40 bp, Artificial Sequence
  PCR primer for ORF amplification
tggaagtggttcaggaatgagggatattgtatttgtatca

SEQ ID NO: 19300 - DNA, 40 bp, Artificial Sequence
  PCR primer for ORF amplification
tggaagtggttcaggaatgatcgaagtcccagaagacaat

SEQ ID NO: 19301 - DNA, 40 bp, Artificial Sequence
  PCR primer for ORF amplification
tggaagtggttcaggaatgattgaagaaagagatttggtt

SEQ ID NO: 19302 - DNA, 40 bp, Artificial Sequence
  PCR primer for ORF amplification
tggaagtggttcaggaatgctaaatggggaagactttgta

SEQ ID NO: 19303 - DNA, 40 bp, Artificial Sequence
  PCR primer for ORF amplification
tggaagtggttcaggaatggagggctcatatctatctgca

SEQ ID NO: 19304 - DNA, 40 bp, Artificial Sequence
  PCR primer for ORF amplification
tggaagtggttcaggaatgggcagatcaaagaaaagatca

SEQ ID NO: 19305 - DNA, 40 bp, Artificial Sequence
  PCR primer for ORF amplification
tggaagtggttcaggaatggttaaggaaactccattacac

SEQ ID NO: 19306 - DNA, 40 bp, Artificial Sequence
  PCR primer for ORF amplification
tggaagtggttcaggaatgagcagtgttcaactttcgagg

SEQ ID NO: 19307 - DNA, 40 bp, Artificial Sequence
  PCR primer for ORF amplification
tggaagtggttcaggaatgtcagttgaagtagataagcac

SEQ ID NO: 19308 - DNA, 40 bp, Artificial Sequence
  PCR primer for ORF amplification
tggaagtggttcaggaatgttcgaccaattagcagtcttt

SEQ ID NO: 19309 - DNA, 40 bp, Artificial Sequence
  PCR primer for ORF amplification
tggaagtggttcaggaatgaacagacaggaatccataaat

SEQ ID NO: 19310 - DNA, 40 bp, Artificial Sequence
  PCR primer for ORF amplification
tggaagtggttcaggaatgagattacattatagaagaaga

SEQ ID NO: 19311 - DNA, 40 bp, Artificial Sequence
  PCR primer for ORF amplification
tggaagtggttcaggaatgagcttttccaccataaatagc

SEQ ID NO: 19312 - DNA, 40 bp, Artificial Sequence
  PCR primer for ORF amplification
tggaagtggttcaggaatgctaatcacacgtttacgggtc

SEQ ID NO: 19313 - DNA, 40 bp, Artificial Sequence
  PCR primer for ORF amplification
tggaagtggttcaggaatggtacgtcgatggattcctagt

SEQ ID NO: 19314 - DNA, 40 bp, Artificial Sequence
  PCR primer for ORF amplification
tggaagtggttcaggaatgtccgttagcacgccaagtgag

SEQ ID NO: 19315 - DNA, 40 bp, Artificial Sequence
  PCR primer for ORF amplification
tggaagtggttcaggaatgttgcaaggaattttagaaacc

SEQ ID NO: 19316 - DNA, 40 bp, Artificial Sequence
  PCR primer for ORF amplification
tggaagtggttcaggaatgttgttctactcgttcgtgtgg

SEQ ID NO: 19317 - DNA, 40 bp, Artificial Sequence
  PCR primer for ORF amplification
tggaagtggttcaggaatgtttagtcactaccgctataaa

SEQ ID NO: 19318 - DNA, 40 bp, Artificial Sequence
  PCR primer for ORF amplification
tggaagtggttcaggaatgacaggtccaatagtgtacgtt

SEQ ID NO: 19319 - DNA, 40 bp, Artificial Sequence
  PCR primer for ORF amplification
tggaagtggttcaggaatgcccgctgaaattgacattgat

SEQ ID NO: 19320 - DNA, 40 bp, Artificial Sequence
  PCR primer for ORF amplification
tggaagtggttcaggaatgcttggcgaagatgaagggaat

SEQ ID NO: 19321 - DNA, 40 bp, Artificial Sequence
  PCR primer for ORF amplification
tggaagtggttcaggaatggttaatcagggccaaccgcaa

SEQ ID NO: 19322 - DNA, 40 bp, Artificial Sequence
  PCR primer for ORF amplification
tggaagtggttcaggaatgtcatcgagcaagaaaatcgtc

SEQ ID NO: 19323 - DNA, 40 bp, Artificial Sequence
  PCR primer for ORF amplification
tggaagtggttcaggaatggacttgaatcaaagaaaggaa

SEQ ID NO: 19324 - DNA, 40 bp, Artificial Sequence
  PCR primer for ORF amplification
tggaagtggttcaggaatgaactcttccacttcttcagaa

SEQ ID NO: 19325 - DNA, 40 bp, Artificial Sequence
  PCR primer for ORF amplification
tggaagtggttcaggaatgagattccaccgtcaaggtacc

SEQ ID NO: 19326 - DNA, 40 bp, Artificial Sequence
  PCR primer for ORF amplification
tggaagtggttcaggaatggaaaatcttggcgacaaactt

SEQ ID NO: 19327 - DNA, 40 bp, Artificial Sequence
  PCR primer for ORF amplification
tggaagtggttcaggaatggctactccccatttatatcac

SEQ ID NO: 19328 - DNA, 40 bp, Artificial Sequence
  PCR primer for ORF amplification
tggaagtggttcaggaatggtggtgcagaaaaaacttagg

SEQ ID NO: 19329 - DNA, 40 bp, Artificial Sequence
  PCR primer for ORF amplification
tggaagtggttcaggaatgttatcaaggtacaaccgcgtt

SEQ ID NO: 19330 - DNA, 40 bp, Artificial Sequence
  PCR primer for ORF amplification
tggaagtggttcaggaatgcctgctgtcttgagaaccagg

SEQ ID NO: 19331 - DNA, 40 bp, Artificial Sequence
  PCR primer for ORF amplification
tggaagtggttcaggaatggactacaacatatttgaggcg

SEQ ID NO: 19332 - DNA, 40 bp, Artificial Sequence
  PCR primer for ORF amplification
tggaagtggttcaggaatggtagttaagaagcgtaagttg

SEQ ID NO: 19333 - DNA, 40 bp, Artificial Sequence
  PCR primer for ORF amplification
tggaagtggttcaggaatggtgccattggaagatctgctt

SEQ ID NO: 19334 - DNA, 40 bp, Artificial Sequence
  PCR primer for ORF amplification
tggaagtggttcaggaatgaatgacgacagccaggataaa

SEQ ID NO: 19335 - DNA, 40 bp, Artificial Sequence
  PCR primer for ORF amplification
tggaagtggttcaggaatggatcacgacacagaagttata

SEQ ID NO: 19336 - DNA, 40 bp, Artificial Sequence
  PCR primer for ORF amplification
tggaagtggttcaggaatgaatgaaatggaaaacacagat

SEQ ID NO: 19337 - DNA, 40 bp, Artificial Sequence
  PCR primer for ORF amplification
tggaagtggttcaggaatgactctagaaccacactatagt

SEQ ID NO: 19338 - DNA, 40 bp, Artificial Sequence
  PCR primer for ORF amplification
tggaagtggttcaggaatgatggcttttgagaatacaagt

SEQ ID NO: 19339 - DNA, 40 bp, Artificial Sequence
  PCR primer for ORF amplification
tggaagtggttcaggaatgattaggtacactgttgctggc

SEQ ID NO: 19340 - DNA, 40 bp, Artificial Sequence
  PCR primer for ORF amplification
tggaagtggttcaggaatggagtctgttcactctcgcgat

SEQ ID NO: 19341 - DNA, 40 bp, Artificial Sequence
  PCR primer for ORF amplification
tggaagtggttcaggaatggtaaatatactgcccttccac

SEQ ID NO: 19342 - DNA, 40 bp, Artificial Sequence
  PCR primer for ORF amplification
tggaagtggttcaggaatggttgacgactcaaactatctt

SEQ ID NO: 19343 - DNA, 40 bp, Artificial Sequence
  PCR primer for ORF amplification
tggaagtggttcaggaatgatgaaaagatgcttcagtatc

SEQ ID NO: 19344 - DNA, 40 bp, Artificial Sequence
  PCR primer for ORF amplification
tggaagtggttcaggaatggaccctggtattgctaatcat

SEQ ID NO: 19345 - DNA, 40 bp, Artificial Sequence
  PCR primer for ORF amplification
tggaagtggttcaggaatggagctgccttcaataaatagc

SEQ ID NO: 19346 - DNA, 40 bp, Artificial Sequence
  PCR primer for ORF amplification
tggaagtggttcaggaatggctggagagaacccaaagaag

SEQ ID NO: 19347 - DNA, 40 bp, Artificial Sequence
  PCR primer for ORF amplification
tggaagtggttcaggaatgggtgtcgcagatttgatcaag

SEQ ID NO: 19348 - DNA, 40 bp, Artificial Sequence
  PCR primer for ORF amplification
tggaagtggttcaggaatgccagatgaaacaaattttaca

SEQ ID NO: 19349 - DNA, 40 bp, Artificial Sequence
  PCR primer for ORF amplification
tggaagtggttcaggaatggataaaagcatgatcaaaaaa

SEQ ID NO: 19350 - DNA, 40 bp, Artificial Sequence
  PCR primer for ORF amplification
tggaagtggttcaggaatgtcaagtgagtcaacaactttc

SEQ ID NO: 19351 - DNA, 40 bp, Artificial Sequence
  PCR primer for ORF amplification
tggaagtggttcaggaatgtttgcatcgagatttgaccct

SEQ ID NO: 19352 - DNA, 40 bp, Artificial Sequence
  PCR primer for ORF amplification
tggaagtggttcaggaatgctagtcttcggacctaatagt

SEQ ID NO: 19353 - DNA, 40 bp, Artificial Sequence
  PCR primer for ORF amplification
tggaagtggttcaggaatgctcatagaaaacactaatgat

SEQ ID NO: 19354 - DNA, 40 bp, Artificial Sequence
  PCR primer for ORF amplification
tggaagtggttcaggaatgcttaaatcattaaaatccaga

SEQ ID NO: 19355 - DNA, 40 bp, Artificial Sequence
  PCR primer for ORF amplification
tggaagtggttcaggaatggtgaattggcaaacattgttc

SEQ ID NO: 19356 - DNA, 40 bp, Artificial Sequence
  PCR primer for ORF amplification
tggaagtggttcaggaatgtcgtcagaaagggtcttaagt

SEQ ID NO: 19357 - DNA, 40 bp, Artificial Sequence
  PCR primer for ORF amplification
tggaagtggttcaggaatgtgttctccaactaatttctta

SEQ ID NO: 19358 - DNA, 40 bp, Artificial Sequence
  PCR primer for ORF amplification
tggaagtggttcaggaatgattaagttcactaacgagaac

SEQ ID NO: 19359 - DNA, 40 bp, Artificial Sequence
  PCR primer for ORF amplification
tggaagtggttcaggaatggtgcgttttgtttcaatttta

SEQ ID NO: 19360 - DNA, 40 bp, Artificial Sequence
  PCR primer for ORF amplification
tggaagtggttcaggaatgaattcacaaaaggcgagtaaa

SEQ ID NO: 19361 - DNA, 40 bp, Artificial Sequence
  PCR primer for ORF amplification
tggaagtggttcaggaatggaactcaacgacccttcaatt

SEQ ID NO: 19362 - DNA, 40 bp, Artificial Sequence
  PCR primer for ORF amplification
tggaagtggttcaggaatggaactctcatcaaacttaaaa

SEQ ID NO: 19363 - DNA, 40 bp, Artificial Sequence
  PCR primer for ORF amplification
tggaagtggttcaggaatggtgatagattccaaacaggat

SEQ ID NO: 19364 - DNA, 40 bp, Artificial Sequence
  PCR primer for ORF amplification
tggaagtggttcaggaatgtcaaaatttacttggaaggag

SEQ ID NO: 19365 - DNA, 40 bp, Artificial Sequence
  PCR primer for ORF amplification
tggaagtggttcaggaatgagcagtaacaacaacacaaac

SEQ ID NO: 19366 - DNA, 40 bp, Artificial Sequence
  PCR primer for ORF amplification
tggaagtggttcaggaatgagtgcagatttatcgattggt

SEQ ID NO: 19367 - DNA, 40 bp, Artificial Sequence
  PCR primer for ORF amplification
tggaagtggttcaggaatgcagaacgatcaacagaggttc

SEQ ID NO: 19368 - DNA, 40 bp, Artificial Sequence
  PCR primer for ORF amplification
tggaagtggttcaggaatgccagacaatctatcattacat

SEQ ID NO: 19369 - DNA, 40 bp, Artificial Sequence
  PCR primer for ORF amplification
tggaagtggttcaggaatgctatccaaggtattgctgaat

SEQ ID NO: 19370 - DNA, 40 bp, Artificial Sequence
  PCR primer for ORF amplification
tggaagtggttcaggaatggattacgaagaaattttattt

SEQ ID NO: 19371 - DNA, 40 bp, Artificial Sequence
  PCR primer for ORF amplification
tggaagtggttcaggaatgggactcctaaactcttcagat

SEQ ID NO: 19372 - DNA, 40 bp, Artificial Sequence
  PCR primer for ORF amplification
tggaagtggttcaggaatggtgcaaatgagatccaaaaac

SEQ ID NO: 19373 - DNA, 40 bp, Artificial Sequence
  PCR primer for ORF amplification
tggaagtggttcaggaatgtcgtcgtcgaagtctctatac

SEQ ID NO: 19374 - DNA, 40 bp, Artificial Sequence
  PCR primer for ORF amplification
tggaagtggttcaggaatgttatctttgaaaaaaggaata

SEQ ID NO: 19375 - DNA, 40 bp, Artificial Sequence
  PCR primer for ORF amplification
tggaagtggttcaggaatgaagttagaaaatactctattt

SEQ ID NO: 19376 - DNA, 40 bp, Artificial Sequence
  PCR primer for ORF amplification
tggaagtggttcaggaatgactgcgttgcatagtgtgtcc

SEQ ID NO: 19377 - DNA, 40 bp, Artificial Sequence
  PCR primer for ORF amplification
tggaagtggttcaggaatggcacctgttacaattgaaaag

SEQ ID NO: 19378 - DNA, 40 bp, Artificial Sequence
  PCR primer for ORF amplification
tggaagtggttcaggaatggctaacgacgctctaagtgct

SEQ ID NO: 19379 - DNA, 40 bp, Artificial Sequence
  PCR primer for ORF amplification
tggaagtggttcaggaatgtctggagcaagatcaacaacg

SEQ ID NO: 19380 - DNA, 40 bp, Artificial Sequence
  PCR primer for ORF amplification
tggaagtggttcaggaatgaactccaatagtaccatcgga

SEQ ID NO: 19381 - DNA, 40 bp, Artificial Sequence
  PCR primer for ORF amplification
tggaagtggttcaggaatgactaacgctttgctctctata

SEQ ID NO: 19382 - DNA, 40 bp, Artificial Sequence
  PCR primer for ORF amplification
tggaagtggttcaggaatgccaagggaaacaagtttggta

SEQ ID NO: 19383 - DNA, 40 bp, Artificial Sequence
  PCR primer for ORF amplification
tggaagtggttcaggaatggataggaaaaggtcttttgaa

SEQ ID NO: 19384 - DNA, 40 bp, Artificial Sequence
  PCR primer for ORF amplification
tggaagtggttcaggaatgacaacatatttcaagttggta

SEQ ID NO: 19385 - DNA, 40 bp, Artificial Sequence
  PCR primer for ORF amplification
tggaagtggttcaggaatgagtgaagttgagagcagagaa

SEQ ID NO: 19386 - DNA, 40 bp, Artificial Sequence
  PCR primer for ORF amplification
tggaagtggttcaggaatgggtgtgagatccgctgcaaag

SEQ ID NO: 19387 - DNA, 40 bp, Artificial Sequence
  PCR primer for ORF amplification
tggaagtggttcaggaatgaatcaacctcaaattggcact

SEQ ID NO: 19388 - DNA, 40 bp, Artificial Sequence
  PCR primer for ORF amplification
tggaagtggttcaggaatgtctcgtactaacatggataca

SEQ ID NO: 19389 - DNA, 40 bp, Artificial Sequence
  PCR primer for ORF amplification
tggaagtggttcaggaatgagcgaatcagtgaaagaaaac

SEQ ID NO: 19390 - DNA, 40 bp, Artificial Sequence
  PCR primer for ORF amplification
tggaagtggttcaggaatgatatctagaaccattggtgaa

SEQ ID NO: 19391 - DNA, 40 bp, Artificial Sequence
  PCR primer for ORF amplification
tggaagtggttcaggaatgccggtatctgattctggattc

SEQ ID NO: 19392 - DNA, 40 bp, Artificial Sequence
  PCR primer for ORF amplification
tggaagtggttcaggaatggaaactattttgcagccaaag

SEQ ID NO: 19393 - DNA, 40 bp, Artificial Sequence
  PCR primer for ORF amplification
tggaagtggttcaggaatggccgaaaactccctcctgagg

SEQ ID NO: 19394 - DNA, 40 bp, Artificial Sequence
  PCR primer for ORF amplification
tggaagtggttcaggaatgtacgaacagtttgaattttct

SEQ ID NO: 19395 - DNA, 40 bp, Artificial Sequence
  PCR primer for ORF amplification
tggaagtggttcaggaatgtctaaagctgtcggtattgat

SEQ ID NO: 19396 - DNA, 40 bp, Artificial Sequence
  PCR primer for ORF amplification
tggaagtggttcaggaatgaacggtcctccaacattcact

SEQ ID NO: 19397 - DNA, 40 bp, Artificial Sequence
  PCR primer for ORF amplification
tggaagtggttcaggaatgaggagagagaggcaaaggatg

SEQ ID NO: 19398 - DNA, 40 bp, Artificial Sequence
  PCR primer for ORF amplification
tggaagtggttcaggaatgccaccaaaagaagctcccaag

SEQ ID NO: 19399 - DNA, 40 bp, Artificial Sequence
  PCR primer for ORF amplification
tggaagtggttcaggaatgctaaatcagcacacaagttca

SEQ ID NO: 19400 - DNA, 40 bp, Artificial Sequence
  PCR primer for ORF amplification
tggaagtggttcaggaatgctatcgctaaaaaaatcagcg

SEQ ID NO: 19401 - DNA, 40 bp, Artificial Sequence
  PCR primer for ORF amplification
tggaagtggttcaggaatggctaaagataatttaactaat

SEQ ID NO: 19402 - DNA, 40 bp, Artificial Sequence
  PCR primer for ORF amplification
tggaagtggttcaggaatgtcacctcgacagcttataccg

SEQ ID NO: 19403 - DNA, 40 bp, Artificial Sequence
  PCR primer for ORF amplification
tggaagtggttcaggaatgtcagacttaaatgatgtccaa

SEQ ID NO: 19404 - DNA, 40 bp, Artificial Sequence
  PCR primer for ORF amplification
tggaagtggttcaggaatggatgttctcaaagaggtgttg

SEQ ID NO: 19405 - DNA, 40 bp, Artificial Sequence
  PCR primer for ORF amplification
tggaagtggttcaggaatgtacaacgagcaggtgaactct

SEQ ID NO: 19406 - DNA, 40 bp, Artificial Sequence
  PCR primer for ORF amplification
tggaagtggttcaggaatgaaggaaacggcgcaggaatac

SEQ ID NO: 19407 - DNA, 40 bp, Artificial Sequence
  PCR primer for ORF amplification
tggaagtggttcaggaatgacaaggctcaaagcaaaatat

SEQ ID NO: 19408 - DNA, 40 bp, Artificial Sequence
  PCR primer for ORF amplification
tggaagtggttcaggaatgagcccgaaaaacaaatatgta

SEQ ID NO: 19409 - DNA, 40 bp, Artificial Sequence
  PCR primer for ORF amplification
tggaagtggttcaggaatggacaagaagaaggatctactg

SEQ ID NO: 19410 - DNA, 40 bp, Artificial Sequence
  PCR primer for ORF amplification
tggaagtggttcaggaatggtgcacattactctgggtcaa

SEQ ID NO: 19411 - DNA, 40 bp, Artificial Sequence
  PCR primer for ORF amplification
tggaagtggttcaggaatgtcaaaagctgtcggtattgat

SEQ ID NO: 19412 - DNA, 40 bp, Artificial Sequence
  PCR primer for ORF amplification
tggaagtggttcaggaatgtcaaaagctgttggtattgat

SEQ ID NO: 19413 - DNA, 40 bp, Artificial Sequence
  PCR primer for ORF amplification
tggaagtggttcaggaatgtcacattccggagctgccatt

SEQ ID NO: 19414 - DNA, 40 bp, Artificial Sequence
  PCR primer for ORF amplification
tggaagtggttcaggaatgtcatctcagtttttcctgaaa

SEQ ID NO: 19415 - DNA, 40 bp, Artificial Sequence
  PCR primer for ORF amplification
tggaagtggttcaggaatggattctcctgttctacagtcc

SEQ ID NO: 19416 - DNA, 40 bp, Artificial Sequence
  PCR primer for ORF amplification
tggaagtggttcaggaatgggttcgggcgatactagagga

SEQ ID NO: 19417 - DNA, 40 bp, Artificial Sequence
  PCR primer for ORF amplification
tggaagtggttcaggaatgtggaaattcaacaaaaagctc

SEQ ID NO: 19418 - DNA, 40 bp, Artificial Sequence
  PCR primer for ORF amplification
tggaagtggttcaggaatgttcgggatagtttatctgaag

SEQ ID NO: 19419 - DNA, 40 bp, Artificial Sequence
  PCR primer for ORF amplification
tggaagtggttcaggaatgaagagaaaaactgctgaagtt

SEQ ID NO: 19420 - DNA, 40 bp, Artificial Sequence
  PCR primer for ORF amplification
tggaagtggttcaggaatgaaggctaatggtttagataat

SEQ ID NO: 19421 - DNA, 40 bp, Artificial Sequence
  PCR primer for ORF amplification
tggaagtggttcaggaatgaatctcaatgaaagctaccta

SEQ ID NO: 19422 - DNA, 40 bp, Artificial Sequence
  PCR primer for ORF amplification
tggaagtggttcaggaatggataatgatggacccagatct

SEQ ID NO: 19423 - DNA, 40 bp, Artificial Sequence
  PCR primer for ORF amplification
tggaagtggttcaggaatgtccaaggtctatctgaattca

SEQ ID NO: 19424 - DNA, 40 bp, Artificial Sequence
  PCR primer for ORF amplification
tggaagtggttcaggaatgttaccatcatggaaagccttt

SEQ ID NO: 19425 - DNA, 40 bp, Artificial Sequence
  PCR primer for ORF amplification
tggaagtggttcaggaatgatactgatctcgggatactgt

SEQ ID NO: 19426 - DNA, 40 bp, Artificial Sequence
  PCR primer for ORF amplification
tggaagtggttcaggaatgctgaaatttagaattaggcca

SEQ ID NO: 19427 - DNA, 40 bp, Artificial Sequence
  PCR primer for ORF amplification
tggaagtggttcaggaatggttgaaaaacgtagtagacag

SEQ ID NO: 19428 - DNA, 40 bp, Artificial Sequence
  PCR primer for ORF amplification
tggaagtggttcaggaatgtctgatgaagataacaattat

SEQ ID NO: 19429 - DNA, 40 bp, Artificial Sequence
  PCR primer for ORF amplification
tggaagtggttcaggaatgagttacgaatctgggaggtca

SEQ ID NO: 19430 - DNA, 40 bp, Artificial Sequence
  PCR primer for ORF amplification
tggaagtggttcaggaatgatgcttagaagaaatgcggtg

SEQ ID NO: 19431 - DNA, 40 bp, Artificial Sequence
  PCR primer for ORF amplification
tggaagtggttcaggaatgattggtgcctttaagaggaac

SEQ ID NO: 19432 - DNA, 40 bp, Artificial Sequence
  PCR primer for ORF amplification
tggaagtggttcaggaatgaaatatcccgcttttagcatt

SEQ ID NO: 19433 - DNA, 40 bp, Artificial Sequence
  PCR primer for ORF amplification
tggaagtggttcaggaatgagagcatatggaaagaggggc

SEQ ID NO: 19434 - DNA, 40 bp, Artificial Sequence
  PCR primer for ORF amplification
tggaagtggttcaggaatgcaactttcatggaaggatatc

SEQ ID NO: 19435 - DNA, 40 bp, Artificial Sequence
  PCR primer for ORF amplification
tggaagtggttcaggaatggaagctggcaggagtgctgat

SEQ ID NO: 19436 - DNA, 40 bp, Artificial Sequence
  PCR primer for ORF amplification
tggaagtggttcaggaatggcgtcacagcaaaacaaacac

SEQ ID NO: 19437 - DNA, 40 bp, Artificial Sequence
  PCR primer for ORF amplification
tggaagtggttcaggaatgtcaagcgaggaacgctcgaga

SEQ ID NO: 19438 - DNA, 40 bp, Artificial Sequence
  PCR primer for ORF amplification
tggaagtggttcaggaatgatgttggagccttcacctcca

SEQ ID NO: 19439 - DNA, 40 bp, Artificial Sequence
  PCR primer for ORF amplification
tggaagtggttcaggaatgccttacagccatggtaagaag

SEQ ID NO: 19440 - DNA, 40 bp, Artificial Sequence
  PCR primer for ORF amplification
tggaagtggttcaggaatgccagtggaggagcctcttgct

SEQ ID NO: 19441 - DNA, 40 bp, Artificial Sequence
  PCR primer for ORF amplification
tggaagtggttcaggaatggtttcagcgcaagtggctacc

SEQ ID NO: 19442 - DNA, 40 bp, Artificial Sequence
  PCR primer for ORF amplification
tggaagtggttcaggaatgtcattagtgcataatcagacg

SEQ ID NO: 19443 - DNA, 40 bp, Artificial Sequence
  PCR primer for ORF amplification
tggaagtggttcaggaatgtctagagcagttggtattgat

SEQ ID NO: 19444 - DNA, 40 bp, Artificial Sequence
  PCR primer for ORF amplification
tggaagtggttcaggaatgttttcggtaacgagaagaaga

SEQ ID NO: 19445 - DNA, 40 bp, Artificial Sequence
  PCR primer for ORF amplification
tggaagtggttcaggaatgagtgtgtctaccgccaagagg

SEQ ID NO: 19446 - DNA, 40 bp, Artificial Sequence
  PCR primer for ORF amplification
tggaagtggttcaggaatgtattatggaatcagccagttt

SEQ ID NO: 19447 - DNA, 40 bp, Artificial Sequence
  PCR primer for ORF amplification
tggaagtggttcaggaatgttcacttttctcaaaattatt

SEQ ID NO: 19448 - DNA, 40 bp, Artificial Sequence
  PCR primer for ORF amplification
tggaagtggttcaggaatgagcgaatcggaagccaaatct

SEQ ID NO: 19449 - DNA, 40 bp, Artificial Sequence
  PCR primer for ORF amplification
tggaagtggttcaggaatgagtggaaaatttgttcgtgct

SEQ ID NO: 19450 - DNA, 40 bp, Artificial Sequence
  PCR primer for ORF amplification
tggaagtggttcaggaatggcaaagaagaataagaaggat

SEQ ID NO: 19451 - DNA, 40 bp, Artificial Sequence
  PCR primer for ORF amplification
tggaagtggttcaggaatgggattaaagaaattttttaag

SEQ ID NO: 19452 - DNA, 40 bp, Artificial Sequence
  PCR primer for ORF amplification
tggaagtggttcaggaatgtcgtctcctattaatgattat

SEQ ID NO: 19453 - DNA, 40 bp, Artificial Sequence
  PCR primer for ORF amplification
tggaagtggttcaggaatggaccaaaaaggtatgttctgg

SEQ ID NO: 19454 - DNA, 40 bp, Artificial Sequence
  PCR primer for ORF amplification
tggaagtggttcaggaatgccaaataatactcttaaacaa

SEQ ID NO: 19455 - DNA, 40 bp, Artificial Sequence
  PCR primer for ORF amplification
tggaagtggttcaggaatgctacagatcaactccaggctt

SEQ ID NO: 19456 - DNA, 40 bp, Artificial Sequence
  PCR primer for ORF amplification
tggaagtggttcaggaatgcttgctgctaaaaacatacta

SEQ ID NO: 19457 - DNA, 40 bp, Artificial Sequence
  PCR primer for ORF amplification
tggaagtggttcaggaatggacgagttactgggagaagcg

SEQ ID NO: 19458 - DNA, 40 bp, Artificial Sequence
  PCR primer for ORF amplification
tggaagtggttcaggaatgtttttacctcgtctcgttcgg

SEQ ID NO: 19459 - DNA, 40 bp, Artificial Sequence
  PCR primer for ORF amplification
tggaagtggttcaggaatgaagggcgtaaaaaaggaagga

SEQ ID NO: 19460 - DNA, 40 bp, Artificial Sequence
  PCR primer for ORF amplification
tggaagtggttcaggaatgatacagacgccaagggagttg

SEQ ID NO: 19461 - DNA, 40 bp, Artificial Sequence
  PCR primer for ORF amplification
tggaagtggttcaggaatggatttactacgcattttagac

SEQ ID NO: 19462 - DNA, 40 bp, Artificial Sequence
  PCR primer for ORF amplification
tggaagtggttcaggaatgaaagtgctatgtgtcgcagag

SEQ ID NO: 19463 - DNA, 40 bp, Artificial Sequence
  PCR primer for ORF amplification
tggaagtggttcaggaatgaacaatgtacacataattaaa

SEQ ID NO: 19464 - DNA, 40 bp, Artificial Sequence
  PCR primer for ORF amplification
tggaagtggttcaggaatgatggcaactccggctactgat

SEQ ID NO: 19465 - DNA, 40 bp, Artificial Sequence
  PCR primer for ORF amplification
tggaagtggttcaggaatgcactggaatataatttcgaaa

SEQ ID NO: 19466 - DNA, 40 bp, Artificial Sequence
  PCR primer for ORF amplification
tggaagtggttcaggaatggcacctttaaccaagaagaca

SEQ ID NO: 19467 - DNA, 40 bp, Artificial Sequence
  PCR primer for ORF amplification
tggaagtggttcaggaatgtcttaccaacggaacagtgca

SEQ ID NO: 19468 - DNA, 40 bp, Artificial Sequence
  PCR primer for ORF amplification
tggaagtggttcaggaatgaggtcaggcgatgcagagatt

SEQ ID NO: 19469 - DNA, 40 bp, Artificial Sequence
  PCR primer for ORF amplification
tggaagtggttcaggaatgagtgataatggttcccccgcg

SEQ ID NO: 19470 - DNA, 40 bp, Artificial Sequence
  PCR primer for ORF amplification
tggaagtggttcaggaatgcttaaatctggtagactcaac

SEQ ID NO: 19471 - DNA, 40 bp, Artificial Sequence
  PCR primer for ORF amplification
tggaagtggttcaggaatgtccatcagagatttatatcat

SEQ ID NO: 19472 - DNA, 40 bp, Artificial Sequence
  PCR primer for ORF amplification
tggaagtggttcaggaatgttggcccgttccagggtgtgc

SEQ ID NO: 19473 - DNA, 40 bp, Artificial Sequence
  PCR primer for ORF amplification
tggaagtggttcaggaatgcaaaaactcctctttgtcttt

SEQ ID NO: 19474 - DNA, 40 bp, Artificial Sequence
  PCR primer for ORF amplification
tggaagtggttcaggaatgccaaactctcatggtaatgta

SEQ ID NO: 19475 - DNA, 40 bp, Artificial Sequence
  PCR primer for ORF amplification
tggaagtggttcaggaatgccttcttctttgacaaaaacc

SEQ ID NO: 19476 - DNA, 40 bp, Artificial Sequence
  PCR primer for ORF amplification
tggaagtggttcaggaatggatagtacgaatttgaacaaa

SEQ ID NO: 19477 - DNA, 40 bp, Artificial Sequence
  PCR primer for ORF amplification
tggaagtggttcaggaatgagcttgcacattagtaaactg

SEQ ID NO: 19478 - DNA, 40 bp, Artificial Sequence
  PCR primer for ORF amplification
tggaagtggttcaggaatgagtgctgctccattggattac

SEQ ID NO: 19479 - DNA, 40 bp, Artificial Sequence
  PCR primer for ORF amplification
tggaagtggttcaggaatgctgttgtgtaatagaaaagtc

SEQ ID NO: 19480 - DNA, 40 bp, Artificial Sequence
  PCR primer for ORF amplification
tggaagtggttcaggaatgagcggttttaaatgctatttg

SEQ ID NO: 19481 - DNA, 40 bp, Artificial Sequence
  PCR primer for ORF amplification
tggaagtggttcaggaatgagtgaactgcttgccattcca

SEQ ID NO: 19482 - DNA, 40 bp, Artificial Sequence
  PCR primer for ORF amplification
tggaagtggttcaggaatgcaaagttcagtttattttgac

SEQ ID NO: 19483 - DNA, 40 bp, Artificial Sequence
  PCR primer for ORF amplification
tggaagtggttcaggaatgggcacactgtttcgaagaaat

SEQ ID NO: 19484 - DNA, 40 bp, Artificial Sequence
  PCR primer for ORF amplification
tggaagtggttcaggaatgtcaaggaaatctatagtgcaa

SEQ ID NO: 19485 - DNA, 40 bp, Artificial Sequence
  PCR primer for ORF amplification
tggaagtggttcaggaatgaaggacttgagattacagggg

SEQ ID NO: 19486 - DNA, 40 bp, Artificial Sequence
  PCR primer for ORF amplification
tggaagtggttcaggaatgacagtctcacacaatcattct

SEQ ID NO: 19487 - DNA, 40 bp, Artificial Sequence
  PCR primer for ORF amplification
tggaagtggttcaggaatgactaaagaaacgattcgggta

SEQ ID NO: 19488 - DNA, 40 bp, Artificial Sequence
  PCR primer for ORF amplification
tggaagtggttcaggaatgagttataaggctaaccaacca

SEQ ID NO: 19489 - DNA, 40 bp, Artificial Sequence
  PCR primer for ORF amplification
tggaagtggttcaggaatgaagttactttttaaaagatat

SEQ ID NO: 19490 - DNA, 40 bp, Artificial Sequence
  PCR primer for ORF amplification
tggaagtggttcaggaatgacgcttggtaatagacgccat

SEQ ID NO: 19491 - DNA, 40 bp, Artificial Sequence
  PCR primer for ORF amplification
tggaagtggttcaggaatgccatttcaagattattttcag

SEQ ID NO: 19492 - DNA, 40 bp, Artificial Sequence
  PCR primer for ORF amplification
tggaagtggttcaggaatgcctacaaattacgagtatgat

SEQ ID NO: 19493 - DNA, 40 bp, Artificial Sequence
  PCR primer for ORF amplification
tggaagtggttcaggaatgcgtgcgcacagaatcgataca

SEQ ID NO: 19494 - DNA, 40 bp, Artificial Sequence
  PCR primer for ORF amplification
tggaagtggttcaggaatggatcacagaaaccttgatccg

SEQ ID NO: 19495 - DNA, 40 bp, Artificial Sequence
  PCR primer for ORF amplification
tggaagtggttcaggaatggctaagagaaatagatctcaa

SEQ ID NO: 19496 - DNA, 40 bp, Artificial Sequence
  PCR primer for ORF amplification
tggaagtggttcaggaatgggtactggtaagaaagagaaa

SEQ ID NO: 19497 - DNA, 40 bp, Artificial Sequence
  PCR primer for ORF amplification
tggaagtggttcaggaatgaagttgcagagtttgttggtt

SEQ ID NO: 19498 - DNA, 40 bp, Artificial Sequence
  PCR primer for ORF amplification
tggaagtggttcaggaatggtcacgactccattgcattcc

SEQ ID NO: 19499 - DNA, 40 bp, Artificial Sequence
  PCR primer for ORF amplification
tggaagtggttcaggaatgttgacctctatattgataaaa

SEQ ID NO: 19500 - DNA, 40 bp, Artificial Sequence
  PCR primer for ORF amplification
tggaagtggttcaggaatgaagcataacaggcagatgcca

SEQ ID NO: 19501 - DNA, 40 bp, Artificial Sequence
  PCR primer for ORF amplification
tggaagtggttcaggaatggaagagactgcgaagaaacca

SEQ ID NO: 19502 - DNA, 40 bp, Artificial Sequence
  PCR primer for ORF amplification
tggaagtggttcaggaatggatatcgagcctactttcaaa

SEQ ID NO: 19503 - DNA, 40 bp, Artificial Sequence
  PCR primer for ORF amplification
tggaagtggttcaggaatggctgtggaggaaattgcgtcc

SEQ ID NO: 19504 - DNA, 40 bp, Artificial Sequence
  PCR primer for ORF amplification
tggaagtggttcaggaatgggaaagactaaaacaagaggc

SEQ ID NO: 19505 - DNA, 40 bp, Artificial Sequence
  PCR primer for ORF amplification
tggaagtggttcaggaatgagtgtagaagatatcaagaag

SEQ ID NO: 19506 - DNA, 40 bp, Artificial Sequence
  PCR primer for ORF amplification
tggaagtggttcaggaatgagtttagtaccatatgaagaa

SEQ ID NO: 19507 - DNA, 40 bp, Artificial Sequence
  PCR primer for ORF amplification
tggaagtggttcaggaatgatttacaaaatggcacacgta

SEQ ID NO: 19508 - DNA, 40 bp, Artificial Sequence
  PCR primer for ORF amplification
tggaagtggttcaggaatggaaacatgggaagtcatagca

SEQ ID NO: 19509 - DNA, 40 bp, Artificial Sequence
  PCR primer for ORF amplification
tggaagtggttcaggaatggaagacaagtttgctaacctc

SEQ ID NO: 19510 - DNA, 40 bp, Artificial Sequence
  PCR primer for ORF amplification
tggaagtggttcaggaatggagaccagttcttttgagaat

SEQ ID NO: 19511 - DNA, 40 bp, Artificial Sequence
  PCR primer for ORF amplification
tggaagtggttcaggaatggagcaaaacgctgaaaaacgc

SEQ ID NO: 19512 - DNA, 40 bp, Artificial Sequence
  PCR primer for ORF amplification
tggaagtggttcaggaatggagcggcctggcttggtattg

SEQ ID NO: 19513 - DNA, 40 bp, Artificial Sequence
  PCR primer for ORF amplification
tggaagtggttcaggaatgtcagatccatttgcacattta

SEQ ID NO: 19514 - DNA, 40 bp, Artificial Sequence
  PCR primer for ORF amplification
tggaagtggttcaggaatgagctacagttatgaagcttgt

SEQ ID NO: 19515 - DNA, 40 bp, Artificial Sequence
  PCR primer for ORF amplification
tggaagtggttcaggaatgagtaatcctcaaaaagctcta

SEQ ID NO: 19516 - DNA, 40 bp, Artificial Sequence
  PCR primer for ORF amplification
tggaagtggttcaggaatgctgcgtgtaacaaccttggcg

SEQ ID NO: 19517 - DNA, 40 bp, Artificial Sequence
  PCR primer for ORF amplification
tggaagtggttcaggaatgcttagaaccagactatccgtt

SEQ ID NO: 19518 - DNA, 40 bp, Artificial Sequence
  PCR primer for ORF amplification
tggaagtggttcaggaatgtctcccatacaggttgttgtc

SEQ ID NO: 19519 - DNA, 40 bp, Artificial Sequence
  PCR primer for ORF amplification
tggaagtggttcaggaatgaggatctgtcattcgagaact

SEQ ID NO: 19520 - DNA, 40 bp, Artificial Sequence
  PCR primer for ORF amplification
tggaagtggttcaggaatggtagaaccggacatgcagaag

SEQ ID NO: 19521 - DNA, 40 bp, Artificial Sequence
  PCR primer for ORF amplification
tggaagtggttcaggaatgtccatttcaaccagtttgaac

SEQ ID NO: 19522 - DNA, 40 bp, Artificial Sequence
  PCR primer for ORF amplification
tggaagtggttcaggaatgatggataatcaggctgtaaag

SEQ ID NO: 19523 - DNA, 40 bp, Artificial Sequence
  PCR primer for ORF amplification
tggaagtggttcaggaatgtcttcagttgatgtactgtta

SEQ ID NO: 19524 - DNA, 40 bp, Artificial Sequence
  PCR primer for ORF amplification
tggaagtggttcaggaatgttcttgcttccatttgtcatt

SEQ ID NO: 19525 - DNA, 40 bp, Artificial Sequence
  PCR primer for ORF amplification
tggaagtggttcaggaatgaaacgaggtgtttggttgctg

SEQ ID NO: 19526 - DNA, 40 bp, Artificial Sequence
  PCR primer for ORF amplification
tggaagtggttcaggaatgaagcaggagcagtcccacgaa

SEQ ID NO: 19527 - DNA, 40 bp, Artificial Sequence
  PCR primer for ORF amplification
tggaagtggttcaggaatgatgtctaacgttgctaacgcc

SEQ ID NO: 19528 - DNA, 40 bp, Artificial Sequence
  PCR primer for ORF amplification
tggaagtggttcaggaatggcagtaataccggcaaagaaa

SEQ ID NO: 19529 - DNA, 40 bp, Artificial Sequence
  PCR primer for ORF amplification
tggaagtggttcaggaatgtcaacgcactcaaacgactac

SEQ ID NO: 19530 - DNA, 40 bp, Artificial Sequence
  PCR primer for ORF amplification
tggaagtggttcaggaatgacaaacaaatctagcctgaag

SEQ ID NO: 19531 - DNA, 40 bp, Artificial Sequence
  PCR primer for ORF amplification
tggaagtggttcaggaatgagtaggaaaaattctaagaaa

SEQ ID NO: 19532 - DNA, 40 bp, Artificial Sequence
  PCR primer for ORF amplification
tggaagtggttcaggaatggaaccaattgatgacatactt

SEQ ID NO: 19533 - DNA, 40 bp, Artificial Sequence
  PCR primer for ORF amplification
tggaagtggttcaggaatggttgtagtgggtaagagtgaa

SEQ ID NO: 19534 - DNA, 40 bp, Artificial Sequence
  PCR primer for ORF amplification
tggaagtggttcaggaatgtcggatgtagataactgggaa

SEQ ID NO: 19535 - DNA, 40 bp, Artificial Sequence
  PCR primer for ORF amplification
tggaagtggttcaggaatgaattttaaaatactcctcccg

SEQ ID NO: 19536 - DNA, 40 bp, Artificial Sequence
  PCR primer for ORF amplification
tggaagtggttcaggaatggactacgaggataatctagaa

SEQ ID NO: 19537 - DNA, 40 bp, Artificial Sequence
  PCR primer for ORF amplification
tggaagtggttcaggaatggtatcagccaacggcgacttg

SEQ ID NO: 19538 - DNA, 40 bp, Artificial Sequence
  PCR primer for ORF amplification
tggaagtggttcaggaatgaattttgatgcggtagcagat

SEQ ID NO: 19539 - DNA, 40 bp, Artificial Sequence
  PCR primer for ORF amplification
tggaagtggttcaggaatgctcagaagacacggattattc

SEQ ID NO: 19540 - DNA, 40 bp, Artificial Sequence
  PCR primer for ORF amplification
tggaagtggttcaggaatgggtagacggaagattgaaatc

SEQ ID NO: 19541 - DNA, 40 bp, Artificial Sequence
  PCR primer for ORF amplification
tggaagtggttcaggaatgtctacaaatatattgcaacat

SEQ ID NO: 19542 - DNA, 40 bp, Artificial Sequence
  PCR primer for ORF amplification
tggaagtggttcaggaatgtctgactcctcagaagccact

SEQ ID NO: 19543 - DNA, 40 bp, Artificial Sequence
  PCR primer for ORF amplification
tggaagtggttcaggaatgcattcctggcgaatatccaag

SEQ ID NO: 19544 - DNA, 40 bp, Artificial Sequence
  PCR primer for ORF amplification
tggaagtggttcaggaatgtccagctctacgactcctgat

SEQ ID NO: 19545 - DNA, 40 bp, Artificial Sequence
  PCR primer for ORF amplification
tggaagtggttcaggaatgtttaagacttcatataacttg

SEQ ID NO: 19546 - DNA, 40 bp, Artificial Sequence
  PCR primer for ORF amplification
tggaagtggttcaggaatgcactctcatagacaaaagtgg

SEQ ID NO: 19547 - DNA, 40 bp, Artificial Sequence
  PCR primer for ORF amplification
tggaagtggttcaggaatgggactcttagctttgggcacg

SEQ ID NO: 19548 - DNA, 40 bp, Artificial Sequence
  PCR primer for ORF amplification
tggaagtggttcaggaatgggtgtgcattttgatgataat

SEQ ID NO: 19549 - DNA, 40 bp, Artificial Sequence
  PCR primer for ORF amplification
tggaagtggttcaggaatgtcattcagcaacggaaatatg

SEQ ID NO: 19550 - DNA, 40 bp, Artificial Sequence
  PCR primer for ORF amplification
tggaagtggttcaggaatgaatattgtcaaattacaagta

SEQ ID NO: 19551 - DNA, 40 bp, Artificial Sequence
  PCR primer for ORF amplification
tggaagtggttcaggaatgcacgacaagaagtcgcccatg

SEQ ID NO: 19552 - DNA, 40 bp, Artificial Sequence
  PCR primer for ORF amplification
tggaagtggttcaggaatgccatcggaagttacgccaaaa

SEQ ID NO: 19553 - DNA, 40 bp, Artificial Sequence
  PCR primer for ORF amplification
tggaagtggttcaggaatggacaaaatcaatcctgattgg

SEQ ID NO: 19554 - DNA, 40 bp, Artificial Sequence
  PCR primer for ORF amplification
tggaagtggttcaggaatggatacgtcagtatattctcat

SEQ ID NO: 19555 - DNA, 40 bp, Artificial Sequence
  PCR primer for ORF amplification
tggaagtggttcaggaatggcatttagaaaatcaaatgtg

SEQ ID NO: 19556 - DNA, 40 bp, Artificial Sequence
  PCR primer for ORF amplification
tggaagtggttcaggaatgactcaattcactgacattgat

SEQ ID NO: 19557 - DNA, 40 bp, Artificial Sequence
  PCR primer for ORF amplification
tggaagtggttcaggaatggcacctctttcgttgaacttt

SEQ ID NO: 19558 - DNA, 40 bp, Artificial Sequence
  PCR primer for ORF amplification
tggaagtggttcaggaatgtattcttggaagtcaaagttt

SEQ ID NO: 19559 - DNA, 40 bp, Artificial Sequence
  PCR primer for ORF amplification
tggaagtggttcaggaatggcacagttctccgacattgat

SEQ ID NO: 19560 - DNA, 40 bp, Artificial Sequence
  PCR primer for ORF amplification
tggaagtggttcaggaatgaataactcaaatgagcatagg

SEQ ID NO: 19561 - DNA, 40 bp, Artificial Sequence
  PCR primer for ORF amplification
tggaagtggttcaggaatggatagcttcaattatattcat

SEQ ID NO: 19562 - DNA, 40 bp, Artificial Sequence
  PCR primer for ORF amplification
tggaagtggttcaggaatgtttttcaacagactaagcgct

SEQ ID NO: 19563 - DNA, 40 bp, Artificial Sequence
  PCR primer for ORF amplification
tggaagtggttcaggaatgaacaaagaattggcttctaag

SEQ ID NO: 19564 - DNA, 40 bp, Artificial Sequence
  PCR primer for ORF amplification
tggaagtggttcaggaatgacaatcaaggaacataaagta

SEQ ID NO: 19565 - DNA, 40 bp, Artificial Sequence
  PCR primer for ORF amplification
tggaagtggttcaggaatggattttacaacaatgactatg

SEQ ID NO: 19566 - DNA, 40 bp, Artificial Sequence
  PCR primer for ORF amplification
tggaagtggttcaggaatggacaccagcaagaaagatact

SEQ ID NO: 19567 - DNA, 40 bp, Artificial Sequence
  PCR primer for ORF amplification
tggaagtggttcaggaatggctagaagaaagaatttcaaa

SEQ ID NO: 19568 - DNA, 40 bp, Artificial Sequence
  PCR primer for ORF amplification
tggaagtggttcaggaatgttaaaatgtatatgccgtgtc

SEQ ID NO: 19569 - DNA, 40 bp, Artificial Sequence
  PCR primer for ORF amplification
tggaagtggttcaggaatgaagtttatagcattaatatca

SEQ ID NO: 19570 - DNA, 40 bp, Artificial Sequence
  PCR primer for ORF amplification
tggaagtggttcaggaatgagtaagtatggtccattgggt

SEQ ID NO: 19571 - DNA, 40 bp, Artificial Sequence
  PCR primer for ORF amplification
tggaagtggttcaggaatggaagaaacaatagaaaatgtt

SEQ ID NO: 19572 - DNA, 40 bp, Artificial Sequence
  PCR primer for ORF amplification
tggaagtggttcaggaatgtcggattcaaaccaaggcaac

SEQ ID NO: 19573 - DNA, 40 bp, Artificial Sequence
  PCR primer for ORF amplification
tggaagtggttcaggaatgtctctgacaccaactaatgaa

SEQ ID NO: 19574 - DNA, 40 bp, Artificial Sequence
  PCR primer for ORF amplification
tggaagtggttcaggaatgaatttaaagtccatcgttagc

SEQ ID NO: 19575 - DNA, 40 bp, Artificial Sequence
  PCR primer for ORF amplification
tggaagtggttcaggaatgaccgatatcacacccgtacag

SEQ ID NO: 19576 - DNA, 40 bp, Artificial Sequence
  PCR primer for ORF amplification
tggaagtggttcaggaatgatacgtccattatgttcaaaa

SEQ ID NO: 19577 - DNA, 40 bp, Artificial Sequence
  PCR primer for ORF amplification
tggaagtggttcaggaatggttagaacccgtgtattattc

SEQ ID NO: 19578 - DNA, 40 bp, Artificial Sequence
  PCR primer for ORF amplification
tggaagtggttcaggaatgtcgaaaaacaacacaatgacc

SEQ ID NO: 19579 - DNA, 40 bp, Artificial Sequence
  PCR primer for ORF amplification
tggaagtggttcaggaatgaaacctccgttaaacatgtca

SEQ ID NO: 19580 - DNA, 40 bp, Artificial Sequence
  PCR primer for ORF amplification
tggaagtggttcaggaatgacaacggaagatccagattca

SEQ ID NO: 19581 - DNA, 40 bp, Artificial Sequence
  PCR primer for ORF amplification
tggaagtggttcaggaatgactttgaaaccttcaaagaga

SEQ ID NO: 19582 - DNA, 40 bp, Artificial Sequence
  PCR primer for ORF amplification
tggaagtggttcaggaatgatcagacaatctacgctaaaa

SEQ ID NO: 19583 - DNA, 40 bp, Artificial Sequence
  PCR primer for ORF amplification
tggaagtggttcaggaatgccaaacttaaagagactaccc

SEQ ID NO: 19584 - DNA, 40 bp, Artificial Sequence
  PCR primer for ORF amplification
tggaagtggttcaggaatgccttacaaaatcaaccgaatg

SEQ ID NO: 19585 - DNA, 40 bp, Artificial Sequence
  PCR primer for ORF amplification
tggaagtggttcaggaatggacactttagagccaacagcc

SEQ ID NO: 19586 - DNA, 40 bp, Artificial Sequence
  PCR primer for ORF amplification
tggaagtggttcaggaatgtgcgccagtttaaacgaggta

SEQ ID NO: 19587 - DNA, 40 bp, Artificial Sequence
  PCR primer for ORF amplification
tggaagtggttcaggaatgaaagtccaaataaccaatagt

SEQ ID NO: 19588 - DNA, 40 bp, Artificial Sequence
  PCR primer for ORF amplification
tggaagtggttcaggaatgcctgtttcggaagcgtttgcc

SEQ ID NO: 19589 - DNA, 40 bp, Artificial Sequence
  PCR primer for ORF amplification
tggaagtggttcaggaatggagtacatcaagattgccaaa

SEQ ID NO: 19590 - DNA, 40 bp, Artificial Sequence
  PCR primer for ORF amplification
tggaagtggttcaggaatgggggaaaaaaggacaataatc

SEQ ID NO: 19591 - DNA, 40 bp, Artificial Sequence
  PCR primer for ORF amplification
tggaagtggttcaggaatgggtctaaaaattacaaaagga

SEQ ID NO: 19592 - DNA, 40 bp, Artificial Sequence
  PCR primer for ORF amplification
tggaagtggttcaggaatggttttagaaacgctgaaacaa

SEQ ID NO: 19593 - DNA, 40 bp, Artificial Sequence
  PCR primer for ORF amplification
tggaagtggttcaggaatgtccattgacgaggctgttgcc

SEQ ID NO: 19594 - DNA, 40 bp, Artificial Sequence
  PCR primer for ORF amplification
tggaagtggttcaggaatgacctcaacactagccactaga

SEQ ID NO: 19595 - DNA, 40 bp, Artificial Sequence
  PCR primer for ORF amplification
tggaagtggttcaggaatgcaagcccaaggttcacaatcg

SEQ ID NO: 19596 - DNA, 40 bp, Artificial Sequence
  PCR primer for ORF amplification
tggaagtggttcaggaatgtttggctctgggaatgttctg

SEQ ID NO: 19597 - DNA, 40 bp, Artificial Sequence
  PCR primer for ORF amplification
tggaagtggttcaggaatgaatgtattagtctataatggc

SEQ ID NO: 19598 - DNA, 40 bp, Artificial Sequence
  PCR primer for ORF amplification
tggaagtggttcaggaatgctgcttcttccaagatgtcct

SEQ ID NO: 19599 - DNA, 40 bp, Artificial Sequence
  PCR primer for ORF amplification
tggaagtggttcaggaatggaaggcttcaatccggctgac

SEQ ID NO: 19600 - DNA, 40 bp, Artificial Sequence
  PCR primer for ORF amplification
tggaagtggttcaggaatgaatagattttggaatactaag

SEQ ID NO: 19601 - DNA, 40 bp, Artificial Sequence
  PCR primer for ORF amplification
tggaagtggttcaggaatgacaaggttcatgaacagcttt

SEQ ID NO: 19602 - DNA, 40 bp, Artificial Sequence
  PCR primer for ORF amplification
tggaagtggttcaggaatgagccagatcgttgattttgtt

SEQ ID NO: 19603 - DNA, 40 bp, Artificial Sequence
  PCR primer for ORF amplification
tggaagtggttcaggaatgcaaagctcaacaagtactgat

SEQ ID NO: 19604 - DNA, 40 bp, Artificial Sequence
  PCR primer for ORF amplification
tggaagtggttcaggaatgccgtttggaatagacaacacc

SEQ ID NO: 19605 - DNA, 40 bp, Artificial Sequence
  PCR primer for ORF amplification
tggaagtggttcaggaatgaatggaaaagaggtttcaagt

SEQ ID NO: 19606 - DNA, 40 bp, Artificial Sequence
  PCR primer for ORF amplification
tggaagtggttcaggaatgctttcccataatgctttaagg

SEQ ID NO: 19607 - DNA, 40 bp, Artificial Sequence
  PCR primer for ORF amplification
tggaagtggttcaggaatggactatcctgatccagacaca

SEQ ID NO: 19608 - DNA, 40 bp, Artificial Sequence
  PCR primer for ORF amplification
tggaagtggttcaggaatggccaagagactgttagaatca

SEQ ID NO: 19609 - DNA, 40 bp, Artificial Sequence
  PCR primer for ORF amplification
tggaagtggttcaggaatggggaagagagtatacgatcca

SEQ ID NO: 19610 - DNA, 40 bp, Artificial Sequence
  PCR primer for ORF amplification
tggaagtggttcaggaatgggtaattcaagttcaaaatct

SEQ ID NO: 19611 - DNA, 40 bp, Artificial Sequence
  PCR primer for ORF amplification
tggaagtggttcaggaatgagcactccatttggcttagat

SEQ ID NO: 19612 - DNA, 40 bp, Artificial Sequence
  PCR primer for ORF amplification
tggaagtggttcaggaatgagtactccatttggtttagat

SEQ ID NO: 19613 - DNA, 40 bp, Artificial Sequence
  PCR primer for ORF amplification
tggaagtggttcaggaatgctacgatcaaccacatttact

SEQ ID NO: 19614 - DNA, 40 bp, Artificial Sequence
  PCR primer for ORF amplification
tggaagtggttcaggaatgtggggggatagtatgcgcgag

SEQ ID NO: 19615 - DNA, 40 bp, Artificial Sequence
  PCR primer for ORF amplification
tggaagtggttcaggaatgaccgaacaatattccgttgca

SEQ ID NO: 19616 - DNA, 40 bp, Artificial Sequence
  PCR primer for ORF amplification
tggaagtggttcaggaatgactcatacaaatgagcacgac

SEQ ID NO: 19617 - DNA, 40 bp, Artificial Sequence
  PCR primer for ORF amplification
tggaagtggttcaggaatgcttttcgctagattagtgctg

SEQ ID NO: 19618 - DNA, 40 bp, Artificial Sequence
  PCR primer for ORF amplification
tggaagtggttcaggaatggtcttgataaatggcataaag

SEQ ID NO: 19619 - DNA, 40 bp, Artificial Sequence
  PCR primer for ORF amplification
tggaagtggttcaggaatgtccgaacaacactctgtcgca

SEQ ID NO: 19620 - DNA, 40 bp, Artificial Sequence
  PCR primer for ORF amplification
tggaagtggttcaggaatgaagaatctgaccactataaag

SEQ ID NO: 19621 - DNA, 40 bp, Artificial Sequence
  PCR primer for ORF amplification
tggaagtggttcaggaatgactatacatcagttatctcca

SEQ ID NO: 19622 - DNA, 40 bp, Artificial Sequence
  PCR primer for ORF amplification
tggaagtggttcaggaatgattgtaagaatgatacgtctt

SEQ ID NO: 19623 - DNA, 40 bp, Artificial Sequence
  PCR primer for ORF amplification
tggaagtggttcaggaatggctggaattttgtcaaagact

SEQ ID NO: 19624 - DNA, 40 bp, Artificial Sequence
  PCR primer for ORF amplification
tggaagtggttcaggaatggcaagttcaccgcaggtacat

SEQ ID NO: 19625 - DNA, 40 bp, Artificial Sequence
  PCR primer for ORF amplification
tggaagtggttcaggaatggtaggctcgaaggatattgat

SEQ ID NO: 19626 - DNA, 40 bp, Artificial Sequence
  PCR primer for ORF amplification
tggaagtggttcaggaatgtcttccaagcattcagatcca

SEQ ID NO: 19627 - DNA, 40 bp, Artificial Sequence
  PCR primer for ORF amplification
tggaagtggttcaggaatggactgggcaatcaaagcagct

SEQ ID NO: 19628 - DNA, 40 bp, Artificial Sequence
  PCR primer for ORF amplification
tggaagtggttcaggaatggtggataaaaataggacgttg

SEQ ID NO: 19629 - DNA, 40 bp, Artificial Sequence
  PCR primer for ORF amplification
tggaagtggttcaggaatggttttttcttatgagcactat

SEQ ID NO: 19630 - DNA, 40 bp, Artificial Sequence
  PCR primer for ORF amplification
tggaagtggttcaggaatgtatcgtacaagaagctctgac

SEQ ID NO: 19631 - DNA, 40 bp, Artificial Sequence
  PCR primer for ORF amplification
tggaagtggttcaggaatgacagctcagttacaaagtgaa

SEQ ID NO: 19632 - DNA, 40 bp, Artificial Sequence
  PCR primer for ORF amplification
tggaagtggttcaggaatggataatgaagaagttaacgaa

SEQ ID NO: 19633 - DNA, 40 bp, Artificial Sequence
  PCR primer for ORF amplification
tggaagtggttcaggaatggtcagattttttggtttaaac

SEQ ID NO: 19634 - DNA, 40 bp, Artificial Sequence
  PCR primer for ORF amplification
tggaagtggttcaggaatgtcgttgtctagaatcctgcga

SEQ ID NO: 19635 - DNA, 40 bp, Artificial Sequence; identical to SEQ ID NO: 15460
  PCR primer for ORF amplification

SEQ ID NO: 19636 - DNA, 40 bp, Artificial Sequence
  PCR primer for ORF amplification
tggaagtggttcaggaatgacggccgagcctgctactaag

SEQ ID NO: 19637 - DNA, 40 bp, Artificial Sequence
  PCR primer for ORF amplification
tggaagtggttcaggaatggttgctcaatataccgttcca

SEQ ID NO: 19638 - DNA, 40 bp, Artificial Sequence
  PCR primer for ORF amplification
tggaagtggttcaggaatgtccgatcaaaaagtttttgcc

SEQ ID NO: 19639 - DNA, 40 bp, Artificial Sequence
  PCR primer for ORF amplification
tggaagtggttcaggaatgaaaatgaatctgaaaaggctc

SEQ ID NO: 19640 - DNA, 40 bp, Artificial Sequence
  PCR primer for ORF amplification
tggaagtggttcaggaatgaacggtattgatgatctccta

SEQ ID NO: 19641 - DNA, 40 bp, Artificial Sequence
  PCR primer for ORF amplification
tggaagtggttcaggaatgcatgctacaaactggttcgac

SEQ ID NO: 19642 - DNA, 40 bp, Artificial Sequence
  PCR primer for ORF amplification
tggaagtggttcaggaatggatggatcccattttcctatg

SEQ ID NO: 19643 - DNA, 40 bp, Artificial Sequence
  PCR primer for ORF amplification
tggaagtggttcaggaatgcctagacatggaagaagagga

SEQ ID NO: 19644 - DNA, 40 bp, Artificial Sequence
  PCR primer for ORF amplification
tggaagtggttcaggaatgggtatccaaggtcttcttcct

SEQ ID NO: 19645 - DNA, 40 bp, Artificial Sequence
  PCR primer for ORF amplification
tggaagtggttcaggaatggtgagcatgttctcattattt

SEQ ID NO: 19646 - DNA, 40 bp, Artificial Sequence
  PCR primer for ORF amplification
tggaagtggttcaggaatgcttcccattaaagtcttctct

SEQ ID NO: 19647 - DNA, 40 bp, Artificial Sequence
  PCR primer for ORF amplification
tggaagtggttcaggaatgacggtcgaccatgatttcaat

SEQ ID NO: 19648 - DNA, 40 bp, Artificial Sequence
  PCR primer for ORF amplification
tggaagtggttcaggaatgagactacactatattacggtt

SEQ ID NO: 19649 - DNA, 40 bp, Artificial Sequence
  PCR primer for ORF amplification
tggaagtggttcaggaatgattattgaacgttgggaagta

SEQ ID NO: 19650 - DNA, 40 bp, Artificial Sequence
  PCR primer for ORF amplification
tggaagtggttcaggaatggatgagcatttaatttctact

SEQ ID NO: 19651 - DNA, 40 bp, Artificial Sequence
  PCR primer for ORF amplification
tggaagtggttcaggaatggtttctccaacgaaaatgata

SEQ ID NO: 19652 - DNA, 40 bp, Artificial Sequence
  PCR primer for ORF amplification
tggaagtggttcaggaatgtacaacattccagataatgtc

SEQ ID NO: 19653 - DNA, 40 bp, Artificial Sequence
  PCR primer for ORF amplification
tggaagtggttcaggaatgaagaatacggaacttagtcaa

SEQ ID NO: 19654 - DNA, 40 bp, Artificial Sequence
  PCR primer for ORF amplification
tggaagtggttcaggaatgacaacaaactcacgtccatcc

SEQ ID NO: 19655 - DNA, 40 bp, Artificial Sequence
  PCR primer for ORF amplification
tggaagtggttcaggaatgagcggatctatcgatgtcatc

SEQ ID NO: 19656 - DNA, 40 bp, Artificial Sequence
  PCR primer for ORF amplification
tggaagtggttcaggaatggctggtgaaacttttgaattt

SEQ ID NO: 19657 - DNA, 40 bp, Artificial Sequence
  PCR primer for ORF amplification
tggaagtggttcaggaatgtcccgtgacctacaaaaccat

SEQ ID NO: 19658 - DNA, 40 bp, Artificial Sequence
  PCR primer for ORF amplification
tggaagtggttcaggaatgtcgttgggtcctcttaaagct

SEQ ID NO: 19659 - DNA, 40 bp, Artificial Sequence
  PCR primer for ORF amplification
tggaagtggttcaggaatgagagtaagaccaaagaggtcg

SEQ ID NO: 19660 - DNA, 40 bp, Artificial Sequence
  PCR primer for ORF amplification
tggaagtggttcaggaatgattcaaaaaatgagcccaagc

SEQ ID NO: 19661 - DNA, 40 bp, Artificial Sequence
  PCR primer for ORF amplification
tggaagtggttcaggaatgcaattacggaacatattacag

SEQ ID NO: 19662 - DNA, 40 bp, Artificial Sequence
  PCR primer for ORF amplification
tggaagtggttcaggaatggacaagctaactccatctcaa

SEQ ID NO: 19663 - DNA, 40 bp, Artificial Sequence
  PCR primer for ORF amplification
tggaagtggttcaggaatggattctgtaatggttaagaaa

SEQ ID NO: 19664 - DNA, 40 bp, Artificial Sequence
  PCR primer for ORF amplification
tggaagtggttcaggaatgtataactcaatctacgggtcc

SEQ ID NO: 19665 - DNA, 40 bp, Artificial Sequence
  PCR primer for ORF amplification
tggaagtggttcaggaatgtcgtttttgccactaaggtct

SEQ ID NO: 19666 - DNA, 40 bp, Artificial Sequence
  PCR primer for ORF amplification
tggaagtggttcaggaatgagtaaaaaattatcgttggaa

SEQ ID NO: 19667 - DNA, 40 bp, Artificial Sequence
  PCR primer for ORF amplification
tggaagtggttcaggaatggttttgaaatctacttccgca

SEQ ID NO: 19668 - DNA, 40 bp, Artificial Sequence
  PCR primer for ORF amplification
tggaagtggttcaggaatgtcagaacaactcagacaaaca

SEQ ID NO: 19669 - DNA, 40 bp, Artificial Sequence
  PCR primer for ORF amplification
tggaagtggttcaggaatgtcatttttaaagttcgcttat

SEQ ID NO: 19670 - DNA, 40 bp, Artificial Sequence
  PCR primer for ORF amplification
tggaagtggttcaggaatgccatctaccttgactattaat

SEQ ID NO: 19671 - DNA, 40 bp, Artificial Sequence
  PCR primer for ORF amplification
tggaagtggttcaggaatggaggattcggactccaacaca

SEQ ID NO: 19672 - DNA, 40 bp, Artificial Sequence
  PCR primer for ORF amplification
tggaagtggttcaggaatggctactggcaggattcaattt

SEQ ID NO: 19673 - DNA, 40 bp, Artificial Sequence
  PCR primer for ORF amplification
tggaagtggttcaggaatggctcgtgacttacaaaatcat

SEQ ID NO: 19674 - DNA, 40 bp, Artificial Sequence
  PCR primer for ORF amplification
tggaagtggttcaggaatgagtaataaggaagagcatgtt

SEQ ID NO: 19675 - DNA, 40 bp, Artificial Sequence
  PCR primer for ORF amplification
tggaagtggttcaggaatggatacatcaaactcttggttt

SEQ ID NO: 19676 - DNA, 40 bp, Artificial Sequence
  PCR primer for ORF amplification
tggaagtggttcaggaatggctagtgaaacttttgaattt

SEQ ID NO: 19677 - DNA, 40 bp, Artificial Sequence
  PCR primer for ORF amplification
tggaagtggttcaggaatgttggaagagcaactatatttg

SEQ ID NO: 19678 - DNA, 40 bp, Artificial Sequence
  PCR primer for ORF amplification
tggaagtggttcaggaatgtttccctctctcttccgactt

SEQ ID NO: 19679 - DNA, 40 bp, Artificial Sequence
  PCR primer for ORF amplification
tggaagtggttcaggaatgggtaaagtttctaaatcgacc

SEQ ID NO: 19680 - DNA, 40 bp, Artificial Sequence
  PCR primer for ORF amplification
tggaagtggttcaggaatgggtaattccggttcgaaacaa

SEQ ID NO: 19681 - DNA, 40 bp, Artificial Sequence
  PCR primer for ORF amplification
tggaagtggttcaggaatgagccactttttcgccgatcat

SEQ ID NO: 19682 - DNA, 40 bp, Artificial Sequence
  PCR primer for ORF amplification
tggaagtggttcaggaatgcattggacgtccatcttgagc

SEQ ID NO: 19683 - DNA, 40 bp, Artificial Sequence
  PCR primer for ORF amplification
tggaagtggttcaggaatgtattgggtcctcctttgtggt

SEQ ID NO: 19684 - DNA, 40 bp, Artificial Sequence
  PCR primer for ORF amplification
tggaagtggttcaggaatgcatagaacgcttctgttttta

SEQ ID NO: 19685 - DNA, 40 bp, Artificial Sequence
  PCR primer for ORF amplification
tggaagtggttcaggaatgcgattgttgctgtgcaagaat

SEQ ID NO: 19686 - DNA, 40 bp, Artificial Sequence
  PCR primer for ORF amplification
tggaagtggttcaggaatgctcaattctgcgttactgtgg

SEQ ID NO: 19687 - DNA, 40 bp, Artificial Sequence
  PCR primer for ORF amplification
tggaagtggttcaggaatggctggaaaaaagggacaaaag

SEQ ID NO: 19688 - DNA, 40 bp, Artificial Sequence
  PCR primer for ORF amplification
tggaagtggttcaggaatgaaaaccgaaatcagcactgcg

SEQ ID NO: 19689 - DNA, 40 bp, Artificial Sequence
  PCR primer for ORF amplification
tggaagtggttcaggaatgactgccagcgtttcgaatacg

SEQ ID NO: 19690 - DNA, 40 bp, Artificial Sequence
  PCR primer for ORF amplification
tggaagtggttcaggaatgccatccctgtctcaaccattt

SEQ ID NO: 19691 - DNA, 40 bp, Artificial Sequence
  PCR primer for ORF amplification
tggaagtggttcaggaatggtcactaacaatggagatggt

SEQ ID NO: 19692 - DNA, 40 bp, Artificial Sequence
  PCR primer for ORF amplification
tggaagtggttcaggaatgtcccaatctagtaggttaagt

SEQ ID NO: 19693 - DNA, 40 bp, Artificial Sequence
  PCR primer for ORF amplification
tggaagtggttcaggaatgtcgccctctgccgtacaatca

SEQ ID NO: 19694 - DNA, 40 bp, Artificial Sequence
  PCR primer for ORF amplification
tggaagtggttcaggaatgggtatgtgcctcggtttttct

SEQ ID NO: 19695 - DNA, 40 bp, Artificial Sequence
  PCR primer for ORF amplification
tggaagtggttcaggaatgacagaaattattgatttagac

SEQ ID NO: 19696 - DNA, 40 bp, Artificial Sequence
  PCR primer for ORF amplification
tggaagtggttcaggaatgctatcattttgcgactatttt

SEQ ID NO: 19697 - DNA, 40 bp, Artificial Sequence
  PCR primer for ORF amplification
tggaagtggttcaggaatgtcacatcttatcactttagct

SEQ ID NO: 19698 - DNA, 40 bp, Artificial Sequence
  PCR primer for ORF amplification
tggaagtggttcaggaatgtcagtgaacgaccaaataact

SEQ ID NO: 19699 - DNA, 40 bp, Artificial Sequence
  PCR primer for ORF amplification
tggaagtggttcaggaatgaaaagcaggaaacgccaaaac

SEQ ID NO: 19700 - DNA, 40 bp, Artificial Sequence
  PCR primer for ORF amplification
tggaagtggttcaggaatgagccagcatattaggaaatta

SEQ ID NO: 19701 - DNA, 40 bp, Artificial Sequence
  PCR primer for ORF amplification
tggaagtggttcaggaatgctacggtttactcatcgaggc

SEQ ID NO: 19702 - DNA, 40 bp, Artificial Sequence
  PCR primer for ORF amplification
tggaagtggttcaggaatgggatatcaattgagtgcaaca

SEQ ID NO: 19703 - DNA, 40 bp, Artificial Sequence
  PCR primer for ORF amplification
tggaagtggttcaggaatggaacagacacaaacagcagag

SEQ ID NO: 19704 - DNA, 40 bp, Artificial Sequence
  PCR primer for ORF amplification
tggaagtggttcaggaatgtgtggtatctttggttactgc

SEQ ID NO: 19705 - DNA, 40 bp, Artificial Sequence
  PCR primer for ORF amplification
tggaagtggttcaggaatgttattaaacccagatcaaatt

SEQ ID NO: 19706 - DNA, 40 bp, Artificial Sequence
  PCR primer for ORF amplification
tggaagtggttcaggaatgggatccgaccggtcgtgtgtt

SEQ ID NO: 19707 - DNA, 40 bp, Artificial Sequence
  PCR primer for ORF amplification
tggaagtggttcaggaatgcactatgtggtactagagctg

SEQ ID NO: 19708 - DNA, 40 bp, Artificial Sequence
  PCR primer for ORF amplification
tggaagtggttcaggaatgtctggaatgggtattgcgatt

SEQ ID NO: 19709 - DNA, 40 bp, Artificial Sequence
  PCR primer for ORF amplification
tggaagtggttcaggaatgttgttggtacatattatatct

SEQ ID NO: 19710 - DNA, 40 bp, Artificial Sequence
  PCR primer for ORF amplification
tggaagtggttcaggaatgaattcgaatgaagatatacat

SEQ ID NO: 19711 - DNA, 40 bp, Artificial Sequence
  PCR primer for ORF amplification
tggaagtggttcaggaatgactcagcaagaataccgttcc

SEQ ID NO: 19712 - DNA, 40 bp, Artificial Sequence
  PCR primer for ORF amplification
tggaagtggttcaggaatgcctttgagaaatctaactgaa

SEQ ID NO: 19713 - DNA, 40 bp, Artificial Sequence
  PCR primer for ORF amplification
tggaagtggttcaggaatggccaaaagagttgccgatgcg

SEQ ID NO: 19714 - DNA, 40 bp, Artificial Sequence
  PCR primer for ORF amplification
tggaagtggttcaggaatgaagtttggtgagcacttgagc

SEQ ID NO: 19715 - DNA, 40 bp, Artificial Sequence
  PCR primer for ORF amplification
tggaagtggttcaggaatgagtgacagttctgtgagggaa

SEQ ID NO: 19716 - DNA, 40 bp, Artificial Sequence
  PCR primer for ORF amplification
tggaagtggttcaggaatgaagggaaactttaggaaaaga

SEQ ID NO: 19717 - DNA, 40 bp, Artificial Sequence
  PCR primer for ORF amplification
tggaagtggttcaggaatgagctctagagcattaaggaga

SEQ ID NO: 19718 - DNA, 40 bp, Artificial Sequence
  PCR primer for ORF amplification
tggaagtggttcaggaatgttcaggtcgcatgcctccggt

SEQ ID NO: 19719 - DNA, 40 bp, Artificial Sequence
  PCR primer for ORF amplification
tggaagtggttcaggaatgaatctgcaagaactattagcg

SEQ ID NO: 19720 - DNA, 40 bp, Artificial Sequence
  PCR primer for ORF amplification
tggaagtggttcaggaatggtaatgcaggaggagaagaag

SEQ ID NO: 19721 - DNA, 40 bp, Artificial Sequence
  PCR primer for ORF amplification
tggaagtggttcaggaatgtctgatttaattgaattacag

SEQ ID NO: 19722 - DNA, 40 bp, Artificial Sequence
  PCR primer for ORF amplification
tggaagtggttcaggaatgttgtctcaaacctccataccg

SEQ ID NO: 19723 - DNA, 40 bp, Artificial Sequence
  PCR primer for ORF amplification
tggaagtggttcaggaatgacattatctttcgctcatttt

SEQ ID NO: 19724 - DNA, 40 bp, Artificial Sequence
  PCR primer for ORF amplification
tggaagtggttcaggaatgcctcaatctactccaagtcaa

SEQ ID NO: 19725 - DNA, 40 bp, Artificial Sequence
  PCR primer for ORF amplification
tggaagtggttcaggaatggactgggcaatcaatgtcgcc

SEQ ID NO: 19726 - DNA, 40 bp, Artificial Sequence
  PCR primer for ORF amplification
tggaagtggttcaggaatgtttaaagtgtttggttttggt

SEQ ID NO: 19727 - DNA, 40 bp, Artificial Sequence
  PCR primer for ORF amplification
tggaagtggttcaggaatgccaccattggataaaagaatc

SEQ ID NO: 19728 - DNA, 40 bp, Artificial Sequence
  PCR primer for ORF amplification
tggaagtggttcaggaatggaattatcccctacttatcaa

SEQ ID NO: 19729 - DNA, 40 bp, Artificial Sequence
  PCR primer for ORF amplification
tggaagtggttcaggaatggcaagtgtcatgtcaaataat

SEQ ID NO: 19730 - DNA, 40 bp, Artificial Sequence
  PCR primer for ORF amplification
tggaagtggttcaggaatgaatgattggcatgagttcaat

SEQ ID NO: 19731 - DNA, 40 bp, Artificial Sequence
  PCR primer for ORF amplification
tggaagtggttcaggaatggaggaaattcctgccctgtat

SEQ ID NO: 19732 - DNA, 40 bp, Artificial Sequence
  PCR primer for ORF amplification
tggaagtggttcaggaatggtatttggttttacaaagagg

SEQ ID NO: 19733 - DNA, 40 bp, Artificial Sequence
  PCR primer for ORF amplification
tggaagtggttcaggaatggaatcacttccacgtactccc

SEQ ID NO: 19734 - DNA, 40 bp, Artificial Sequence
  PCR primer for ORF amplification
tggaagtggttcaggaatgttttacaataggtggctcgga

SEQ ID NO: 19735 - DNA, 40 bp, Artificial Sequence
  PCR primer for ORF amplification
tggaagtggttcaggaatgaccattgatggcacggggcaa

SEQ ID NO: 19736 - DNA, 40 bp, Artificial Sequence
  PCR primer for ORF amplification
tggaagtggttcaggaatgatttctgtttgcccacaaaat

SEQ ID NO: 19737 - DNA, 40 bp, Artificial Sequence
  PCR primer for ORF amplification
tggaagtggttcaggaatgcaagacgaccccgaaaattcg

SEQ ID NO: 19738 - DNA, 40 bp, Artificial Sequence
  PCR primer for ORF amplification
tggaagtggttcaggaatgacagaattttattctgacaca

SEQ ID NO: 19739 - DNA, 40 bp, Artificial Sequence
  PCR primer for ORF amplification
tggaagtggttcaggaatgatccgtttagctcagcaaaca

SEQ ID NO: 19740 - DNA, 40 bp, Artificial Sequence
  PCR primer for ORF amplification
tggaagtggttcaggaatggacaaattagtcgtgaattat

SEQ ID NO: 19741 - DNA, 40 bp, Artificial Sequence
  PCR primer for ORF amplification
tggaagtggttcaggaatgtttagagtatttggttcattt

SEQ ID NO: 19742 - DNA, 40 bp, Artificial Sequence
  PCR primer for ORF amplification
tggaagtggttcaggaatgaccacacaaataaggtctccc

SEQ ID NO: 19743 - DNA, 40 bp, Artificial Sequence
  PCR primer for ORF amplification
tggaagtggttcaggaatgtcttccccagggaattcaggc

SEQ ID NO: 19744 - DNA, 40 bp, Artificial Sequence
  PCR primer for ORF amplification
tggaagtggttcaggaatgacttctgaaaatccggatgta

SEQ ID NO: 19745 - DNA, 40 bp, Artificial Sequence
  PCR primer for ORF amplification
tggaagtggttcaggaatgagtcttatactagatgatatc

SEQ ID NO: 19746 - DNA, 40 bp, Artificial Sequence
  PCR primer for ORF amplification
tggaagtggttcaggaatggaagtagacagtatattaggt

SEQ ID NO: 19747 - DNA, 40 bp, Artificial Sequence
  PCR primer for ORF amplification
tggaagtggttcaggaatgggcttcagtagcggtaaatca

SEQ ID NO: 19748 - DNA, 40 bp, Artificial Sequence
  PCR primer for ORF amplification
tggaagtggttcaggaatgtcgaagaaccaaagtgtgagt

SEQ ID NO: 19749 - DNA, 40 bp, Artificial Sequence
  PCR primer for ORF amplification
tggaagtggttcaggaatgagtgctagtgaagcaggtgtc

SEQ ID NO: 19750 - DNA, 40 bp, Artificial Sequence
  PCR primer for ORF amplification
tggaagtggttcaggaatgtaccacacccatatgcatgaa

SEQ ID NO: 19751 - DNA, 40 bp, Artificial Sequence
  PCR primer for ORF amplification
tggaagtggttcaggaatggcagcaaatagcaatagtaga

SEQ ID NO: 19752 - DNA, 40 bp, Artificial Sequence
  PCR primer for ORF amplification
tggaagtggttcaggaatgggagaatttaaacctccgcta

SEQ ID NO: 19753 - DNA, 40 bp, Artificial Sequence
  PCR primer for ORF amplification
tggaagtggttcaggaatgtccagacgcaatccaccaggc

SEQ ID NO: 19754 - DNA, 40 bp, Artificial Sequence
  PCR primer for ORF amplification
tggaagtggttcaggaatgaatcaaaatttaaaaaacact

SEQ ID NO: 19755 - DNA, 40 bp, Artificial Sequence
  PCR primer for ORF amplification
tggaagtggttcaggaatggattcacatcaactagaacta

SEQ ID NO: 19756 - DNA, 40 bp, Artificial Sequence
  PCR primer for ORF amplification
tggaagtggttcaggaatggcacttgtcaaatacagcaca

SEQ ID NO: 19757 - DNA, 40 bp, Artificial Sequence
  PCR primer for ORF amplification
tggaagtggttcaggaatgtcacagaatattcaaattggc

SEQ ID NO: 19758 - DNA, 40 bp, Artificial Sequence
  PCR primer for ORF amplification
tggaagtggttcaggaatggttgccgaagaggacatcgag

SEQ ID NO: 19759 - DNA, 40 bp, Artificial Sequence
  PCR primer for ORF amplification
tggaagtggttcaggaatgtctacacaatttaggaagtct

SEQ ID NO: 19760 - DNA, 40 bp, Artificial Sequence
  PCR primer for ORF amplification
tggaagtggttcaggaatgatagcaccagactcgcaaaga

SEQ ID NO: 19761 - DNA, 40 bp, Artificial Sequence
  PCR primer for ORF amplification
tggaagtggttcaggaatgtcctccagcatctttgaaatg

SEQ ID NO: 19762 - DNA, 40 bp, Artificial Sequence
  PCR primer for ORF amplification
tggaagtggttcaggaatggttgataccgcaccatacatt

SEQ ID NO: 19763 - DNA, 40 bp, Artificial Sequence
  PCR primer for ORF amplification
tggaagtggttcaggaatgagcgatgaagattctatgctg

SEQ ID NO: 19764 - DNA, 40 bp, Artificial Sequence
  PCR primer for ORF amplification
tggaagtggttcaggaatggaacttcagaatgatttagag

SEQ ID NO: 19765 - DNA, 40 bp, Artificial Sequence
  PCR primer for ORF amplification
tggaagtggttcaggaatgggttcatcaattaactatcct

SEQ ID NO: 19766 - DNA, 40 bp, Artificial Sequence
  PCR primer for ORF amplification
tggaagtggttcaggaatgaataaagagcatttgctgaag

SEQ ID NO: 19767 - DNA, 40 bp, Artificial Sequence
  PCR primer for ORF amplification
tggaagtggttcaggaatggatggtcccaattttgcacat

SEQ ID NO: 19768 - DNA, 40 bp, Artificial Sequence
  PCR primer for ORF amplification
tggaagtggttcaggaatgtctgctcccgctgccgatcat

SEQ ID NO: 19769 - DNA, 40 bp, Artificial Sequence
  PCR primer for ORF amplification
tggaagtggttcaggaatgacaatcgatgattcaaatcga

SEQ ID NO: 19770 - DNA, 40 bp, Artificial Sequence
  PCR primer for ORF amplification
tggaagtggttcaggaatgataactaataagaaaataaag

SEQ ID NO: 19771 - DNA, 40 bp, Artificial Sequence
  PCR primer for ORF amplification
tggaagtggttcaggaatggccgctccagattatgcactt

SEQ ID NO: 19772 - DNA, 40 bp, Artificial Sequence
  PCR primer for ORF amplification
tggaagtggttcaggaatggaattatttaacaaggaagaa

SEQ ID NO: 19773 - DNA, 40 bp, Artificial Sequence
  PCR primer for ORF amplification
tggaagtggttcaggaatgtcacacactaataagatcgca

SEQ ID NO: 19774 - DNA, 40 bp, Artificial Sequence
  PCR primer for ORF amplification
tggaagtggttcaggaatgaatttgttttggccatcggaa

SEQ ID NO: 19775 - DNA, 40 bp, Artificial Sequence
  PCR primer for ORF amplification
tggaagtggttcaggaatgagtaagatactattctgcaaa

SEQ ID NO: 19776 - DNA, 40 bp, Artificial Sequence
  PCR primer for ORF amplification
tggaagtggttcaggaatgattacgcagaattctatacca

SEQ ID NO: 19777 - DNA, 40 bp, Artificial Sequence
  PCR primer for ORF amplification
tggaagtggttcaggaatgaacgtttcaaaaatacttgtg

SEQ ID NO: 19778 - DNA, 40 bp, Artificial Sequence
  PCR primer for ORF amplification
tggaagtggttcaggaatgagacgagaaacggtgggtgaa

SEQ ID NO: 19779 - DNA, 40 bp, Artificial Sequence
  PCR primer for ORF amplification
tggaagtggttcaggaatgatcagaagatggctaactata

SEQ ID NO: 19780 - DNA, 40 bp, Artificial Sequence
  PCR primer for ORF amplification
tggaagtggttcaggaatgtcgttattagagcaattagca

SEQ ID NO: 19781 - DNA, 40 bp, Artificial Sequence
  PCR primer for ORF amplification
tggaagtggttcaggaatgaataggggatcattagatgat

SEQ ID NO: 19782 - DNA, 40 bp, Artificial Sequence
  PCR primer for ORF amplification
tggaagtggttcaggaatgacgagacgtactactattaat

SEQ ID NO: 19783 - DNA, 40 bp, Artificial Sequence
  PCR primer for ORF amplification
tggaagtggttcaggaatggaacttcagagggcacaacgg

SEQ ID NO: 19784 - DNA, 40 bp, Artificial Sequence
  PCR primer for ORF amplification
tggaagtggttcaggaatgaccagtatgtcaattattgat

SEQ ID NO: 19785 - DNA, 40 bp, Artificial Sequence
  PCR primer for ORF amplification
tggaagtggttcaggaatgacttcgaaaccatccaccagt

SEQ ID NO: 19786 - DNA, 40 bp, Artificial Sequence
  PCR primer for ORF amplification
tggaagtggttcaggaatggatgtgagagcggcattgcaa

SEQ ID NO: 19787 - DNA, 40 bp, Artificial Sequence
  PCR primer for ORF amplification
tggaagtggttcaggaatgtctaataccttgccagtaaca

SEQ ID NO: 19788 - DNA, 40 bp, Artificial Sequence
  PCR primer for ORF amplification
tggaagtggttcaggaatgaggatcgaaaagcaccgtacc

SEQ ID NO: 19789 - DNA, 40 bp, Artificial Sequence
  PCR primer for ORF amplification
tggaagtggttcaggaatgagtataattagttcttggtta

SEQ ID NO: 19790 - DNA, 40 bp, Artificial Sequence
  PCR primer for ORF amplification
tggaagtggttcaggaatggatcgcatagcacagcaatat

SEQ ID NO: 19791 - DNA, 40 bp, Artificial Sequence
  PCR primer for ORF amplification
tggaagtggttcaggaatgagtcaagttaatacaagccaa

SEQ ID NO: 19792 - DNA, 40 bp, Artificial Sequence
  PCR primer for ORF amplification
tggaagtggttcaggaatgtcagtacctaattccaaagag

SEQ ID NO: 19793 - DNA, 40 bp, Artificial Sequence
  PCR primer for ORF amplification
tggaagtggttcaggaatgtctttcctcatttcctttgat

SEQ ID NO: 19794 - DNA, 40 bp, Artificial Sequence
  PCR primer for ORF amplification
tggaagtggttcaggaatggcaagcatcggttcgcaagtg

SEQ ID NO: 19795 - DNA, 40 bp, Artificial Sequence
  PCR primer for ORF amplification
tggaagtggttcaggaatggtggtaggaactaaaaaatac

SEQ ID NO: 19796 - DNA, 40 bp, Artificial Sequence
  PCR primer for ORF amplification
tggaagtggttcaggaatgtctaataccgaggaattgatc

SEQ ID NO: 19797 - DNA, 40 bp, Artificial Sequence
  PCR primer for ORF amplification
tggaagtggttcaggaatgccgtacagagtggcgacgggc

SEQ ID NO: 19798 - DNA, 40 bp, Artificial Sequence
  PCR primer for ORF amplification
tggaagtggttcaggaatgcgggttttaataactaacgat

SEQ ID NO: 19799 - DNA, 40 bp, Artificial Sequence
  PCR primer for ORF amplification
tggaagtggttcaggaatggaagaaaaccaattaacgtgc

SEQ ID NO: 19800 - DNA, 40 bp, Artificial Sequence
  PCR primer for ORF amplification
tggaagtggttcaggaatggttgagttttctttgaagaag

SEQ ID NO: 19801 - DNA, 40 bp, Artificial Sequence
  PCR primer for ORF amplification
tggaagtggttcaggaatgaatgaagacctgcccaaggaa

SEQ ID NO: 19802 - DNA, 40 bp, Artificial Sequence
  PCR primer for ORF amplification
tggaagtggttcaggaatgacatcaaataattcgttattg

SEQ ID NO: 19803 - DNA, 40 bp, Artificial Sequence
  PCR primer for ORF amplification
tggaagtggttcaggaatgactacacaactaaggtatgaa

SEQ ID NO: 19804 - DNA, 40 bp, Artificial Sequence
  PCR primer for ORF amplification
tggaagtggttcaggaatgataaaaagatggttatctgtg

SEQ ID NO: 19805 - DNA, 40 bp, Artificial Sequence
  PCR primer for ORF amplification
tggaagtggttcaggaatggagtctctttttcctaacaaa

SEQ ID NO: 19806 - DNA, 40 bp, Artificial Sequence
  PCR primer for ORF amplification
tggaagtggttcaggaatggcacatgaaaagtttagtata

SEQ ID NO: 19807 - DNA, 40 bp, Artificial Sequence
  PCR primer for ORF amplification
tggaagtggttcaggaatgcgcagattactgaccggttgc

SEQ ID NO: 19808 - DNA, 40 bp, Artificial Sequence
  PCR primer for ORF amplification
tggaagtggttcaggaatgtctagcagagacgcctctttg

SEQ ID NO: 19809 - DNA, 40 bp, Artificial Sequence
  PCR primer for ORF amplification
tggaagtggttcaggaatgtataatagcagcaccaatcat

SEQ ID NO: 19810 - DNA, 40 bp, Artificial Sequence
  PCR primer for ORF amplification
tggaagtggttcaggaatgatgcgtggtttcaagcaaaga

SEQ ID NO: 19811 - DNA, 40 bp, Artificial Sequence
  PCR primer for ORF amplification
tggaagtggttcaggaatggctagtttagaagatcttatt

SEQ ID NO: 19812 - DNA, 40 bp, Artificial Sequence
  PCR primer for ORF amplification
tggaagtggttcaggaatgacgccgaaagaatctggaaag

SEQ ID NO: 19813 - DNA, 40 bp, Artificial Sequence
  PCR primer for ORF amplification
tggaagtggttcaggaatgatcatcagagctccaataagg

SEQ ID NO: 19814 - DNA, 40 bp, Artificial Sequence
  PCR primer for ORF amplification
tggaagtggttcaggaatggaaatcgatggcaacactctg

SEQ ID NO: 19815 - DNA, 40 bp, Artificial Sequence
  PCR primer for ORF amplification
tggaagtggttcaggaatggataacacgaccaatattaat

SEQ ID NO: 19816 - DNA, 40 bp, Artificial Sequence
  PCR primer for ORF amplification
tggaagtggttcaggaatggcggtaaatcctgagttagca

SEQ ID NO: 19817 - DNA, 40 bp, Artificial Sequence
  PCR primer for ORF amplification
tggaagtggttcaggaatgtctgaactctctcaaatgaca

SEQ ID NO: 19818 - DNA, 40 bp, Artificial Sequence
  PCR primer for ORF amplification
tggaagtggttcaggaatgttcaagatacctggttttgga

SEQ ID NO: 19819 - DNA, 40 bp, Artificial Sequence
  PCR primer for ORF amplification
tggaagtggttcaggaatgacagcgccattgtggccaaac

SEQ ID NO: 19820 - DNA, 40 bp, Artificial Sequence
  PCR primer for ORF amplification
tggaagtggttcaggaatgagtaaagccaagggaacggga

SEQ ID NO: 19821 - DNA, 40 bp, Artificial Sequence
  PCR primer for ORF amplification
tggaagtggttcaggaatgcctaatctattgtcgagaaac

SEQ ID NO: 19822 - DNA, 40 bp, Artificial Sequence
  PCR primer for ORF amplification
tggaagtggttcaggaatgcctgcaccaaaactcacggag

SEQ ID NO: 19823 - DNA, 40 bp, Artificial Sequence
  PCR primer for ORF amplification
tggaagtggttcaggaatggatgcttctgaggaagcaaaa

SEQ ID NO: 19824 - DNA, 40 bp, Artificial Sequence
  PCR primer for ORF amplification
tggaagtggttcaggaatgggtgtctcacaaatatgggaa

SEQ ID NO: 19825 - DNA, 40 bp, Artificial Sequence
  PCR primer for ORF amplification
tggaagtggttcaggaatgtcctcgtcttcgtctaccggg

SEQ ID NO: 19826 - DNA, 40 bp, Artificial Sequence
  PCR primer for ORF amplification
tggaagtggttcaggaatgaagataacgtgtacagacttg

SEQ ID NO: 19827 - DNA, 40 bp, Artificial Sequence
  PCR primer for ORF amplification
tggaagtggttcaggaatgctacttcattttgacattgta

SEQ ID NO: 19828 - DNA, 40 bp, Artificial Sequence
  PCR primer for ORF amplification
tggaagtggttcaggaatggtagatgtgcaaaagagaaaa

SEQ ID NO: 19829 - DNA, 40 bp, Artificial Sequence
  PCR primer for ORF amplification
tggaagtggttcaggaatgaatttttccagcattttcaaa

SEQ ID NO: 19830 - DNA, 40 bp, Artificial Sequence
  PCR primer for ORF amplification
tggaagtggttcaggaatgagtgtccagaaaatgatgtgg

SEQ ID NO: 19831 - DNA, 40 bp, Artificial Sequence
  PCR primer for ORF amplification
tggaagtggttcaggaatgatgatgtggcaacgatatgca

SEQ ID NO: 19832 - DNA, 40 bp, Artificial Sequence
  PCR primer for ORF amplification
tggaagtggttcaggaatggaacaccaagatagttcgcca

SEQ ID NO: 19833 - DNA, 40 bp, Artificial Sequence
  PCR primer for ORF amplification
tggaagtggttcaggaatgcataaacctttaagatggcta

SEQ ID NO: 19834 - DNA, 40 bp, Artificial Sequence
  PCR primer for ORF amplification
tggaagtggttcaggaatgtctgtgcccaaaaaacgtaac

SEQ ID NO: 19835 - DNA, 40 bp, Artificial Sequence
  PCR primer for ORF amplification
tggaagtggttcaggaatgttggcactccggagatttata

SEQ ID NO: 19836 - DNA, 40 bp, Artificial Sequence
  PCR primer for ORF amplification
tggaagtggttcaggaatgaaaaattttcttccacgcaca

SEQ ID NO: 19837 - DNA, 40 bp, Artificial Sequence
  PCR primer for ORF amplification
tggaagtggttcaggaatgaaacggttgcaattgtttggt

SEQ ID NO: 19838 - DNA, 40 bp, Artificial Sequence
  PCR primer for ORF amplification
tggaagtggttcaggaatgaacgatagccaaaactgccta

SEQ ID NO: 19839 - DNA, 40 bp, Artificial Sequence
  PCR primer for ORF amplification
tggaagtggttcaggaatgtcagaggaatttatcgcagtt

SEQ ID NO: 19840 - DNA, 40 bp, Artificial Sequence
  PCR primer for ORF amplification
tggaagtggttcaggaatgaagccctttcaaggaataaca

SEQ ID NO: 19841 - DNA, 40 bp, Artificial Sequence
  PCR primer for ORF amplification
tggaagtggttcaggaatgcctgccaaaatacacatttct

SEQ ID NO: 19842 - DNA, 40 bp, Artificial Sequence
  PCR primer for ORF amplification
tggaagtggttcaggaatggatgaacacgaggaagcagtc

SEQ ID NO: 19843 - DNA, 40 bp, Artificial Sequence
  PCR primer for ORF amplification
tggaagtggttcaggaatggtgaacgaattagagaatgtg

SEQ ID NO: 19844 - DNA, 40 bp, Artificial Sequence
  PCR primer for ORF amplification
tggaagtggttcaggaatgtcaacaaactcattccatgat

SEQ ID NO: 19845 - DNA, 40 bp, Artificial Sequence
  PCR primer for ORF amplification
tggaagtggttcaggaatgagttttttatgggggtctaca

SEQ ID NO: 19846 - DNA, 40 bp, Artificial Sequence
  PCR primer for ORF amplification
tggaagtggttcaggaatgagtgaagaggaaacggtctca

SEQ ID NO: 19847 - DNA, 40 bp, Artificial Sequence
  PCR primer for ORF amplification
tggaagtggttcaggaatgcaactggaagccactcatcag

SEQ ID NO: 19848 - DNA, 40 bp, Artificial Sequence
  PCR primer for ORF amplification
tggaagtggttcaggaatgggaaataggtctttgacagag

SEQ ID NO: 19849 - DNA, 40 bp, Artificial Sequence
  PCR primer for ORF amplification
tggaagtggttcaggaatgaatatcttcataaaagccctg

SEQ ID NO: 19850 - DNA, 40 bp, Artificial Sequence
  PCR primer for ORF amplification
tggaagtggttcaggaatggcaaaaaggcatagtcattat

SEQ ID NO: 19851 - DNA, 40 bp, Artificial Sequence
  PCR primer for ORF amplification
tggaagtggttcaggaatgggtagaagaagtagagcagct

SEQ ID NO: 19852 - DNA, 40 bp, Artificial Sequence
  PCR primer for ORF amplification
tggaagtggttcaggaatgggttccaaaagaagattctcg

SEQ ID NO: 19853 - DNA, 40 bp, Artificial Sequence
  PCR primer for ORF amplification
tggaagtggttcaggaatggttcaatctgctgtcttaggg

SEQ ID NO: 19854 - DNA, 40 bp, Artificial Sequence
  PCR primer for ORF amplification
tggaagtggttcaggaatggacttcgagactaatgaagac

SEQ ID NO: 19855 - DNA, 40 bp, Artificial Sequence
  PCR primer for ORF amplification
tggaagtggttcaggaatggggaagaaggatagacagcgc

SEQ ID NO: 19856 - DNA, 40 bp, Artificial Sequence
  PCR primer for ORF amplification
tggaagtggttcaggaatgactattgctgatgcttccaaa

SEQ ID NO: 19857 - DNA, 40 bp, Artificial Sequence
  PCR primer for ORF amplification
tggaagtggttcaggaatgtctctcagaataaaagcactt

SEQ ID NO: 19858 - DNA, 40 bp, Artificial Sequence
  PCR primer for ORF amplification
tggaagtggttcaggaatggataacgttgtagatccgtgg

SEQ ID NO: 19859 - DNA, 40 bp, Artificial Sequence
  PCR primer for ORF amplification
tggaagtggttcaggaatggccaaaaaaaatagattgaac

SEQ ID NO: 19860 - DNA, 40 bp, Artificial Sequence
  PCR primer for ORF amplification
tggaagtggttcaggaatggctagcttgaaggtatttctc

SEQ ID NO: 19861 - DNA, 40 bp, Artificial Sequence
  PCR primer for ORF amplification
tggaagtggttcaggaatgataaaaatgtggaggttacag

SEQ ID NO: 19862 - DNA, 40 bp, Artificial Sequence
  PCR primer for ORF amplification
tggaagtggttcaggaatgtctgtgcgaaacctcaccaat

SEQ ID NO: 19863 - DNA, 40 bp, Artificial Sequence
  PCR primer for ORF amplification
tggaagtggttcaggaatgcttcgcacgataatattgaaa

SEQ ID NO: 19864 - DNA, 40 bp, Artificial Sequence
  PCR primer for ORF amplification
tggaagtggttcaggaatggatataaactcaaatgcctca

SEQ ID NO: 19865 - DNA, 40 bp, Artificial Sequence
  PCR primer for ORF amplification
tggaagtggttcaggaatgggtaagaaaagggctcctcaa

SEQ ID NO: 19866 - DNA, 40 bp, Artificial Sequence
  PCR primer for ORF amplification
tggaagtggttcaggaatgttgaatggtcgtttaccactt

SEQ ID NO: 19867 - DNA, 40 bp, Artificial Sequence
  PCR primer for ORF amplification
tggaagtggttcaggaatgcaaaaatccgttagagtgggc

SEQ ID NO: 19868 - DNA, 40 bp, Artificial Sequence
  PCR primer for ORF amplification
tggaagtggttcaggaatgtcatttgatagaccggaaata

SEQ ID NO: 19869 - DNA, 40 bp, Artificial Sequence
  PCR primer for ORF amplification
tggaagtggttcaggaatgagctcatcgctactttcagtt

SEQ ID NO: 19870 - DNA, 40 bp, Artificial Sequence
  PCR primer for ORF amplification
tggaagtggttcaggaatggctgatagacctgctattcag

SEQ ID NO: 19871 - DNA, 40 bp, Artificial Sequence
  PCR primer for ORF amplification
tggaagtggttcaggaatgaagttttatatagatgattta

SEQ ID NO: 19872 - DNA, 40 bp, Artificial Sequence
  PCR primer for ORF amplification
tggaagtggttcaggaatgctgtctgcacgttctgccatc

SEQ ID NO: 19873 - DNA, 40 bp, Artificial Sequence
  PCR primer for ORF amplification
tggaagtggttcaggaatgccaacaacttatgtgccaata

SEQ ID NO: 19874 - DNA, 40 bp, Artificial Sequence
  PCR primer for ORF amplification
tggaagtggttcaggaatggagcgaacaaatacaacaaca

SEQ ID NO: 19875 - DNA, 40 bp, Artificial Sequence
  PCR primer for ORF amplification
tggaagtggttcaggaatggggtcgtttcccttagctgag

SEQ ID NO: 19876 - DNA, 40 bp, Artificial Sequence
  PCR primer for ORF amplification
tggaagtggttcaggaatggtttacactccatccaagggt

SEQ ID NO: 19877 - DNA, 40 bp, Artificial Sequence
  PCR primer for ORF amplification
tggaagtggttcaggaatgtcagtcttgcgatcacaacct

SEQ ID NO: 19878 - DNA, 40 bp, Artificial Sequence
  PCR primer for ORF amplification
tggaagtggttcaggaatgtgttacagtaggcaagccatt

SEQ ID NO: 19879 - DNA, 40 bp, Artificial Sequence
  PCR primer for ORF amplification
tggaagtggttcaggaatggctcctaaatctagttcttcc

SEQ ID NO: 19880 - DNA, 40 bp, Artificial Sequence
  PCR primer for ORF amplification
tggaagtggttcaggaatggtagattttttaccaaaagta

SEQ ID NO: 19881 - DNA, 40 bp, Artificial Sequence
  PCR primer for ORF amplification
tggaagtggttcaggaatgaatattgcagaagaaccatca

SEQ ID NO: 19882 - DNA, 40 bp, Artificial Sequence
  PCR primer for ORF amplification
tggaagtggttcaggaatggcagaagcagtactagaaaac

SEQ ID NO: 19883 - DNA, 40 bp, Artificial Sequence
  PCR primer for ORF amplification
tggaagtggttcaggaatgaacattttgaagaagtttatg

SEQ ID NO: 19884 - DNA, 40 bp, Artificial Sequence
  PCR primer for ORF amplification
tggaagtggttcaggaatgacatcatatatcgaaaggctc

SEQ ID NO: 19885 - DNA, 40 bp, Artificial Sequence
  PCR primer for ORF amplification
tggaagtggttcaggaatgcagttgtctatgcggatgatg

SEQ ID NO: 19886 - DNA, 40 bp, Artificial Sequence
  PCR primer for ORF amplification
tggaagtggttcaggaatgatcttcctaaacaccttcgca

SEQ ID NO: 19887 - DNA, 40 bp, Artificial Sequence
  PCR primer for ORF amplification
tggaagtggttcaggaatggtgaatactaggggctacact

SEQ ID NO: 19888 - DNA, 40 bp, Artificial Sequence
  PCR primer for ORF amplification
tggaagtggttcaggaatgcccatcggtaacccaatcaat

SEQ ID NO: 19889 - DNA, 40 bp, Artificial Sequence
  PCR primer for ORF amplification
tggaagtggttcaggaatgtcatctgcaaagacatttact

SEQ ID NO: 19890 - DNA, 40 bp, Artificial Sequence
  PCR primer for ORF amplification
tggaagtggttcaggaatgtcatctgcagagatggaacaa

SEQ ID NO: 19891 - DNA, 40 bp, Artificial Sequence
  PCR primer for ORF amplification
tggaagtggttcaggaatgtctgttaaagagcataacgaa

SEQ ID NO: 19892 - DNA, 40 bp, Artificial Sequence
  PCR primer for ORF amplification
tggaagtggttcaggaatgagtaagcggggtagtttacag

SEQ ID NO: 19893 - DNA, 40 bp, Artificial Sequence
  PCR primer for ORF amplification
tggaagtggttcaggaatgctgtccgatacaattgacaca

SEQ ID NO: 19894 - DNA, 40 bp, Artificial Sequence
  PCR primer for ORF amplification
tggaagtggttcaggaatggattctccatccaattctatc

SEQ ID NO: 19895 - DNA, 40 bp, Artificial Sequence
  PCR primer for ORF amplification
tggaagtggttcaggaatgtttgatggctttagcaacaat

SEQ ID NO: 19896 - DNA, 40 bp, Artificial Sequence
  PCR primer for ORF amplification
tggaagtggttcaggaatgaagatggccgtggatgaccct

SEQ ID NO: 19897 - DNA, 40 bp, Artificial Sequence
  PCR primer for ORF amplification
tggaagtggttcaggaatggcaggtcattcacacaggtca

SEQ ID NO: 19898 - DNA, 40 bp, Artificial Sequence
  PCR primer for ORF amplification
tggaagtggttcaggaatggtggaatgtatcactcccgaa

SEQ ID NO: 19899 - DNA, 40 bp, Artificial Sequence
  PCR primer for ORF amplification
tggaagtggttcaggaatgccactgtgtgagaaagggaat

SEQ ID NO: 19900 - DNA, 40 bp, Artificial Sequence
  PCR primer for ORF amplification
tggaagtggttcaggaatgctatcttcagctaataggttt

SEQ ID NO: 19901 - DNA, 40 bp, Artificial Sequence
  PCR primer for ORF amplification
tggaagtggttcaggaatgaatcattggttagcatttttg

SEQ ID NO: 19902 - DNA, 40 bp, Artificial Sequence
  PCR primer for ORF amplification
tggaagtggttcaggaatgcaagaagggggctttatccgt

SEQ ID NO: 19903 - DNA, 40 bp, Artificial Sequence
  PCR primer for ORF amplification
tggaagtggttcaggaatgtcttcattaactcgattgcta

SEQ ID NO: 19904 - DNA, 40 bp, Artificial Sequence
  PCR primer for ORF amplification
tggaagtggttcaggaatgttcgaatctgtcaatttggat

SEQ ID NO: 19905 - DNA, 40 bp, Artificial Sequence
  PCR primer for ORF amplification
tggaagtggttcaggaatgaaaaggcacgtgtctttatct

SEQ ID NO: 19906 - DNA, 40 bp, Artificial Sequence
  PCR primer for ORF amplification
tggaagtggttcaggaatggtagcgacatcttcaaagagg

SEQ ID NO: 19907 - DNA, 40 bp, Artificial Sequence; identical to SEQ ID NO: 19323
  PCR primer for ORF amplification

SEQ ID NO: 19908 - DNA, 40 bp, Artificial Sequence
  PCR primer for ORF amplification
tggaagtggttcaggaatgaccactcaagaatcgatcaaa

SEQ ID NO: 19909 - DNA, 40 bp, Artificial Sequence
  PCR primer for ORF amplification
tggaagtggttcaggaatgcaagtactagtgacgctctgg

SEQ ID NO: 19910 - DNA, 40 bp, Artificial Sequence
  PCR primer for ORF amplification
tggaagtggttcaggaatggtaatacaaactgctactacg

SEQ ID NO: 19911 - DNA, 40 bp, Artificial Sequence
  PCR primer for ORF amplification
tggaagtggttcaggaatggcagcaaaaagaggattagcc

SEQ ID NO: 19912 - DNA, 40 bp, Artificial Sequence
  PCR primer for ORF amplification
tggaagtggttcaggaatgagtgatgaaggtgctgataaa

SEQ ID NO: 19913 - DNA, 40 bp, Artificial Sequence
  PCR primer for ORF amplification
tggaagtggttcaggaatgacgaaactaatcgctccttca

SEQ ID NO: 19914 - DNA, 40 bp, Artificial Sequence
  PCR primer for ORF amplification
tggaagtggttcaggaatggatttgttagcggccagcgta

SEQ ID NO: 19915 - DNA, 40 bp, Artificial Sequence
  PCR primer for ORF amplification
tggaagtggttcaggaatggtttgctgcttatgggtgctt

SEQ ID NO: 19916 - DNA, 40 bp, Artificial Sequence
  PCR primer for ORF amplification
tggaagtggttcaggaatgtccgacaagatacaggaggag

SEQ ID NO: 19917 - DNA, 40 bp, Artificial Sequence
  PCR primer for ORF amplification
tggaagtggttcaggaatgtccttctttgggttagaaaat

SEQ ID NO: 19918 - DNA, 40 bp, Artificial Sequence
  PCR primer for ORF amplification
tggaagtggttcaggaatggtacagaacaatgaatcggtt

SEQ ID NO: 19919 - DNA, 40 bp, Artificial Sequence
  PCR primer for ORF amplification
tggaagtggttcaggaatgaaaaaccctagcttcgactgg

SEQ ID NO: 19920 - DNA, 40 bp, Artificial Sequence
  PCR primer for ORF amplification
tggaagtggttcaggaatgtcacagaagcaaagtacgaat

SEQ ID NO: 19921 - DNA, 40 bp, Artificial Sequence
  PCR primer for ORF amplification
tggaagtggttcaggaatgagtaccatttatagggagagc

SEQ ID NO: 19922 - DNA, 40 bp, Artificial Sequence
  PCR primer for ORF amplification
tggaagtggttcaggaatgagttataaagtgaatagttcg

SEQ ID NO: 19923 - DNA, 40 bp, Artificial Sequence
  PCR primer for ORF amplification
tggaagtggttcaggaatggttcatcgaggaaggactttg

SEQ ID NO: 19924 - DNA, 40 bp, Artificial Sequence
  PCR primer for ORF amplification
tggaagtggttcaggaatggttttgccgattctaccgtta

SEQ ID NO: 19925 - DNA, 40 bp, Artificial Sequence
  PCR primer for ORF amplification
tggaagtggttcaggaatggcttctgtacctaaacgccat

SEQ ID NO: 19926 - DNA, 40 bp, Artificial Sequence
  PCR primer for ORF amplification
tggaagtggttcaggaatggggttctacaactgtagattc

SEQ ID NO: 19927 - DNA, 40 bp, Artificial Sequence
  PCR primer for ORF amplification
tggaagtggttcaggaatgttacaacggagatttatatcc

SEQ ID NO: 19928 - DNA, 40 bp, Artificial Sequence
  PCR primer for ORF amplification
tggaagtggttcaggaatggcgagaagtagaaagaattca

SEQ ID NO: 19929 - DNA, 40 bp, Artificial Sequence
  PCR primer for ORF amplification
tggaagtggttcaggaatgagatttcttcaggtttataaa

SEQ ID NO: 19930 - DNA, 40 bp, Artificial Sequence
  PCR primer for ORF amplification
tggaagtggttcaggaatgctcaacattctcgttttagga

SEQ ID NO: 19931 - DNA, 40 bp, Artificial Sequence
  PCR primer for ORF amplification
tggaagtggttcaggaatgtcagatgaaaaccataacagt

SEQ ID NO: 19932 - DNA, 40 bp, Artificial Sequence
  PCR primer for ORF amplification
tggaagtggttcaggaatggcgttggaagaagtggtacga

SEQ ID NO: 19933 - DNA, 40 bp, Artificial Sequence
  PCR primer for ORF amplification
tggaagtggttcaggaatgatgttttggtcctcaaagacg

SEQ ID NO: 19934 - DNA, 40 bp, Artificial Sequence
  PCR primer for ORF amplification
tggaagtggttcaggaatggctgcgggtcaaaaaaaatat

SEQ ID NO: 19935 - DNA, 40 bp, Artificial Sequence
  PCR primer for ORF amplification
tggaagtggttcaggaatgaacgtgcctgaaacaagacaa

SEQ ID NO: 19936 - DNA, 40 bp, Artificial Sequence
  PCR primer for ORF amplification
tggaagtggttcaggaatgggctcagaacaagccttaagt

SEQ ID NO: 19937 - DNA, 40 bp, Artificial Sequence
  PCR primer for ORF amplification
tggaagtggttcaggaatgtcttcagatcccttgcagcaa

SEQ ID NO: 19938 - DNA, 40 bp, Artificial Sequence
  PCR primer for ORF amplification
tggaagtggttcaggaatgaactcatccaataataacgac

SEQ ID NO: 19939 - DNA, 40 bp, Artificial Sequence
  PCR primer for ORF amplification
tggaagtggttcaggaatgatggctaagaacaacaaaact

SEQ ID NO: 19940 - DNA, 40 bp, Artificial Sequence
  PCR primer for ORF amplification
tggaagtggttcaggaatgccagatttgaagtccaagacc

SEQ ID NO: 19941 - DNA, 40 bp, Artificial Sequence
  PCR primer for ORF amplification
tggaagtggttcaggaatggttttggaagtgccctcaatc

SEQ ID NO: 19942 - DNA, 40 bp, Artificial Sequence
  PCR primer for ORF amplification
tggaagtggttcaggaatgaggagcagttatcaaccagtg

SEQ ID NO: 19943 - DNA, 40 bp, Artificial Sequence
  PCR primer for ORF amplification
tggaagtggttcaggaatgccttcatccatatccgtcaag

SEQ ID NO: 19944 - DNA, 40 bp, Artificial Sequence
  PCR primer for ORF amplification
tggaagtggttcaggaatggatttgtttattgaaagcaag

SEQ ID NO: 19945 - DNA, 40 bp, Artificial Sequence
  PCR primer for ORF amplification
tggaagtggttcaggaatggtagattcaattcaccgtatt

SEQ ID NO: 19946 - DNA, 40 bp, Artificial Sequence
  PCR primer for ORF amplification
tggaagtggttcaggaatgtcttctgtagaagaattgact

SEQ ID NO: 19947 - DNA, 40 bp, Artificial Sequence
  PCR primer for ORF amplification
tggaagtggttcaggaatgaaaagaagaagcgatgctttg

SEQ ID NO: 19948 - DNA, 40 bp, Artificial Sequence
  PCR primer for ORF amplification
tggaagtggttcaggaatgaatactccacagattagtctg

SEQ ID NO: 19949 - DNA, 40 bp, Artificial Sequence
  PCR primer for ORF amplification
tggaagtggttcaggaatgccttcaggtcataacgataaa

SEQ ID NO: 19950 - DNA, 40 bp, Artificial Sequence
  PCR primer for ORF amplification
tggaagtggttcaggaatggacaatcaggctacacagagg

SEQ ID NO: 19951 - DNA, 40 bp, Artificial Sequence
  PCR primer for ORF amplification
tggaagtggttcaggaatggatggttttcgtgtagctggt

SEQ ID NO: 19952 - DNA, 40 bp, Artificial Sequence
  PCR primer for ORF amplification
tggaagtggttcaggaatggccggttcacaacttaagaat

SEQ ID NO: 19953 - DNA, 40 bp, Artificial Sequence
  PCR primer for ORF amplification
tggaagtggttcaggaatgagaatgatacagagagagaga

SEQ ID NO: 19954 - DNA, 40 bp, Artificial Sequence
  PCR primer for ORF amplification
tggaagtggttcaggaatggtaatcttcaaagaacgcaaa

SEQ ID NO: 19955 - DNA, 40 bp, Artificial Sequence
  PCR primer for ORF amplification
tggaagtggttcaggaatgtcgaatataagtaccaaagat

SEQ ID NO: 19956 - DNA, 40 bp, Artificial Sequence
  PCR primer for ORF amplification
tggaagtggttcaggaatgttaagacaagctacaaaagca

SEQ ID NO: 19957 - DNA, 40 bp, Artificial Sequence
  PCR primer for ORF amplification
tggaagtggttcaggaatgagaacgaagagaactaggggt

SEQ ID NO: 19958 - DNA, 40 bp, Artificial Sequence
  PCR primer for ORF amplification
tggaagtggttcaggaatgtcccgtttcttttcgtctaat

SEQ ID NO: 19959 - DNA, 40 bp, Artificial Sequence
  PCR primer for ORF amplification
tggaagtggttcaggaatgaaagtgaggaaatatattact

SEQ ID NO: 19960 - DNA, 40 bp, Artificial Sequence
  PCR primer for ORF amplification
tggaagtggttcaggaatgacatccgatgatgggaatgct

SEQ ID NO: 19961 - DNA, 40 bp, Artificial Sequence
  PCR primer for ORF amplification
tggaagtggttcaggaatgggaaacagtccttctactcag

SEQ ID NO: 19962 - DNA, 40 bp, Artificial Sequence
  PCR primer for ORF amplification
tggaagtggttcaggaatgtctgagactctgcctagatct

SEQ ID NO: 19963 - DNA, 40 bp, Artificial Sequence
  PCR primer for ORF amplification
tggaagtggttcaggaatgctattcaatatcaaccgtcaa

SEQ ID NO: 19964 - DNA, 40 bp, Artificial Sequence
  PCR primer for ORF amplification
tggaagtggttcaggaatggatgttgtgcagcagaaacag

SEQ ID NO: 19965 - DNA, 40 bp, Artificial Sequence
  PCR primer for ORF amplification
tggaagtggttcaggaatgagcactgaacaggtcggtaga

SEQ ID NO: 19966 - DNA, 40 bp, Artificial Sequence
  PCR primer for ORF amplification
tggaagtggttcaggaatgcctaactcaaatgttcggatt

SEQ ID NO: 19967 - DNA, 40 bp, Artificial Sequence
  PCR primer for ORF amplification
tggaagtggttcaggaatggatctgaaaacctcatataaa

SEQ ID NO: 19968 - DNA, 40 bp, Artificial Sequence
  PCR primer for ORF amplification
tggaagtggttcaggaatggcaggtgctccagctcctcct

SEQ ID NO: 19969 - DNA, 40 bp, Artificial Sequence
  PCR primer for ORF amplification
tggaagtggttcaggaatgtcggaagagaaaacgtacaaa

SEQ ID NO: 19970 - DNA, 40 bp, Artificial Sequence
  PCR primer for ORF amplification
tggaagtggttcaggaatggaaggtggcgaagaagaagtt

SEQ ID NO: 19971 - DNA, 40 bp, Artificial Sequence
  PCR primer for ORF amplification
tggaagtggttcaggaatggcattttcacgtcttacatct

SEQ ID NO: 19972 - DNA, 40 bp, Artificial Sequence
  PCR primer for ORF amplification
tggaagtggttcaggaatggcgggaaacggtaaggacaaa

SEQ ID NO: 19973 - DNA, 40 bp, Artificial Sequence
  PCR primer for ORF amplification
tggaagtggttcaggaatgtcactatggccctttggagag

SEQ ID NO: 19974 - DNA, 40 bp, Artificial Sequence
  PCR primer for ORF amplification
tggaagtggttcaggaatgagttctttggacgaggatgaa

SEQ ID NO: 19975 - DNA, 40 bp, Artificial Sequence
  PCR primer for ORF amplification
tggaagtggttcaggaatgtggaaatggaatgtgcgcaga

SEQ ID NO: 19976 - DNA, 40 bp, Artificial Sequence
  PCR primer for ORF amplification
tggaagtggttcaggaatgaacgaagttcctaccactcca

SEQ ID NO: 19977 - DNA, 40 bp, Artificial Sequence
  PCR primer for ORF amplification
tggaagtggttcaggaatggaaaatattacacaacccaca

SEQ ID NO: 19978 - DNA, 40 bp, Artificial Sequence
  PCR primer for ORF amplification
tggaagtggttcaggaatgctggaaggtacggtagattat

SEQ ID NO: 19979 - DNA, 40 bp, Artificial Sequence
  PCR primer for ORF amplification
tggaagtggttcaggaatgtgccataattctgttaggagc

SEQ ID NO: 19980 - DNA, 40 bp, Artificial Sequence
  PCR primer for ORF amplification
tggaagtggttcaggaatgacacagcttcagatttcatta

SEQ ID NO: 19981 - DNA, 40 bp, Artificial Sequence
  PCR primer for ORF amplification
tggaagtggttcaggaatggaaatcaaagaggtagatgac

SEQ ID NO: 19982 - DNA, 40 bp, Artificial Sequence
  PCR primer for ORF amplification
tggaagtggttcaggaatgatgaatttttttacatcaaaa

SEQ ID NO: 19983 - DNA, 40 bp, Artificial Sequence
  PCR primer for ORF amplification
tggaagtggttcaggaatgtcaaagctattttctactgtc

SEQ ID NO: 19984 - DNA, 40 bp, Artificial Sequence
  PCR primer for ORF amplification
tggaagtggttcaggaatggagaatacactgggtgagggg

SEQ ID NO: 19985 - DNA, 40 bp, Artificial Sequence
  PCR primer for ORF amplification
tggaagtggttcaggaatggataacttcaaaatttacagt

SEQ ID NO: 19986 - DNA, 40 bp, Artificial Sequence
  PCR primer for ORF amplification
tggaagtggttcaggaatgtcgtcttcctcacttcgagtt

SEQ ID NO: 19987 - DNA, 40 bp, Artificial Sequence
  PCR primer for ORF amplification
tggaagtggttcaggaatgttgctactttcttggtcaaga

SEQ ID NO: 19988 - DNA, 40 bp, Artificial Sequence
  PCR primer for ORF amplification
tggaagtggttcaggaatgcatagcaacgtatttgttggt

SEQ ID NO: 19989 - DNA, 40 bp, Artificial Sequence
  PCR primer for ORF amplification
tggaagtggttcaggaatgcctagcccatatgacggtaaa

SEQ ID NO: 19990 - DNA, 40 bp, Artificial Sequence
  PCR primer for ORF amplification
tggaagtggttcaggaatggaaggtttgaagaaaaagatt

SEQ ID NO: 19991 - DNA, 40 bp, Artificial Sequence
  PCR primer for ORF amplification
tggaagtggttcaggaatgtctagtccagatgattttgaa

SEQ ID NO: 19992 - DNA, 40 bp, Artificial Sequence
  PCR primer for ORF amplification
tggaagtggttcaggaatgttcaaaccagtagacttctct

SEQ ID NO: 19993 - DNA, 40 bp, Artificial Sequence
  PCR primer for ORF amplification
tggaagtggttcaggaatgctgtttggagtgaagttggct

SEQ ID NO: 19994 - DNA, 40 bp, Artificial Sequence
  PCR primer for ORF amplification
tggaagtggttcaggaatgttgggtaatttactgagaaat

SEQ ID NO: 19995 - DNA, 40 bp, Artificial Sequence
  PCR primer for ORF amplification
tggaagtggttcaggaatggccaagaggaaatatggcagg

SEQ ID NO: 19996 - DNA, 40 bp, Artificial Sequence
  PCR primer for ORF amplification
tggaagtggttcaggaatgaacttgaagcagttcacgtgc

SEQ ID NO: 19997 - DNA, 40 bp, Artificial Sequence
  PCR primer for ORF amplification
tggaagtggttcaggaatgaagacaccaacaagagtttcg

SEQ ID NO: 19998 - DNA, 40 bp, Artificial Sequence
  PCR primer for ORF amplification
tggaagtggttcaggaatgacatctgcattaagggttttg

SEQ ID NO: 19999 - DNA, 40 bp, Artificial Sequence
  PCR primer for ORF amplification
tggaagtggttcaggaatggcaatcaagtcattggaatcg

SEQ ID NO: 20000 - DNA, 40 bp, Artificial Sequence
  PCR primer for ORF amplification
tggaagtggttcaggaatgtcattaacagcaaacgacgaa

SEQ ID NO: 20001 - DNA, 40 bp, Artificial Sequence
  PCR primer for ORF amplification
tggaagtggttcaggaatgccgacaccttcaaacgctata

SEQ ID NO: 20002 - DNA, 40 bp, Artificial Sequence
  PCR primer for ORF amplification
tggaagtggttcaggaatggattcgattacagtaaaaaaa

SEQ ID NO: 20003 - DNA, 40 bp, Artificial Sequence
  PCR primer for ORF amplification
tggaagtggttcaggaatgggctcttcgttgagaagcttt

SEQ ID NO: 20004 - DNA, 40 bp, Artificial Sequence
  PCR primer for ORF amplification
tggaagtggttcaggaatgaataatgctgcaaatacaggg

SEQ ID NO: 20005 - DNA, 40 bp, Artificial Sequence
  PCR primer for ORF amplification
tggaagtggttcaggaatgataacactcttattatacctg

SEQ ID NO: 20006 - DNA, 40 bp, Artificial Sequence
  PCR primer for ORF amplification
tggaagtggttcaggaatgcttatttcaaaatctaagatg

SEQ ID NO: 20007 - DNA, 40 bp, Artificial Sequence
  PCR primer for ORF amplification
tggaagtggttcaggaatgtctaaccaaatatactcagcg

SEQ ID NO: 20008 - DNA, 40 bp, Artificial Sequence
  PCR primer for ORF amplification
tggaagtggttcaggaatgacgaatatggcggaggataaa

SEQ ID NO: 20009 - DNA, 40 bp, Artificial Sequence
  PCR primer for ORF amplification
tggaagtggttcaggaatggtacaaagatgattatattca

SEQ ID NO: 20010 - DNA, 40 bp, Artificial Sequence
  PCR primer for ORF amplification
tggaagtggttcaggaatgctatttggtattaaactggct

SEQ ID NO: 20011 - DNA, 40 bp, Artificial Sequence
  PCR primer for ORF amplification
tggaagtggttcaggaatgggtgaagaacataaaccactt

SEQ ID NO: 20012 - DNA, 40 bp, Artificial Sequence
  PCR primer for ORF amplification
tggaagtggttcaggaatgctagacaaggcgcgctctcaa

SEQ ID NO: 20013 - DNA, 40 bp, Artificial Sequence
  PCR primer for ORF amplification
tggaagtggttcaggaatggctcatagaaaattacagcag

SEQ ID NO: 20014 - DNA, 40 bp, Artificial Sequence
  PCR primer for ORF amplification
tggaagtggttcaggaatgaacgacccttctttactaggc

SEQ ID NO: 20015 - DNA, 40 bp, Artificial Sequence
  PCR primer for ORF amplification
tggaagtggttcaggaatggttaaagtaaagtcgaaaaag

SEQ ID NO: 20016 - DNA, 40 bp, Artificial Sequence
  PCR primer for ORF amplification
tggaagtggttcaggaatgttttcatcatcatctcgacct

SEQ ID NO: 20017 - DNA, 40 bp, Artificial Sequence
  PCR primer for ORF amplification
tggaagtggttcaggaatgtctgaatatctagctcagacg

SEQ ID NO: 20018 - DNA, 40 bp, Artificial Sequence
  PCR primer for ORF amplification
tggaagtggttcaggaatgttcacatttatacccatcacc

SEQ ID NO: 20019 - DNA, 40 bp, Artificial Sequence
  PCR primer for ORF amplification
tggaagtggttcaggaatgctggagacgttgcgcggaaat

SEQ ID NO: 20020 - DNA, 40 bp, Artificial Sequence
  PCR primer for ORF amplification
tggaagtggttcaggaatggatttcgttgtagactatcag

SEQ ID NO: 20021 - DNA, 40 bp, Artificial Sequence
  PCR primer for ORF amplification
tggaagtggttcaggaatgaaagtggtaaagtttccatgg

SEQ ID NO: 20022 - DNA, 40 bp, Artificial Sequence
  PCR primer for ORF amplification
tggaagtggttcaggaatgaagttttgtctttattgctgt

SEQ ID NO: 20023 - DNA, 40 bp, Artificial Sequence
  PCR primer for ORF amplification
tggaagtggttcaggaatggatgatctgctaaaagttccc

SEQ ID NO: 20024 - DNA, 40 bp, Artificial Sequence
  PCR primer for ORF amplification
tggaagtggttcaggaatggcagagaaggaggaagcgatt

SEQ ID NO: 20025 - DNA, 40 bp, Artificial Sequence
  PCR primer for ORF amplification
tggaagtggttcaggaatggacctcccaactgttaatagc

SEQ ID NO: 20026 - DNA, 40 bp, Artificial Sequence
  PCR primer for ORF amplification
tggaagtggttcaggaatgggtaagacacaaaagaagaat

SEQ ID NO: 20027 - DNA, 40 bp, Artificial Sequence
  PCR primer for ORF amplification
tggaagtggttcaggaatggttgctttcactgttgaccaa

SEQ ID NO: 20028 - DNA, 40 bp, Artificial Sequence
  PCR primer for ORF amplification
tggaagtggttcaggaatgataaatgagagcgtttccaag

SEQ ID NO: 20029 - DNA, 40 bp, Artificial Sequence
  PCR primer for ORF amplification
tggaagtggttcaggaatgtctctttcagctgcagcgaat

SEQ ID NO: 20030 - DNA, 40 bp, Artificial Sequence
  PCR primer for ORF amplification
tggaagtggttcaggaatgacggacgttgaaggctaccaa

SEQ ID NO: 20031 - DNA, 40 bp, Artificial Sequence
  PCR primer for ORF amplification
tggaagtggttcaggaatgagcattgcatctcagaaaaag

SEQ ID NO: 20032 - DNA, 40 bp, Artificial Sequence
  PCR primer for ORF amplification
tggaagtggttcaggaatgtctttaatttcagctgtagaa

SEQ ID NO: 20033 - DNA, 40 bp, Artificial Sequence
  PCR primer for ORF amplification
tggaagtggttcaggaatgaaaccttacttatttgaccta

SEQ ID NO: 20034 - DNA, 40 bp, Artificial Sequence
  PCR primer for ORF amplification
tggaagtggttcaggaatgagtgcggcacttccatcaatt

SEQ ID NO: 20035 - DNA, 40 bp, Artificial Sequence
  PCR primer for ORF amplification
tggaagtggttcaggaatggaactagagcccactcttttt

SEQ ID NO: 20036 - DNA, 40 bp, Artificial Sequence
  PCR primer for ORF amplification
tggaagtggttcaggaatgaatcctatcaactctctagcg

SEQ ID NO: 20037 - DNA, 40 bp, Artificial Sequence
  PCR primer for ORF amplification
tggaagtggttcaggaatggaaactattgattcgaagcaa

SEQ ID NO: 20038 - DNA, 40 bp, Artificial Sequence
  PCR primer for ORF amplification
tggaagtggttcaggaatgtccatagcgcgattagtatac

SEQ ID NO: 20039 - DNA, 40 bp, Artificial Sequence
  PCR primer for ORF amplification
tggaagtggttcaggaatggctctgccaatagagggcaaa

SEQ ID NO: 20040 - DNA, 40 bp, Artificial Sequence
  PCR primer for ORF amplification
tggaagtggttcaggaatggttatggcggatactattgcc

SEQ ID NO: 20041 - DNA, 40 bp, Artificial Sequence
  PCR primer for ORF amplification
tggaagtggttcaggaatgttgctagtacgaacgacttcc

SEQ ID NO: 20042 - DNA, 40 bp, Artificial Sequence
  PCR primer for ORF amplification
tggaagtggttcaggaatgccgaagaatagtcaccaccat

SEQ ID NO: 20043 - DNA, 40 bp, Artificial Sequence
  PCR primer for ORF amplification
tggaagtggttcaggaatggatatggatacgcaggaggca

SEQ ID NO: 20044 - DNA, 40 bp, Artificial Sequence
  PCR primer for ORF amplification
tggaagtggttcaggaatgacctcgattcaggagcgaggc

SEQ ID NO: 20045 - DNA, 40 bp, Artificial Sequence
  PCR primer for ORF amplification
tggaagtggttcaggaatgagttctgtcaaccaaatatat

SEQ ID NO: 20046 - DNA, 40 bp, Artificial Sequence
  PCR primer for ORF amplification
tggaagtggttcaggaatgttcaagtcgaaaacaagcact

SEQ ID NO: 20047 - DNA, 40 bp, Artificial Sequence
  PCR primer for ORF amplification
tggaagtggttcaggaatgagcagatgctcaaacgcggcg

SEQ ID NO: 20048 - DNA, 40 bp, Artificial Sequence
  PCR primer for ORF amplification
tggaagtggttcaggaatgatctcaacagcttctgcattt

SEQ ID NO: 20049 - DNA, 40 bp, Artificial Sequence
  PCR primer for ORF amplification
tggaagtggttcaggaatgtcatttcagattaccccaact

SEQ ID NO: 20050 - DNA, 40 bp, Artificial Sequence
  PCR primer for ORF amplification
tggaagtggttcaggaatggcgatccaaacccgttttgcc

SEQ ID NO: 20051 - DNA, 40 bp, Artificial Sequence
  PCR primer for ORF amplification
tggaagtggttcaggaatgtctaggaaaagaagtactaag

SEQ ID NO: 20052 - DNA, 40 bp, Artificial Sequence
  PCR primer for ORF amplification
tggaagtggttcaggaatgtgggtagtacgataccagaat

SEQ ID NO: 20053 - DNA, 40 bp, Artificial Sequence
  PCR primer for ORF amplification
tggaagtggttcaggaatgggagatgagaagctttcacgc

SEQ ID NO: 20054 - DNA, 40 bp, Artificial Sequence
  PCR primer for ORF amplification
tggaagtggttcaggaatgtctgaaggaaaacaacaattc

SEQ ID NO: 20055 - DNA, 40 bp, Artificial Sequence
  PCR primer for ORF amplification
tggaagtggttcaggaatgtcccgtgaagtactgccaaac

SEQ ID NO: 20056 - DNA, 40 bp, Artificial Sequence
  PCR primer for ORF amplification
tggaagtggttcaggaatgtcattaccgggtacacctact

SEQ ID NO: 20057 - DNA, 40 bp, Artificial Sequence
  PCR primer for ORF amplification
tggaagtggttcaggaatgtcgtccttatccacttcattt

SEQ ID NO: 20058 - DNA, 40 bp, Artificial Sequence
  PCR primer for ORF amplification
tggaagtggttcaggaatgacttataaatacaattgctgt

SEQ ID NO: 20059 - DNA, 40 bp, Artificial Sequence
  PCR primer for ORF amplification
tggaagtggttcaggaatgccaaagtggataagatcaaca

SEQ ID NO: 20060 - DNA, 40 bp, Artificial Sequence
  PCR primer for ORF amplification
tggaagtggttcaggaatgtcacgtaagagctcgactgaa

SEQ ID NO: 20061 - DNA, 40 bp, Artificial Sequence
  PCR primer for ORF amplification
tggaagtggttcaggaatgtcagcatacatcgcaatgaaa

SEQ ID NO: 20062 - DNA, 40 bp, Artificial Sequence
  PCR primer for ORF amplification
tggaagtggttcaggaatgtcatcatcctcaagttcatca

SEQ ID NO: 20063 - DNA, 40 bp, Artificial Sequence
  PCR primer for ORF amplification
tggaagtggttcaggaatgaacactgcattggatgattta

SEQ ID NO: 20064 - DNA, 40 bp, Artificial Sequence
  PCR primer for ORF amplification
tggaagtggttcaggaatggaagggcaaaaatcgaatgca

SEQ ID NO: 20065 - DNA, 40 bp, Artificial Sequence
  PCR primer for ORF amplification
tggaagtggttcaggaatggacaaaaaggaatattcggag

SEQ ID NO: 20066 - DNA, 40 bp, Artificial Sequence
  PCR primer for ORF amplification
tggaagtggttcaggaatggtcaatatttctgatttcttt

SEQ ID NO: 20067 - DNA, 40 bp, Artificial Sequence
  PCR primer for ORF amplification
tggaagtggttcaggaatgtccaccgctgaatttgctcaa

SEQ ID NO: 20068 - DNA, 40 bp, Artificial Sequence
  PCR primer for ORF amplification
tggaagtggttcaggaatgaacatggcaatccaaacaatt

SEQ ID NO: 20069 - DNA, 40 bp, Artificial Sequence
  PCR primer for ORF amplification
tggaagtggttcaggaatgcagtacgtaggcagagctctt

SEQ ID NO: 20070 - DNA, 40 bp, Artificial Sequence
  PCR primer for ORF amplification
tggaagtggttcaggaatgtccagcagcaattttaacgag

SEQ ID NO: 20071 - DNA, 40 bp, Artificial Sequence
  PCR primer for ORF amplification
tggaagtggttcaggaatgccatctgctagcttactcgtc

SEQ ID NO: 20072 - DNA, 40 bp, Artificial Sequence
  PCR primer for ORF amplification
tggaagtggttcaggaatgggatatgactcccaagttagg

SEQ ID NO: 20073 - DNA, 40 bp, Artificial Sequence
  PCR primer for ORF amplification
tggaagtggttcaggaatgagtatgtttctttccattgga

SEQ ID NO: 20074 - DNA, 40 bp, Artificial Sequence
  PCR primer for ORF amplification
tggaagtggttcaggaatgacagcacgtcgtttgattaat

SEQ ID NO: 20075 - DNA, 40 bp, Artificial Sequence
  PCR primer for ORF amplification
tggaagtggttcaggaatgtacatggccagatgtggcccc

SEQ ID NO: 20076 - DNA, 40 bp, Artificial Sequence
  PCR primer for ORF amplification
tggaagtggttcaggaatgtcgtacaccaataaacgtcat

SEQ ID NO: 20077 - DNA, 40 bp, Artificial Sequence
  PCR primer for ORF amplification
aattacatgactcgagttaagacgaaaaaagtaatggaac

SEQ ID NO: 20078 - DNA, 40 bp, Artificial Sequence
  PCR primer for ORF amplification
aattacatgactcgagttataatattaggtatgtagatat

SEQ ID NO: 20079 - DNA, 40 bp, Artificial Sequence
  PCR primer for ORF amplification
aattacatgactcgagttactcgcctctaaccccacgtag

SEQ ID NO: 20080 - DNA, 40 bp, Artificial Sequence
  PCR primer for ORF amplification
aattacatgactcgagttatctatctaatgaaaccacagt

SEQ ID NO: 20081 - DNA, 40 bp, Artificial Sequence
  PCR primer for ORF amplification
aattacatgactcgagctaagcaattaggcttttggggcg

SEQ ID NO: 20082 - DNA, 40 bp, Artificial Sequence
  PCR primer for ORF amplification
aattacatgactcgagtcacacgtacatacacgaaaagat

SEQ ID NO: 20083 - DNA, 40 bp, Artificial Sequence
  PCR primer for ORF amplification
aattacatgactcgagttagttcttaggagacatggtgga

SEQ ID NO: 20084 - DNA, 40 bp, Artificial Sequence
  PCR primer for ORF amplification
aattacatgactcgagctaagcaataacacatgctgggtc

SEQ ID NO: 20085 - DNA, 40 bp, Artificial Sequence
  PCR primer for ORF amplification
aattacatgactcgagtcaaataaagcctttccttggggg

SEQ ID NO: 20086 - DNA, 40 bp, Artificial Sequence
  PCR primer for ORF amplification
aattacatgactcgagctatataaaaagcaatgaagaagt

SEQ ID NO: 20087 - DNA, 40 bp, Artificial Sequence
  PCR primer for ORF amplification
aattacatgactcgagtcactgcaagtaaggaacatcgct

SEQ ID NO: 20088 - DNA, 40 bp, Artificial Sequence
  PCR primer for ORF amplification
aattacatgactcgagctaaatgatactataccaagacaa

SEQ ID NO: 20089 - DNA, 40 bp, Artificial Sequence
  PCR primer for ORF amplification
aattacatgactcgagtcagaaagccgggtaaggtatgac

SEQ ID NO: 20090 - DNA, 40 bp, Artificial Sequence
  PCR primer for ORF amplification
aattacatgactcgagttaatttgaggctaacctgtatgg

SEQ ID NO: 20091 - DNA, 40 bp, Artificial Sequence
  PCR primer for ORF amplification
aattacatgactcgagttaagcgataacacaggcgggatc

SEQ ID NO: 20092 - DNA, 40 bp, Artificial Sequence
  PCR primer for ORF amplification
aattacatgactcgagtcattttactagtttatggactct

SEQ ID NO: 20093 - DNA, 40 bp, Artificial Sequence
  PCR primer for ORF amplification
aattacatgactcgagttaatttttccaatctctgatctg

SEQ ID NO: 20094 - DNA, 40 bp, Artificial Sequence
  PCR primer for ORF amplification
aattacatgactcgagttaaaaggcgcgagacagcaaaca

SEQ ID NO: 20095 - DNA, 40 bp, Artificial Sequence
  PCR primer for ORF amplification
aattacatgactcgagtcatattgttcggatgcggaagat

SEQ ID NO: 20096 - DNA, 40 bp, Artificial Sequence
  PCR primer for ORF amplification
aattacatgactcgagttaagatgttggggtactataaat

SEQ ID NO: 20097 - DNA, 40 bp, Artificial Sequence
  PCR primer for ORF amplification
aattacatgactcgagtcaatagtatgttcctactataat

SEQ ID NO: 20098 - DNA, 40 bp, Artificial Sequence
  PCR primer for ORF amplification
aattacatgactcgagttagaatctttgcaatcctctttg

SEQ ID NO: 20099 - DNA, 40 bp, Artificial Sequence
  PCR primer for ORF amplification
aattacatgactcgagctagtttgcgatagtgtagatacc

SEQ ID NO: 20100 - DNA, 40 bp, Artificial Sequence
  PCR primer for ORF amplification
aattacatgactcgagctaccagaaagcaccgtttcccgt

SEQ ID NO: 20101 - DNA, 40 bp, Artificial Sequence
  PCR primer for ORF amplification
aattacatgactcgagtcaaaaaagggagggaaaaaaatt

SEQ ID NO: 20102 - DNA, 40 bp, Artificial Sequence
  PCR primer for ORF amplification
aattacatgactcgagttagaatctttgtaaacctctttg

SEQ ID NO: 20103 - DNA, 40 bp, Artificial Sequence
  PCR primer for ORF amplification
aattacatgactcgagttaaaatcgctccacaatggtctc

SEQ ID NO: 20104 - DNA, 40 bp, Artificial Sequence
  PCR primer for ORF amplification
aattacatgactcgagtcacactgacgcatgattaaaacg

SEQ ID NO: 20105 - DNA, 40 bp, Artificial Sequence
  PCR primer for ORF amplification
aattacatgactcgagttacagtacaaggatctgagtgtt

SEQ ID NO: 20106 - DNA, 40 bp, Artificial Sequence
  PCR primer for ORF amplification
aattacatgactcgagttacattatcaatccttgcatttc

SEQ ID NO: 20107 - DNA, 40 bp, Artificial Sequence
  PCR primer for ORF amplification
aattacatgactcgagttagtttccgacgaattgagctga

SEQ ID NO: 20108 - DNA, 40 bp, Artificial Sequence
  PCR primer for ORF amplification
aattacatgactcgagtcatgtttgccgtccgtttaaata

SEQ ID NO: 20109 - DNA, 40 bp, Artificial Sequence
  PCR primer for ORF amplification
aattacatgactcgagctagtgattaactggtttcctttc

SEQ ID NO: 20110 - DNA, 40 bp, Artificial Sequence
  PCR primer for ORF amplification
aattacatgactcgagtcacggccaaactatgttggtatc

SEQ ID NO: 20111 - DNA, 40 bp, Artificial Sequence
  PCR primer for ORF amplification
aattacatgactcgagttaacctatataaattttcttaca

SEQ ID NO: 20112 - DNA, 40 bp, Artificial Sequence
  PCR primer for ORF amplification
aattacatgactcgagttataatttagaaataaataatct

SEQ ID NO: 20113 - DNA, 40 bp, Artificial Sequence
  PCR primer for ORF amplification
aattacatgactcgagctacaggatgtcgccgcgtatgtc

SEQ ID NO: 20114 - DNA, 40 bp, Artificial Sequence
  PCR primer for ORF amplification
aattacatgactcgagtcaaggttgccgagtaaacggttt

SEQ ID NO: 20115 - DNA, 40 bp, Artificial Sequence
  PCR primer for ORF amplification
aattacatgactcgagctaaaaaaaaaacaacgaaaaaat

SEQ ID NO: 20116 - DNA, 40 bp, Artificial Sequence
  PCR primer for ORF amplification
aattacatgactcgagttaatgatatagaaatagtggact

SEQ ID NO: 20117 - DNA, 40 bp, Artificial Sequence
  PCR primer for ORF amplification
aattacatgactcgagtcatttaaacggcactcctaaaaa

SEQ ID NO: 20118 - DNA, 40 bp, Artificial Sequence
  PCR primer for ORF amplification
aattacatgactcgagtcagtttctgccgtgcttgtttga

SEQ ID NO: 20119 - DNA, 40 bp, Artificial Sequence
  PCR primer for ORF amplification
aattacatgactcgagttaagatatgagaacaatgagaaa

SEQ ID NO: 20120 - DNA, 40 bp, Artificial Sequence
  PCR primer for ORF amplification
aattacatgactcgagtcacgggccgtcacaagcgcaccg

SEQ ID NO: 20121 - DNA, 40 bp, Artificial Sequence
  PCR primer for ORF amplification
aattacatgactcgagttacaactggtaatatatagatga

SEQ ID NO: 20122 - DNA, 40 bp, Artificial Sequence
  PCR primer for ORF amplification
aattacatgactcgagctaaatatcagctggagccagccg

SEQ ID NO: 20123 - DNA, 40 bp, Artificial Sequence
  PCR primer for ORF amplification
aattacatgactcgagttatttccattgctttttcaccaa

SEQ ID NO: 20124 - DNA, 40 bp, Artificial Sequence
  PCR primer for ORF amplification
aattacatgactcgagctacttaaatggaatgcaacaaca

SEQ ID NO: 20125 - DNA, 40 bp, Artificial Sequence
  PCR primer for ORF amplification
aattacatgactcgagttaaaaaacgtcacaacataggtt

SEQ ID NO: 20126 - DNA, 40 bp, Artificial Sequence
  PCR primer for ORF amplification
aattacatgactcgagttagtatacggtgtaaaatagtat

SEQ ID NO: 20127 - DNA, 40 bp, Artificial Sequence
  PCR primer for ORF amplification
aattacatgactcgagtcaccttttataaatcttgcatag

SEQ ID NO: 20128 - DNA, 40 bp, Artificial Sequence
  PCR primer for ORF amplification
aattacatgactcgagttacagagtccagggcacaagggt

SEQ ID NO: 20129 - DNA, 40 bp, Artificial Sequence
  PCR primer for ORF amplification
aattacatgactcgagttactgcacgtatttcgattgagc

SEQ ID NO: 20130 - DNA, 40 bp, Artificial Sequence
  PCR primer for ORF amplification
aattacatgactcgagttacaaaacaaaagggccttgaaa

SEQ ID NO: 20131 - DNA, 40 bp, Artificial Sequence
  PCR primer for ORF amplification
aattacatgactcgagctaagttttaacgaaggaatctaa

SEQ ID NO: 20132 - DNA, 40 bp, Artificial Sequence
  PCR primer for ORF amplification
aattacatgactcgagctagctatagaaacgcgtagcacc

SEQ ID NO: 20133 - DNA, 40 bp, Artificial Sequence
  PCR primer for ORF amplification
aattacatgactcgagctagctaaagatcgtacaaacaag

SEQ ID NO: 20134 - DNA, 40 bp, Artificial Sequence
  PCR primer for ORF amplification
aattacatgactcgagttagaaactgatcttggtgctcac

SEQ ID NO: 20135 - DNA, 40 bp, Artificial Sequence
  PCR primer for ORF amplification
aattacatgactcgagttaggtgtggcagccgtacatatg

SEQ ID NO: 20136 - DNA, 40 bp, Artificial Sequence
  PCR primer for ORF amplification
aattacatgactcgagctacaacctcatttctacattaaa

SEQ ID NO: 20137 - DNA, 40 bp, Artificial Sequence
  PCR primer for ORF amplification
aattacatgactcgagttagcctgtcctatcgctaataaa

SEQ ID NO: 20138 - DNA, 40 bp, Artificial Sequence
  PCR primer for ORF amplification
aattacatgactcgagttatatataaacgttacagggcgt

SEQ ID NO: 20139 - DNA, 40 bp, Artificial Sequence
  PCR primer for ORF amplification
aattacatgactcgagttagaaagagtagtattcagccaa

SEQ ID NO: 20140 - DNA, 40 bp, Artificial Sequence
  PCR primer for ORF amplification
aattacatgactcgagttagtactgatgaagtgagagatg

SEQ ID NO: 20141 - DNA, 40 bp, Artificial Sequence
  PCR primer for ORF amplification
aattacatgactcgagttaatcttgtaggacaatgtacaa

SEQ ID NO: 20142 - DNA, 40 bp, Artificial Sequence
  PCR primer for ORF amplification
aattacatgactcgagtcagtatatttcgtcatttcggta

SEQ ID NO: 20143 - DNA, 40 bp, Artificial Sequence
  PCR primer for ORF amplification
aattacatgactcgagtcagaaagccgggtaaggtgtgac

SEQ ID NO: 20144 - DNA, 40 bp, Artificial Sequence
  PCR primer for ORF amplification
aattacatgactcgagctaagtctcagaagtgatacaatt

SEQ ID NO: 20145 - DNA, 40 bp, Artificial Sequence
  PCR primer for ORF amplification
aattacatgactcgagttatctgaatttgttgaaaccaat

SEQ ID NO: 20146 - DNA, 40 bp, Artificial Sequence
  PCR primer for ORF amplification
aattacatgactcgagttatctgtacttgtggaaaccaat

SEQ ID NO: 20147 - DNA, 40 bp, Artificial Sequence
  PCR primer for ORF amplification
aattacatgactcgagtcaacaatcatttttatgtttgta

SEQ ID NO: 20148 - DNA, 40 bp, Artificial Sequence
  PCR primer for ORF amplification
aattacatgactcgagctaaattaattcatttacaatcag

SEQ ID NO: 20149 - DNA, 40 bp, Artificial Sequence
  PCR primer for ORF amplification
aattacatgactcgagtcaaaatgcaggggcggggtgacc

SEQ ID NO: 20150 - DNA, 40 bp, Artificial Sequence
  PCR primer for ORF amplification
aattacatgactcgagttatgaggggcacttattgttgta

SEQ ID NO: 20151 - DNA, 40 bp, Artificial Sequence
  PCR primer for ORF amplification
aattacatgactcgagctattggcctggtaccaaaccaaa

SEQ ID NO: 20152 - DNA, 40 bp, Artificial Sequence
  PCR primer for ORF amplification
aattacatgactcgagttatgttactagtatattatcata

SEQ ID NO: 20153 - DNA, 40 bp, Artificial Sequence
  PCR primer for ORF amplification
aattacatgactcgagttaaatcaaaaaggccaaagcacc

SEQ ID NO: 20154 - DNA, 40 bp, Artificial Sequence
  PCR primer for ORF amplification
aattacatgactcgagtcagttctcttgctttttcctctc

SEQ ID NO: 20155 - DNA, 40 bp, Artificial Sequence
  PCR primer for ORF amplification
aattacatgactcgagttatttcttggcagcagccaaagc

SEQ ID NO: 20156 - DNA, 40 bp, Artificial Sequence
  PCR primer for ORF amplification
aattacatgactcgagttatttatcattttttttcttact

SEQ ID NO: 20157 - DNA, 40 bp, Artificial Sequence
  PCR primer for ORF amplification
aattacatgactcgagtcaatcaacttccacaaactttcc

SEQ ID NO: 20158 - DNA, 40 bp, Artificial Sequence
  PCR primer for ORF amplification
aattacatgactcgagttaaacacttggtaacggagacag

SEQ ID NO: 20159 - DNA, 40 bp, Artificial Sequence
  PCR primer for ORF amplification
aattacatgactcgagctatgccttcttggctttgatacc

SEQ ID NO: 20160 - DNA, 40 bp, Artificial Sequence
  PCR primer for ORF amplification
aattacatgactcgagctatgcattaaatatggctcggtc

SEQ ID NO: 20161 - DNA, 40 bp, Artificial Sequence
  PCR primer for ORF amplification
aattacatgactcgagttaatggtggatgcatctaataat

SEQ ID NO: 20162 - DNA, 40 bp, Artificial Sequence
  PCR primer for ORF amplification
aattacatgactcgagtcatttcccagagcagcatgactt

SEQ ID NO: 20163 - DNA, 40 bp, Artificial Sequence
  PCR primer for ORF amplification
aattacatgactcgagctaaatcaaaaaggccaaagcacc

SEQ ID NO: 20164 - DNA, 40 bp, Artificial Sequence
  PCR primer for ORF amplification
aattacatgactcgagctatagattggtatgaaaaatttt

SEQ ID NO: 20165 - DNA, 40 bp, Artificial Sequence
  PCR primer for ORF amplification
aattacatgactcgagttataattgtggggccaacatgtc

SEQ ID NO: 20166 - DNA, 40 bp, Artificial Sequence
  PCR primer for ORF amplification
aattacatgactcgagtcagaggctcattcgattgtgtgt

SEQ ID NO: 20167 - DNA, 40 bp, Artificial Sequence
  PCR primer for ORF amplification
aattacatgactcgagtcagttcgcactgttcgtggttga

SEQ ID NO: 20168 - DNA, 40 bp, Artificial Sequence
  PCR primer for ORF amplification
aattacatgactcgagctaccttctgttcataatacagtt

SEQ ID NO: 20169 - DNA, 40 bp, Artificial Sequence
  PCR primer for ORF amplification
aattacatgactcgagctattttgttattggagtgggttc

SEQ ID NO: 20170 - DNA, 40 bp, Artificial Sequence
  PCR primer for ORF amplification
aattacatgactcgagttagttaatattatgaatgaatct

SEQ ID NO: 20171 - DNA, 40 bp, Artificial Sequence
  PCR primer for ORF amplification
aattacatgactcgagctatcttagcttgagcagcttttt

SEQ ID NO: 20172 - DNA, 40 bp, Artificial Sequence
  PCR primer for ORF amplification
aattacatgactcgagtcagctacgtctgaccgaatactt

SEQ ID NO: 20173 - DNA, 40 bp, Artificial Sequence
  PCR primer for ORF amplification
aattacatgactcgagttatgggtaaatggcacagggtat

SEQ ID NO: 20174 - DNA, 40 bp, Artificial Sequence
  PCR primer for ORF amplification
aattacatgactcgagttagaggcaagatatggttctgta

SEQ ID NO: 20175 - DNA, 40 bp, Artificial Sequence
  PCR primer for ORF amplification
aattacatgactcgagctagtgcgtagtgtgagtgccact

SEQ ID NO: 20176 - DNA, 40 bp, Artificial Sequence
  PCR primer for ORF amplification
aattacatgactcgagtcacatcaacaggctttcggacga

SEQ ID NO: 20177 - DNA, 40 bp, Artificial Sequence
  PCR primer for ORF amplification
aattacatgactcgagttaataatataatctcatataaac

SEQ ID NO: 20178 - DNA, 40 bp, Artificial Sequence
  PCR primer for ORF amplification
aattacatgactcgagttaaagagaaaaaaaaataaatag

SEQ ID NO: 20179 - DNA, 40 bp, Artificial Sequence
  PCR primer for ORF amplification
aattacatgactcgagttatttcttaccagattttttgat

SEQ ID NO: 20180 - DNA, 40 bp, Artificial Sequence
  PCR primer for ORF amplification
aattacatgactcgagtcataggatatagctgattagttg

SEQ ID NO: 20181 - DNA, 40 bp, Artificial Sequence
  PCR primer for ORF amplification
aattacatgactcgagctaattggcggcatactctttctt

SEQ ID NO: 20182 - DNA, 40 bp, Artificial Sequence
  PCR primer for ORF amplification
aattacatgactcgagttaaaaaattagtggaagctgata

SEQ ID NO: 20183 - DNA, 40 bp, Artificial Sequence
  PCR primer for ORF amplification
aattacatgactcgagttagaataagaaagcgacaccggc

SEQ ID NO: 20184 - DNA, 40 bp, Artificial Sequence
  PCR primer for ORF amplification
aattacatgactcgagtcagtcatccatcagcggaaaaaa

SEQ ID NO: 20185 - DNA, 40 bp, Artificial Sequence
  PCR primer for ORF amplification
aattacatgactcgagtcaaatgaaaatctcgtcgaaatg

SEQ ID NO: 20186 - DNA, 40 bp, Artificial Sequence
  PCR primer for ORF amplification
aattacatgactcgagtcatgcttttcttgccttactaaa

SEQ ID NO: 20187 - DNA, 40 bp, Artificial Sequence
  PCR primer for ORF amplification
aattacatgactcgagctaaatttgatataaaactaaagg

SEQ ID NO: 20188 - DNA, 40 bp, Artificial Sequence
  PCR primer for ORF amplification
aattacatgactcgagctaattccaattcgaggcatatcc

SEQ ID NO: 20189 - DNA, 40 bp, Artificial Sequence
  PCR primer for ORF amplification
aattacatgactcgagctaaaacctggtgtatgatcgttg

SEQ ID NO: 20190 - DNA, 40 bp, Artificial Sequence
  PCR primer for ORF amplification
aattacatgactcgagctaacgcaaacgacgagcttcacg

SEQ ID NO: 20191 - DNA, 40 bp, Artificial Sequence
  PCR primer for ORF amplification
aattacatgactcgagttaacgcaaacgacgagcttcacg

SEQ ID NO: 20192 - DNA, 40 bp, Artificial Sequence
  PCR primer for ORF amplification
aattacatgactcgagttacaacagagacaaagagttttt

SEQ ID NO: 20193 - DNA, 40 bp, Artificial Sequence
  PCR primer for ORF amplification
aattacatgactcgagttaatatggcgcacacaccgtgtt

SEQ ID NO: 20194 - DNA, 40 bp, Artificial Sequence
  PCR primer for ORF amplification
aattacatgactcgagctactccttcttatgccccgcccc

SEQ ID NO: 20195 - DNA, 40 bp, Artificial Sequence
  PCR primer for ORF amplification
aattacatgactcgagttagttggaagtattcttaccaat

SEQ ID NO: 20196 - DNA, 40 bp, Artificial Sequence
  PCR primer for ORF amplification
aattacatgactcgagttattcatctttactacttgcgaa

SEQ ID NO: 20197 - DNA, 40 bp, Artificial Sequence
  PCR primer for ORF amplification
aattacatgactcgagttaaatctttttacttaaagcatc

SEQ ID NO: 20198 - DNA, 40 bp, Artificial Sequence
  PCR primer for ORF amplification
aattacatgactcgagttataacccacacaccgcatttag

SEQ ID NO: 20199 - DNA, 40 bp, Artificial Sequence
  PCR primer for ORF amplification
aattacatgactcgagctatcggtgatagaaatctttctt

SEQ ID NO: 20200 - DNA, 40 bp, Artificial Sequence
  PCR primer for ORF amplification
aattacatgactcgagttatcttctcgtcttttcggcttt

SEQ ID NO: 20201 - DNA, 40 bp, Artificial Sequence
  PCR primer for ORF amplification
aattacatgactcgagttacgcatcttgcttttccgaatg

SEQ ID NO: 20202 - DNA, 40 bp, Artificial Sequence
  PCR primer for ORF amplification
aattacatgactcgagttattgcgtttttccaagcatctg

SEQ ID NO: 20203 - DNA, 40 bp, Artificial Sequence
  PCR primer for ORF amplification
aattacatgactcgagctatttttggctggaactttttgc

SEQ ID NO: 20204 - DNA, 40 bp, Artificial Sequence
  PCR primer for ORF amplification
aattacatgactcgagctaatttgcacttggaacttcgaa

SEQ ID NO: 20205 - DNA, 40 bp, Artificial Sequence
  PCR primer for ORF amplification
aattacatgactcgagctaacatttttcacaattgcattt

SEQ ID NO: 20206 - DNA, 40 bp, Artificial Sequence
  PCR primer for ORF amplification
aattacatgactcgagttacaaatgagtcttctgctttat

SEQ ID NO: 20207 - DNA, 40 bp, Artificial Sequence
  PCR primer for ORF amplification
aattacatgactcgagctactcgaagttaggtcgcccaac

SEQ ID NO: 20208 - DNA, 40 bp, Artificial Sequence
  PCR primer for ORF amplification
aattacatgactcgagtcacaaaggataaatctcttggtt

SEQ ID NO: 20209 - DNA, 40 bp, Artificial Sequence
  PCR primer for ORF amplification
aattacatgactcgagctaaataagtgttaactttaggga

SEQ ID NO: 20210 - DNA, 40 bp, Artificial Sequence
  PCR primer for ORF amplification
aattacatgactcgagttaatctcttttttctaatgggtt

SEQ ID NO: 20211 - DNA, 40 bp, Artificial Sequence
  PCR primer for ORF amplification
aattacatgactcgagtcacttggctgtacgcaagaaatc

SEQ ID NO: 20212 - DNA, 40 bp, Artificial Sequence
  PCR primer for ORF amplification
aattacatgactcgagttagtgtatatttgctagaaagaa

SEQ ID NO: 20213 - DNA, 40 bp, Artificial Sequence
  PCR primer for ORF amplification
aattacatgactcgagctaactcccttggggtttactttc

SEQ ID NO: 20214 - DNA, 40 bp, Artificial Sequence
  PCR primer for ORF amplification
aattacatgactcgagttactcggtaggaggtgcagtagg

SEQ ID NO: 20215 - DNA, 40 bp, Artificial Sequence
  PCR primer for ORF amplification
aattacatgactcgagtcatctagcttcaaattgaaccaa

SEQ ID NO: 20216 - DNA, 40 bp, Artificial Sequence
  PCR primer for ORF amplification
aattacatgactcgagttacgaccttaatggctttacaat

SEQ ID NO: 20217 - DNA, 40 bp, Artificial Sequence
  PCR primer for ORF amplification
aattacatgactcgagtcagataagaaagactgagcctat

SEQ ID NO: 20218 - DNA, 40 bp, Artificial Sequence
  PCR primer for ORF amplification
aattacatgactcgagtcaaaaattagcaacgcctacaat

SEQ ID NO: 20219 - DNA, 40 bp, Artificial Sequence
  PCR primer for ORF amplification
aattacatgactcgagttaaagaggtggcttcttgttatt

SEQ ID NO: 20220 - DNA, 40 bp, Artificial Sequence
  PCR primer for ORF amplification
aattacatgactcgagttactgattttcttcttcatccat

SEQ ID NO: 20221 - DNA, 40 bp, Artificial Sequence
  PCR primer for ORF amplification
aattacatgactcgagttatggtttgcttcgtgaagataa

SEQ ID NO: 20222 - DNA, 40 bp, Artificial Sequence
  PCR primer for ORF amplification
aattacatgactcgagtcagctgttaaattgactgatggc

SEQ ID NO: 20223 - DNA, 40 bp, Artificial Sequence
  PCR primer for ORF amplification
aattacatgactcgagttaaatttttttctcattttggta

SEQ ID NO: 20224 - DNA, 40 bp, Artificial Sequence
  PCR primer for ORF amplification
aattacatgactcgagctacaggtaatacagctccaaatt

SEQ ID NO: 20225 - DNA, 40 bp, Artificial Sequence
  PCR primer for ORF amplification
aattacatgactcgagttatccggaagttttcgcggaccc

SEQ ID NO: 20226 - DNA, 40 bp, Artificial Sequence
  PCR primer for ORF amplification
aattacatgactcgagtcacaattgtttgccagatctaac

SEQ ID NO: 20227 - DNA, 40 bp, Artificial Sequence
  PCR primer for ORF amplification
aattacatgactcgagtcacttttttctcgagaagaagtt

SEQ ID NO: 20228 - DNA, 40 bp, Artificial Sequence
  PCR primer for ORF amplification
aattacatgactcgagctacaatatccgctgtcttggaaa

SEQ ID NO: 20229 - DNA, 40 bp, Artificial Sequence
  PCR primer for ORF amplification
aattacatgactcgagctacaactttggcgcgtgagccaa

SEQ ID NO: 20230 - DNA, 40 bp, Artificial Sequence
  PCR primer for ORF amplification
aattacatgactcgagttaactattggtatatgtgtccgt

SEQ ID NO: 20231 - DNA, 40 bp, Artificial Sequence
  PCR primer for ORF amplification
aattacatgactcgagctaatcgtttgacatagaatgcca

SEQ ID NO: 20232 - DNA, 40 bp, Artificial Sequence
  PCR primer for ORF amplification
aattacatgactcgagttaaacttttttctttttatcgct

SEQ ID NO: 20233 - DNA, 40 bp, Artificial Sequence
  PCR primer for ORF amplification
aattacatgactcgagttattcaagaaattcaactggttc

SEQ ID NO: 20234 - DNA, 40 bp, Artificial Sequence
  PCR primer for ORF amplification
aattacatgactcgagtcaatttgtatgaacttctttgtc

SEQ ID NO: 20235 - DNA, 40 bp, Artificial Sequence
  PCR primer for ORF amplification
aattacatgactcgagtcagttatcgcataccaattctaa

SEQ ID NO: 20236 - DNA, 40 bp, Artificial Sequence
  PCR primer for ORF amplification
aattacatgactcgagctaacagtatacgactcccaacac

SEQ ID NO: 20237 - DNA, 40 bp, Artificial Sequence
  PCR primer for ORF amplification
aattacatgactcgagttattgagcgctggtatatacagc

SEQ ID NO: 20238 - DNA, 40 bp, Artificial Sequence
  PCR primer for ORF amplification
aattacatgactcgagtcaccgactcattttgttaagctt

SEQ ID NO: 20239 - DNA, 40 bp, Artificial Sequence
  PCR primer for ORF amplification
aattacatgactcgagttaagttttcttgaaagttaatgt

SEQ ID NO: 20240 - DNA, 40 bp, Artificial Sequence
  PCR primer for ORF amplification
aattacatgactcgagttatacaccgaataataataagaa

SEQ ID NO: 20241 - DNA, 40 bp, Artificial Sequence
  PCR primer for ORF amplification
aattacatgactcgagttaacaataagcttctgtacgagg

SEQ ID NO: 20242 - DNA, 40 bp, Artificial Sequence
  PCR primer for ORF amplification
aattacatgactcgagttactccgtctcgttaaagaatat

SEQ ID NO: 20243 - DNA, 40 bp, Artificial Sequence
  PCR primer for ORF amplification
aattacatgactcgagttaccatacaagtttgccgtccaa

SEQ ID NO: 20244 - DNA, 40 bp, Artificial Sequence
  PCR primer for ORF amplification
aattacatgactcgagtcagtcttcctttttattaccatc

SEQ ID NO: 20245 - DNA, 40 bp, Artificial Sequence
  PCR primer for ORF amplification
aattacatgactcgagttatatggcatctagagcctctag

SEQ ID NO: 20246 - DNA, 40 bp, Artificial Sequence
  PCR primer for ORF amplification
aattacatgactcgagtcacatcaatgtatagtaactacc

SEQ ID NO: 20247 - DNA, 40 bp, Artificial Sequence
  PCR primer for ORF amplification
aattacatgactcgagttacaattttcgagattcttttga

SEQ ID NO: 20248 - DNA, 40 bp, Artificial Sequence
  PCR primer for ORF amplification
aattacatgactcgagtcacagtttaccaaatttttccgt

SEQ ID NO: 20249 - DNA, 40 bp, Artificial Sequence
  PCR primer for ORF amplification
aattacatgactcgagttataatctgttaaccttcaaagt

SEQ ID NO: 20250 - DNA, 40 bp, Artificial Sequence
  PCR primer for ORF amplification
aattacatgactcgagctactttttcctttcatttttcaa

SEQ ID NO: 20251 - DNA, 40 bp, Artificial Sequence
  PCR primer for ORF amplification
aattacatgactcgagttaaaaagcacctgactttttcaa

SEQ ID NO: 20252 - DNA, 40 bp, Artificial Sequence
  PCR primer for ORF amplification
aattacatgactcgagtcagagacctttggttactggcaa

SEQ ID NO: 20253 - DNA, 40 bp, Artificial Sequence
  PCR primer for ORF amplification
aattacatgactcgagctagaataagaaggcaacaccggc

SEQ ID NO: 20254 - DNA, 40 bp, Artificial Sequence
  PCR primer for ORF amplification
aattacatgactcgagtcatgctaaactaccatagttatc

SEQ ID NO: 20255 - DNA, 40 bp, Artificial Sequence
  PCR primer for ORF amplification
aattacatgactcgagtcaatgtatattcgtcagttcagg

SEQ ID NO: 20256 - DNA, 40 bp, Artificial Sequence
  PCR primer for ORF amplification
aattacatgactcgagttattttttcatgttttcgtaagt

SEQ ID NO: 20257 - DNA, 40 bp, Artificial Sequence
  PCR primer for ORF amplification
aattacatgactcgagtcatttcctttggcatctattgtt

SEQ ID NO: 20258 - DNA, 40 bp, Artificial Sequence
  PCR primer for ORF amplification
aattacatgactcgagtcaaaggaagcaatactttagtat

SEQ ID NO: 20259 - DNA, 40 bp, Artificial Sequence
  PCR primer for ORF amplification
aattacatgactcgagctaccgtgaagtatatgtaagggt

SEQ ID NO: 20260 - DNA, 40 bp, Artificial Sequence
  PCR primer for ORF amplification
aattacatgactcgagttaaacaataacgtatctgattgg

SEQ ID NO: 20261 - DNA, 40 bp, Artificial Sequence
  PCR primer for ORF amplification
aattacatgactcgagttattcgtacccggattcataatt

SEQ ID NO: 20262 - DNA, 40 bp, Artificial Sequence
  PCR primer for ORF amplification
aattacatgactcgagttacatatccatcagaagaagccc

SEQ ID NO: 20263 - DNA, 40 bp, Artificial Sequence
  PCR primer for ORF amplification
aattacatgactcgagttaggcagcagcggcaataggctc

SEQ ID NO: 20264 - DNA, 40 bp, Artificial Sequence
  PCR primer for ORF amplification
aattacatgactcgagttaaaataacttaccggcaacttt

SEQ ID NO: 20265 - DNA, 40 bp, Artificial Sequence
  PCR primer for ORF amplification
aattacatgactcgagttagtctgagttgatatcacctgc

SEQ ID NO: 20266 - DNA, 40 bp, Artificial Sequence
  PCR primer for ORF amplification
aattacatgactcgagtcattccttttggacgttttcaaa

SEQ ID NO: 20267 - DNA, 40 bp, Artificial Sequence
  PCR primer for ORF amplification
aattacatgactcgagttatttcgtaaagttgaaagataa

SEQ ID NO: 20268 - DNA, 40 bp, Artificial Sequence
  PCR primer for ORF amplification
aattacatgactcgagctatatctgttggtttgtcaagtt

SEQ ID NO: 20269 - DNA, 40 bp, Artificial Sequence
  PCR primer for ORF amplification
aattacatgactcgagttaaataccggtgcctaggacgaa

SEQ ID NO: 20270 - DNA, 40 bp, Artificial Sequence
  PCR primer for ORF amplification
aattacatgactcgagttactggtctcctttcaatctgtt

SEQ ID NO: 20271 - DNA, 40 bp, Artificial Sequence
  PCR primer for ORF amplification
aattacatgactcgagtcatttagagttcttcttaccttt

SEQ ID NO: 20272 - DNA, 40 bp, Artificial Sequence
  PCR primer for ORF amplification
aattacatgactcgagtcatgccttcttcttggcttcgta

SEQ ID NO: 20273 - DNA, 40 bp, Artificial Sequence
  PCR primer for ORF amplification
aattacatgactcgagttatttttccaacacattactgga

SEQ ID NO: 20274 - DNA, 40 bp, Artificial Sequence
  PCR primer for ORF amplification
aattacatgactcgagtcaagcctggccggccaaatccaa

SEQ ID NO: 20275 - DNA, 40 bp, Artificial Sequence
  PCR primer for ORF amplification
aattacatgactcgagttatttggtcatcgagtcaatttt

SEQ ID NO: 20276 - DNA, 40 bp, Artificial Sequence
  PCR primer for ORF amplification
aattacatgactcgagttagaagccatctaatacactata

SEQ ID NO: 20277 - DNA, 40 bp, Artificial Sequence
  PCR primer for ORF amplification
aattacatgactcgagttagatgtggtattgttgcaaatc

SEQ ID NO: 20278 - DNA, 40 bp, Artificial Sequence
  PCR primer for ORF amplification
aattacatgactcgagttagttcggcagctccctgatgta

SEQ ID NO: 20279 - DNA, 40 bp, Artificial Sequence
  PCR primer for ORF amplification
aattacatgactcgagttaatcttttttaaagcggtctcc

SEQ ID NO: 20280 - DNA, 40 bp, Artificial Sequence
  PCR primer for ORF amplification
aattacatgactcgagtcatttgtcaacttcttttagttt

SEQ ID NO: 20281 - DNA, 40 bp, Artificial Sequence
  PCR primer for ORF amplification
aattacatgactcgagtcagtcgatggttctcttctccac

SEQ ID NO: 20282 - DNA, 40 bp, Artificial Sequence
  PCR primer for ORF amplification
aattacatgactcgagctatattttttgttcactgatata

SEQ ID NO: 20283 - DNA, 40 bp, Artificial Sequence
  PCR primer for ORF amplification
aattacatgactcgagtcactttgaaaggttattaatttt

SEQ ID NO: 20284 - DNA, 40 bp, Artificial Sequence
  PCR primer for ORF amplification
aattacatgactcgagtcaaaaaacatactgtgtgtttat

SEQ ID NO: 20285 - DNA, 40 bp, Artificial Sequence
  PCR primer for ORF amplification
aattacatgactcgagttaattataaaaactctgaagtaa

SEQ ID NO: 20286 - DNA, 40 bp, Artificial Sequence
  PCR primer for ORF amplification
aattacatgactcgagttatcggcccaagccttgtcccaa

SEQ ID NO: 20287 - DNA, 40 bp, Artificial Sequence
  PCR primer for ORF amplification
aattacatgactcgagttatacaaagtgttcaatgaacct

SEQ ID NO: 20288 - DNA, 40 bp, Artificial Sequence
  PCR primer for ORF amplification
aattacatgactcgagtcagatttggctacctgcatttcc

SEQ ID NO: 20289 - DNA, 40 bp, Artificial Sequence
  PCR primer for ORF amplification
aattacatgactcgagctaagaggagtacttggcaatcag

SEQ ID NO: 20290 - DNA, 40 bp, Artificial Sequence
  PCR primer for ORF amplification
aattacatgactcgagttatacttttacgtgctccgatac

SEQ ID NO: 20291 - DNA, 40 bp, Artificial Sequence
  PCR primer for ORF amplification
aattacatgactcgagttaacgggtgttttgcaacccgtt

SEQ ID NO: 20292 - DNA, 40 bp, Artificial Sequence
  PCR primer for ORF amplification
aattacatgactcgagctaaacaatattagccatcaattc

SEQ ID NO: 20293 - DNA, 40 bp, Artificial Sequence
  PCR primer for ORF amplification
aattacatgactcgagttatataatgtgtgtaaatttcgt

SEQ ID NO: 20294 - DNA, 40 bp, Artificial Sequence
  PCR primer for ORF amplification
aattacatgactcgagttaagagtggaaaaaaataatagt

SEQ ID NO: 20295 - DNA, 40 bp, Artificial Sequence
  PCR primer for ORF amplification
aattacatgactcgagtcactgattttcccgtttgtatct

SEQ ID NO: 20296 - DNA, 40 bp, Artificial Sequence
  PCR primer for ORF amplification
aattacatgactcgagttatatctccactgcgccatcgtc

SEQ ID NO: 20297 - DNA, 40 bp, Artificial Sequence
  PCR primer for ORF amplification
aattacatgactcgagtcattgactatccagaaaagcctg

SEQ ID NO: 20298 - DNA, 40 bp, Artificial Sequence
  PCR primer for ORF amplification
aattacatgactcgagttattcttgagtaactctttcctg

SEQ ID NO: 20299 - DNA, 40 bp, Artificial Sequence
  PCR primer for ORF amplification
aattacatgactcgagttactgtcgagggttccagcatga

SEQ ID NO: 20300 - DNA, 40 bp, Artificial Sequence
  PCR primer for ORF amplification
aattacatgactcgagtcagttggctttcgtatcctgcct

SEQ ID NO: 20301 - DNA, 40 bp, Artificial Sequence
  PCR primer for ORF amplification
aattacatgactcgagtcatttgttcttggtttgagtata

SEQ ID NO: 20302 - DNA, 40 bp, Artificial Sequence
  PCR primer for ORF amplification
aattacatgactcgagttataacaacatagcagcagcagc

SEQ ID NO: 20303 - DNA, 40 bp, Artificial Sequence
  PCR primer for ORF amplification
aattacatgactcgagttatttcatttttcttttaccctt

SEQ ID NO: 20304 - DNA, 40 bp, Artificial Sequence
  PCR primer for ORF amplification
aattacatgactcgagtcaccagccttgaattcggctctg

SEQ ID NO: 20305 - DNA, 40 bp, Artificial Sequence
  PCR primer for ORF amplification
aattacatgactcgagttacaacgcctccgtaggggtctt

SEQ ID NO: 20306 - DNA, 40 bp, Artificial Sequence
  PCR primer for ORF amplification
aattacatgactcgagtcagtatctttttcccctgcctcc

SEQ ID NO: 20307 - DNA, 40 bp, Artificial Sequence
  PCR primer for ORF amplification
aattacatgactcgagctaagccaaagtggcgttatataa

SEQ ID NO: 20308 - DNA, 40 bp, Artificial Sequence
  PCR primer for ORF amplification
aattacatgactcgagctaaaacttaccggctgcgttaaa

SEQ ID NO: 20309 - DNA, 40 bp, Artificial Sequence
  PCR primer for ORF amplification
aattacatgactcgagttaataaacaccgtcatctggcct

SEQ ID NO: 20310 - DNA, 40 bp, Artificial Sequence
  PCR primer for ORF amplification
aattacatgactcgagtcagccttgacgctgtttgtgttt

SEQ ID NO: 20311 - DNA, 40 bp, Artificial Sequence
  PCR primer for ORF amplification
aattacatgactcgagctatttcctagcgaaatacgtcga

SEQ ID NO: 20312 - DNA, 40 bp, Artificial Sequence
  PCR primer for ORF amplification
aattacatgactcgagctatggttcgctattcaatattag

SEQ ID NO: 20313 - DNA, 40 bp, Artificial Sequence
  PCR primer for ORF amplification
aattacatgactcgagttacttcgttttcgattgagataa

SEQ ID NO: 20314 - DNA, 40 bp, Artificial Sequence
  PCR primer for ORF amplification
aattacatgactcgagttagtgttttcttccttgcaatgg

SEQ ID NO: 20315 - DNA, 40 bp, Artificial Sequence
  PCR primer for ORF amplification
aattacatgactcgagttatttagaattgctacccaaaga

SEQ ID NO: 20316 - DNA, 40 bp, Artificial Sequence
  PCR primer for ORF amplification
aattacatgactcgagctatgctagaacacgcatttgacg

SEQ ID NO: 20317 - DNA, 40 bp, Artificial Sequence
  PCR primer for ORF amplification
aattacatgactcgagttaaacattaactctttccagctc

SEQ ID NO: 20318 - DNA, 40 bp, Artificial Sequence
  PCR primer for ORF amplification
aattacatgactcgagtcagttgggctgcttttgtcgtaa

SEQ ID NO: 20319 - DNA, 40 bp, Artificial Sequence
  PCR primer for ORF amplification
aattacatgactcgagtcagtccgctgatgttatcaatgt

SEQ ID NO: 20320 - DNA, 40 bp, Artificial Sequence
  PCR primer for ORF amplification
aattacatgactcgagctagtcatactggtcgacattaat

SEQ ID NO: 20321 - DNA, 40 bp, Artificial Sequence
  PCR primer for ORF amplification
aattacatgactcgagttacatgattgaagagaacatcaa

SEQ ID NO: 20322 - DNA, 40 bp, Artificial Sequence
  PCR primer for ORF amplification
aattacatgactcgagttaatcatggggtttaccgttgat

SEQ ID NO: 20323 - DNA, 40 bp, Artificial Sequence
  PCR primer for ORF amplification
aattacatgactcgagtcattctatacggcgtccttcctg

SEQ ID NO: 20324 - DNA, 40 bp, Artificial Sequence
  PCR primer for ORF amplification
aattacatgactcgagttagagcacattaaataatatgta

SEQ ID NO: 20325 - DNA, 40 bp, Artificial Sequence
  PCR primer for ORF amplification
aattacatgactcgagttatgttgaagcttccttcaggga

SEQ ID NO: 20326 - DNA, 40 bp, Artificial Sequence
  PCR primer for ORF amplification
aattacatgactcgagttaaacagaagaggaaataatggt

SEQ ID NO: 20327 - DNA, 40 bp, Artificial Sequence
  PCR primer for ORF amplification
aattacatgactcgagttataaaataaacacaactgtaag

SEQ ID NO: 20328 - DNA, 40 bp, Artificial Sequence
  PCR primer for ORF amplification
aattacatgactcgagctaaaccttcgaggatctgaggcc

SEQ ID NO: 20329 - DNA, 40 bp, Artificial Sequence
  PCR primer for ORF amplification
aattacatgactcgagtcaactgtcccctggtgtaagctt

SEQ ID NO: 20330 - DNA, 40 bp, Artificial Sequence
  PCR primer for ORF amplification
aattacatgactcgagctaattggttattcctacaggagg

SEQ ID NO: 20331 - DNA, 40 bp, Artificial Sequence
  PCR primer for ORF amplification
aattacatgactcgagttaatgatcttcttgtccatgaga

SEQ ID NO: 20332 - DNA, 40 bp, Artificial Sequence
  PCR primer for ORF amplification
aattacatgactcgagtcaattaggtttatcttctggtgg

SEQ ID NO: 20333 - DNA, 40 bp, Artificial Sequence
  PCR primer for ORF amplification
aattacatgactcgagctatttattatcggtggcgtcttt

SEQ ID NO: 20334 - DNA, 40 bp, Artificial Sequence
  PCR primer for ORF amplification
aattacatgactcgagctataactttggctcagaacagat

SEQ ID NO: 20335 - DNA, 40 bp, Artificial Sequence
  PCR primer for ORF amplification
aattacatgactcgagtcagtattcttcagcattagacat

SEQ ID NO: 20336 - DNA, 40 bp, Artificial Sequence
  PCR primer for ORF amplification
aattacatgactcgagtcaacgtctagcacccctactcaa

SEQ ID NO: 20337 - DNA, 40 bp, Artificial Sequence
  PCR primer for ORF amplification
aattacatgactcgagttatgtattatcgttgaaggatag

SEQ ID NO: 20338 - DNA, 40 bp, Artificial Sequence
  PCR primer for ORF amplification
aattacatgactcgagtcaagcacgtgtagcattgtacaa

SEQ ID NO: 20339 - DNA, 40 bp, Artificial Sequence
  PCR primer for ORF amplification
aattacatgactcgagttaaccaccatgtaatgttgaagt

SEQ ID NO: 20340 - DNA, 40 bp, Artificial Sequence
  PCR primer for ORF amplification
aattacatgactcgagtcacactcgtggggcccacacgat

SEQ ID NO: 20341 - DNA, 40 bp, Artificial Sequence
  PCR primer for ORF amplification
aattacatgactcgagctatatactcaaatagtccgccgc

SEQ ID NO: 20342 - DNA, 40 bp, Artificial Sequence
  PCR primer for ORF amplification
aattacatgactcgagttaatctagttctacaaacctact

SEQ ID NO: 20343 - DNA, 40 bp, Artificial Sequence
  PCR primer for ORF amplification
aattacatgactcgagctaaagtattaacatgtaacaact

SEQ ID NO: 20344 - DNA, 40 bp, Artificial Sequence
  PCR primer for ORF amplification
aattacatgactcgagctaatgattacgattaaccatcaa

SEQ ID NO: 20345 - DNA, 40 bp, Artificial Sequence
  PCR primer for ORF amplification
aattacatgactcgagtcaaagtactatatctactgcctt

SEQ ID NO: 20346 - DNA, 40 bp, Artificial Sequence
  PCR primer for ORF amplification
aattacatgactcgagttataccataaacggtatagtaat

SEQ ID NO: 20347 - DNA, 40 bp, Artificial Sequence
  PCR primer for ORF amplification
aattacatgactcgagttatttgcgatcgtcccatcgctt

SEQ ID NO: 20348 - DNA, 40 bp, Artificial Sequence
  PCR primer for ORF amplification
aattacatgactcgagctaggaattatcctttcttgatgg

SEQ ID NO: 20349 - DNA, 40 bp, Artificial Sequence
  PCR primer for ORF amplification
aattacatgactcgagttagaaaggcgataataacgaggt

SEQ ID NO: 20350 - DNA, 40 bp, Artificial Sequence
  PCR primer for ORF amplification
aattacatgactcgagtcaccttctcttaggtcctcttat

SEQ ID NO: 20351 - DNA, 40 bp, Artificial Sequence
  PCR primer for ORF amplification
aattacatgactcgagtcaatgctcttccgcacctttatg

SEQ ID NO: 20352 - DNA, 40 bp, Artificial Sequence
  PCR primer for ORF amplification
aattacatgactcgagttaaaaaaggctttcagttgaaga

SEQ ID NO: 20353 - DNA, 40 bp, Artificial Sequence
  PCR primer for ORF amplification
aattacatgactcgagctactgcgttgcattctccaaggt

SEQ ID NO: 20354 - DNA, 40 bp, Artificial Sequence
  PCR primer for ORF amplification
aattacatgactcgagctaatacgtagcaccaccaatctg

SEQ ID NO: 20355 - DNA, 40 bp, Artificial Sequence
  PCR primer for ORF amplification
aattacatgactcgagctagttaccacctcttagtgttaa

SEQ ID NO: 20356 - DNA, 40 bp, Artificial Sequence
  PCR primer for ORF amplification
aattacatgactcgagtcaacttgggcagcacacatgcaa

SEQ ID NO: 20357 - DNA, 40 bp, Artificial Sequence
  PCR primer for ORF amplification
aattacatgactcgagtcaacttgggcagcacacacgcaa

SEQ ID NO: 20358 - DNA, 40 bp, Artificial Sequence
  PCR primer for ORF amplification
aattacatgactcgagttataacaaagcaaaggcagcagc

SEQ ID NO: 20359 - DNA, 40 bp, Artificial Sequence
  PCR primer for ORF amplification
aattacatgactcgagttagttgttgagggctctagcatt

SEQ ID NO: 20360 - DNA, 40 bp, Artificial Sequence
  PCR primer for ORF amplification
aattacatgactcgagtcacaaatttttactaagacacgt

SEQ ID NO: 20361 - DNA, 40 bp, Artificial Sequence
  PCR primer for ORF amplification
aattacatgactcgagttactcaacttgactgccatccct

SEQ ID NO: 20362 - DNA, 40 bp, Artificial Sequence
  PCR primer for ORF amplification
aattacatgactcgagttaaccaccgaaaccatataaggt

SEQ ID NO: 20363 - DNA, 40 bp, Artificial Sequence
  PCR primer for ORF amplification
aattacatgactcgagttaaccaccgaaaccgtataaggt

SEQ ID NO: 20364 - DNA, 40 bp, Artificial Sequence
  PCR primer for ORF amplification
aattacatgactcgagctatatagagtataaacagggcat

SEQ ID NO: 20365 - DNA, 40 bp, Artificial Sequence
  PCR primer for ORF amplification
aattacatgactcgagttaagcattagcagcaatggcttg

SEQ ID NO: 20366 - DNA, 40 bp, Artificial Sequence
  PCR primer for ORF amplification
aattacatgactcgagttagaagtccatttcctcgacctt

SEQ ID NO: 20367 - DNA, 40 bp, Artificial Sequence
  PCR primer for ORF amplification
aattacatgactcgagtcattgagaaattttttttaaaac

SEQ ID NO: 20368 - DNA, 40 bp, Artificial Sequence
  PCR primer for ORF amplification
aattacatgactcgagttaaaacaaaaacttcgtcatcgt

SEQ ID NO: 20369 - DNA, 40 bp, Artificial Sequence
  PCR primer for ORF amplification
aattacatgactcgagttattcattaaatggccaggaaag

SEQ ID NO: 20370 - DNA, 40 bp, Artificial Sequence
  PCR primer for ORF amplification
aattacatgactcgagtcactgatttcgttccctctgttt

SEQ ID NO: 20371 - DNA, 40 bp, Artificial Sequence
  PCR primer for ORF amplification
aattacatgactcgagctatacgttggaagcaatagcttg

SEQ ID NO: 20372 - DNA, 40 bp, Artificial Sequence
  PCR primer for ORF amplification
aattacatgactcgagtcatgaacaacggcgagagtgaac

SEQ ID NO: 20373 - DNA, 40 bp, Artificial Sequence
  PCR primer for ORF amplification
aattacatgactcgagttacgtgtatttcttgacggctgc

SEQ ID NO: 20374 - DNA, 40 bp, Artificial Sequence
  PCR primer for ORF amplification
aattacatgactcgagtcagcagacaggtctgtcctggag

SEQ ID NO: 20375 - DNA, 40 bp, Artificial Sequence
  PCR primer for ORF amplification
aattacatgactcgagtcaatgagacaaaaaccacctacc

SEQ ID NO: 20376 - DNA, 40 bp, Artificial Sequence
  PCR primer for ORF amplification
aattacatgactcgagctaagggtaaaattccttgtattt

SEQ ID NO: 20377 - DNA, 40 bp, Artificial Sequence
  PCR primer for ORF amplification
aattacatgactcgagttagatttcgccagaagcggaggc

SEQ ID NO: 20378 - DNA, 40 bp, Artificial Sequence
  PCR primer for ORF amplification
aattacatgactcgagtcagttattctcttcgacaaattt

SEQ ID NO: 20379 - DNA, 40 bp, Artificial Sequence
  PCR primer for ORF amplification
aattacatgactcgagttaaagttggctcaagaaattgtt

SEQ ID NO: 20380 - DNA, 40 bp, Artificial Sequence
  PCR primer for ORF amplification
aattacatgactcgagttagtcgaataaaccgaaacccat

SEQ ID NO: 20381 - DNA, 40 bp, Artificial Sequence
  PCR primer for ORF amplification
aattacatgactcgagttatttagaatcgagtaattcctg

SEQ ID NO: 20382 - DNA, 40 bp, Artificial Sequence
  PCR primer for ORF amplification
aattacatgactcgagtcagaatctggtgaaagaagtttt

SEQ ID NO: 20383 - DNA, 40 bp, Artificial Sequence
  PCR primer for ORF amplification
aattacatgactcgagttagtccttggcaatcttagccag

SEQ ID NO: 20384 - DNA, 40 bp, Artificial Sequence
  PCR primer for ORF amplification
aattacatgactcgagctaattcttaccccaggagtagat

SEQ ID NO: 20385 - DNA, 40 bp, Artificial Sequence
  PCR primer for ORF amplification
aattacatgactcgagctaatcaaataaaccgaaacccat

SEQ ID NO: 20386 - DNA, 40 bp, Artificial Sequence
  PCR primer for ORF amplification
aattacatgactcgagttatttcttagattctttaaccac

SEQ ID NO: 20387 - DNA, 40 bp, Artificial Sequence
  PCR primer for ORF amplification
aattacatgactcgagttatgctactttcatattccccat

SEQ ID NO: 20388 - DNA, 40 bp, Artificial Sequence
  PCR primer for ORF amplification
aattacatgactcgagttatacctttttctttttctcgaa

SEQ ID NO: 20389 - DNA, 40 bp, Artificial Sequence
  PCR primer for ORF amplification
aattacatgactcgagttattcagaagcagtagctctggt

SEQ ID NO: 20390 - DNA, 40 bp, Artificial Sequence
  PCR primer for ORF amplification
aattacatgactcgagttattcggaagcagcagctctggt

SEQ ID NO: 20391 - DNA, 40 bp, Artificial Sequence
  PCR primer for ORF amplification
aattacatgactcgagctagtattgcgaatctaccgtgtt

SEQ ID NO: 20392 - DNA, 40 bp, Artificial Sequence
  PCR primer for ORF amplification
aattacatgactcgagtcatccgattagggcgtatccaaa

SEQ ID NO: 20393 - DNA, 40 bp, Artificial Sequence
  PCR primer for ORF amplification
aattacatgactcgagctatattctgccattcaatgcgtg

SEQ ID NO: 20394 - DNA, 40 bp, Artificial Sequence
  PCR primer for ORF amplification
aattacatgactcgagtcagtccttctgctggctgttcag

SEQ ID NO: 20395 - DNA, 40 bp, Artificial Sequence
  PCR primer for ORF amplification
aattacatgactcgagttaaaacccatgaattttaatgtt

SEQ ID NO: 20396 - DNA, 40 bp, Artificial Sequence
  PCR primer for ORF amplification
aattacatgactcgagttactcacaggcttttttcaagta

SEQ ID NO: 20397 - DNA, 40 bp, Artificial Sequence
  PCR primer for ORF amplification
aattacatgactcgagttaattcttcatcaatgcctttag

SEQ ID NO: 20398 - DNA, 40 bp, Artificial Sequence
  PCR primer for ORF amplification
aattacatgactcgagttattttgtctttgattcgtacac

SEQ ID NO: 20399 - DNA, 40 bp, Artificial Sequence
  PCR primer for ORF amplification
aattacatgactcgagctattttttggaatcatcagctat

SEQ ID NO: 20400 - DNA, 40 bp, Artificial Sequence
  PCR primer for ORF amplification
aattacatgactcgagttacttcttggttgggtcttcttc

SEQ ID NO: 20401 - DNA, 40 bp, Artificial Sequence
  PCR primer for ORF amplification
aattacatgactcgagtcaaggcagaagcccgattttagt

SEQ ID NO: 20402 - DNA, 40 bp, Artificial Sequence
  PCR primer for ORF amplification
aattacatgactcgagttaatcgaataaaccaaaacccat

SEQ ID NO: 20403 - DNA, 40 bp, Artificial Sequence
  PCR primer for ORF amplification
aattacatgactcgagtcatttttttttcttccccttccc

SEQ ID NO: 20404 - DNA, 40 bp, Artificial Sequence
  PCR primer for ORF amplification
aattacatgactcgagttacataagcgtacaacaaacact

SEQ ID NO: 20405 - DNA, 40 bp, Artificial Sequence
  PCR primer for ORF amplification
aattacatgactcgagttactgatttatgacatcgatgag

SEQ ID NO: 20406 - DNA, 40 bp, Artificial Sequence
  PCR primer for ORF amplification
aattacatgactcgagttaattttccttccatctatgacc

SEQ ID NO: 20407 - DNA, 40 bp, Artificial Sequence
  PCR primer for ORF amplification
aattacatgactcgagttaatttgcaagaataggttctaa

SEQ ID NO: 20408 - DNA, 40 bp, Artificial Sequence
  PCR primer for ORF amplification
aattacatgactcgagctatttcgctttggattcatactc

SEQ ID NO: 20409 - DNA, 40 bp, Artificial Sequence
  PCR primer for ORF amplification
aattacatgactcgagtcaaatgtgcgctatatatatacc

SEQ ID NO: 20410 - DNA, 40 bp, Artificial Sequence
  PCR primer for ORF amplification
aattacatgactcgagtcaggaccggtcgtatccctccgg

SEQ ID NO: 20411 - DNA, 40 bp, Artificial Sequence
  PCR primer for ORF amplification
aattacatgactcgagttatctaccctgagatagctttct

SEQ ID NO: 20412 - DNA, 40 bp, Artificial Sequence
  PCR primer for ORF amplification
aattacatgactcgagttattttgtagagctttgtttttg

SEQ ID NO: 20413 - DNA, 40 bp, Artificial Sequence
  PCR primer for ORF amplification
aattacatgactcgagttagattggctttttcgtcgccca

SEQ ID NO: 20414 - DNA, 40 bp, Artificial Sequence
  PCR primer for ORF amplification
aattacatgactcgagtcatccttttttgagagccaaatc

SEQ ID NO: 20415 - DNA, 40 bp, Artificial Sequence
  PCR primer for ORF amplification
aattacatgactcgagtcatagtgttttagtttcactctt

SEQ ID NO: 20416 - DNA, 40 bp, Artificial Sequence
  PCR primer for ORF amplification
aattacatgactcgagtcaattgtaggctttggttccggc

SEQ ID NO: 20417 - DNA, 40 bp, Artificial Sequence
  PCR primer for ORF amplification
aattacatgactcgagttactgttgtggtggagtaggagg

SEQ ID NO: 20418 - DNA, 40 bp, Artificial Sequence
  PCR primer for ORF amplification
aattacatgactcgagctacttccaaacaactggtccaga

SEQ ID NO: 20419 - DNA, 40 bp, Artificial Sequence
  PCR primer for ORF amplification
aattacatgactcgagttatgatagaacgtccatggcttc

SEQ ID NO: 20420 - DNA, 40 bp, Artificial Sequence
  PCR primer for ORF amplification
aattacatgactcgagttaaaggaacttggacgcaaccct

SEQ ID NO: 20421 - DNA, 40 bp, Artificial Sequence
  PCR primer for ORF amplification
aattacatgactcgagttagtcgttttgtgattggccatg

SEQ ID NO: 20422 - DNA, 40 bp, Artificial Sequence
  PCR primer for ORF amplification
aattacatgactcgagtcagtccttacgtataccgtattt

SEQ ID NO: 20423 - DNA, 40 bp, Artificial Sequence
  PCR primer for ORF amplification
aattacatgactcgagctatttggcagcctttgtcatata

SEQ ID NO: 20424 - DNA, 40 bp, Artificial Sequence
  PCR primer for ORF amplification
aattacatgactcgagtcattttggagttcgcgattgtct

SEQ ID NO: 20425 - DNA, 40 bp, Artificial Sequence
  PCR primer for ORF amplification
aattacatgactcgagctataaggaaaagccggatatcat

SEQ ID NO: 20426 - DNA, 40 bp, Artificial Sequence
  PCR primer for ORF amplification
aattacatgactcgagttagttgaaaatggaagcaatttt

SEQ ID NO: 20427 - DNA, 40 bp, Artificial Sequence; identical to SEQ ID NO: 20135
  PCR primer for ORF amplification

SEQ ID NO: 20428 - DNA, 40 bp, Artificial Sequence
  PCR primer for ORF amplification
aattacatgactcgagctaagcaactaaatggtcacggtt

SEQ ID NO: 20429 - DNA, 40 bp, Artificial Sequence
  PCR primer for ORF amplification
aattacatgactcgagttaggcgaggcaaaaaaaaaaaaa

SEQ ID NO: 20430 - DNA, 40 bp, Artificial Sequence
  PCR primer for ORF amplification
aattacatgactcgagtcaaatatctacaaatgaagaaag

SEQ ID NO: 20431 - DNA, 40 bp, Artificial Sequence
  PCR primer for ORF amplification
aattacatgactcgagttatcttagtttaaggtttctaaa

SEQ ID NO: 20432 - DNA, 40 bp, Artificial Sequence
  PCR primer for ORF amplification
aattacatgactcgagttagttgaccttcaacaattcgac

SEQ ID NO: 20433 - DNA, 40 bp, Artificial Sequence
  PCR primer for ORF amplification
aattacatgactcgagttaccttcctgggccagtggaagc

SEQ ID NO: 20434 - DNA, 40 bp, Artificial Sequence
  PCR primer for ORF amplification
aattacatgactcgagtcatctagattgcattctccttat

SEQ ID NO: 20435 - DNA, 40 bp, Artificial Sequence
  PCR primer for ORF amplification
aattacatgactcgagtcaatgatagggtaataaccgctt

SEQ ID NO: 20436 - DNA, 40 bp, Artificial Sequence
  PCR primer for ORF amplification
aattacatgactcgagttagtgatgtttatatcccactaa

SEQ ID NO: 20437 - DNA, 40 bp, Artificial Sequence
  PCR primer for ORF amplification
aattacatgactcgagttaccaaatacccttcttaacacc

SEQ ID NO: 20438 - DNA, 40 bp, Artificial Sequence
  PCR primer for ORF amplification
aattacatgactcgagttatctatttactttattgtcggg

SEQ ID NO: 20439 - DNA, 40 bp, Artificial Sequence
  PCR primer for ORF amplification
aattacatgactcgagttagctgaaatggacgacgatagg

SEQ ID NO: 20440 - DNA, 40 bp, Artificial Sequence
  PCR primer for ORF amplification
aattacatgactcgagtcaacacatagcggggggagggtt

SEQ ID NO: 20441 - DNA, 40 bp, Artificial Sequence
  PCR primer for ORF amplification
aattacatgactcgagttaggttgctaaaatttgtgttac

SEQ ID NO: 20442 - DNA, 40 bp, Artificial Sequence
  PCR primer for ORF amplification
aattacatgactcgagttatgagtccagtccatcctctcc

SEQ ID NO: 20443 - DNA, 40 bp, Artificial Sequence
  PCR primer for ORF amplification
aattacatgactcgagctatatgctacttttagtccgttg

SEQ ID NO: 20444 - DNA, 40 bp, Artificial Sequence
  PCR primer for ORF amplification
aattacatgactcgagctacctgccaaatgtattttctcc

SEQ ID NO: 20445 - DNA, 40 bp, Artificial Sequence
  PCR primer for ORF amplification
aattacatgactcgagctaatctagtttgccagcgaagat

SEQ ID NO: 20446 - DNA, 40 bp, Artificial Sequence
  PCR primer for ORF amplification
aattacatgactcgagtcatgatgatgccggacccttccc

SEQ ID NO: 20447 - DNA, 40 bp, Artificial Sequence
  PCR primer for ORF amplification
aattacatgactcgagctaacgcaactcgatcgaaggttt

SEQ ID NO: 20448 - DNA, 40 bp, Artificial Sequence
  PCR primer for ORF amplification
aattacatgactcgagctagttagcctgtgtttcaccatc

SEQ ID NO: 20449 - DNA, 40 bp, Artificial Sequence
  PCR primer for ORF amplification
aattacatgactcgagttatatactcaatccaaaacaggg

SEQ ID NO: 20450 - DNA, 40 bp, Artificial Sequence
  PCR primer for ORF amplification
aattacatgactcgagctagcaacggtgctcttggcggaa

SEQ ID NO: 20451 - DNA, 40 bp, Artificial Sequence
  PCR primer for ORF amplification
aattacatgactcgagttactcaccgaacaactttctgac

SEQ ID NO: 20452 - DNA, 40 bp, Artificial Sequence
  PCR primer for ORF amplification
aattacatgactcgagttaccagacattctcagattcatc

SEQ ID NO: 20453 - DNA, 40 bp, Artificial Sequence
  PCR primer for ORF amplification
aattacatgactcgagtcatttcgtaaacttgacatcgtg

SEQ ID NO: 20454 - DNA, 40 bp, Artificial Sequence
  PCR primer for ORF amplification
aattacatgactcgagttacaaagctttctttgcggcagc

SEQ ID NO: 20455 - DNA, 40 bp, Artificial Sequence
  PCR primer for ORF amplification
aattacatgactcgagttataaagccttcttggcggcatc

SEQ ID NO: 20456 - DNA, 40 bp, Artificial Sequence
  PCR primer for ORF amplification
aattacatgactcgagtcattctttcttctttgccagagg

SEQ ID NO: 20457 - DNA, 40 bp, Artificial Sequence
  PCR primer for ORF amplification
aattacatgactcgagttaattcgtccagcttctcggggg

SEQ ID NO: 20458 - DNA, 40 bp, Artificial Sequence
  PCR primer for ORF amplification
aattacatgactcgagttagtccttcattgaataaccgat

SEQ ID NO: 20459 - DNA, 40 bp, Artificial Sequence
  PCR primer for ORF amplification
aattacatgactcgagttaatccttatctttggcaaggac

SEQ ID NO: 20460 - DNA, 40 bp, Artificial Sequence
  PCR primer for ORF amplification
aattacatgactcgagctagtttgtgatagtgtagatacc

SEQ ID NO: 20461 - DNA, 40 bp, Artificial Sequence; identical to SEQ ID NO: 20099
  PCR primer for ORF amplification

SEQ ID NO: 20462 - DNA, 40 bp, Artificial Sequence; identical to SEQ ID NO: 20099
  PCR primer for ORF amplification

SEQ ID NO: 20463 - DNA, 40 bp, Artificial Sequence; identical to SEQ ID NO: 20099
  PCR primer for ORF amplification

SEQ ID NO: 20464 - DNA, 40 bp, Artificial Sequence; identical to SEQ ID NO: 20099
  PCR primer for ORF amplification

SEQ ID NO: 20465 - DNA, 40 bp, Artificial Sequence; identical to SEQ ID NO: 20099
  PCR primer for ORF amplification

SEQ ID NO: 20466 - DNA, 40 bp, Artificial Sequence; identical to SEQ ID NO: 20099
  PCR primer for ORF amplification

SEQ ID NO: 20467 - DNA, 40 bp, Artificial Sequence
  PCR primer for ORF amplification
aattacatgactcgagtcagtacattggttggcctggctt

SEQ ID NO: 20468 - DNA, 40 bp, Artificial Sequence
  PCR primer for ORF amplification
aattacatgactcgagtcaaaatgcgtcgtcggcggctag

SEQ ID NO: 20469 - DNA, 40 bp, Artificial Sequence
  PCR primer for ORF amplification
aattacatgactcgagtcataccacaatcttagaccattc

SEQ ID NO: 20470 - DNA, 40 bp, Artificial Sequence
  PCR primer for ORF amplification
aattacatgactcgagtcaagttgtcatctcatcgatgta

SEQ ID NO: 20471 - DNA, 40 bp, Artificial Sequence
  PCR primer for ORF amplification
aattacatgactcgagttattcgttcaacaaataataagc

SEQ ID NO: 20472 - DNA, 40 bp, Artificial Sequence
  PCR primer for ORF amplification
aattacatgactcgagctaacgttcttttaaagccttgtt

SEQ ID NO: 20473 - DNA, 40 bp, Artificial Sequence
  PCR primer for ORF amplification
aattacatgactcgagtcactccaatgtttccattctttc

SEQ ID NO: 20474 - DNA, 40 bp, Artificial Sequence
  PCR primer for ORF amplification
aattacatgactcgagttacgtagttttttccgccacgaa

SEQ ID NO: 20475 - DNA, 40 bp, Artificial Sequence
  PCR primer for ORF amplification
aattacatgactcgagtcacctaccgcatcttgctaactg

SEQ ID NO: 20476 - DNA, 40 bp, Artificial Sequence
  PCR primer for ORF amplification
aattacatgactcgagtcagaatctgacagttccggtaag

SEQ ID NO: 20477 - DNA, 40 bp, Artificial Sequence
  PCR primer for ORF amplification
aattacatgactcgagttagttggaagcaacaacaacttc

SEQ ID NO: 20478 - DNA, 40 bp, Artificial Sequence
  PCR primer for ORF amplification
aattacatgactcgagtcagtccttgattaattccaagtt

SEQ ID NO: 20479 - DNA, 40 bp, Artificial Sequence
  PCR primer for ORF amplification
aattacatgactcgagctattgaatttcaaagtatgcact

SEQ ID NO: 20480 - DNA, 40 bp, Artificial Sequence; identical to SEQ ID NO: 20479
  PCR primer for ORF amplification

SEQ ID NO: 20481 - DNA, 40 bp, Artificial Sequence
  PCR primer for ORF amplification
aattacatgactcgagctaatttgcaatagtgtagatacc

SEQ ID NO: 20482 - DNA, 40 bp, Artificial Sequence
  PCR primer for ORF amplification
aattacatgactcgagtcatgaaaactgcgtccttttgtt

SEQ ID NO: 20483 - DNA, 40 bp, Artificial Sequence
  PCR primer for ORF amplification
aattacatgactcgagttacttagatttactggcgccctt

SEQ ID NO: 20484 - DNA, 40 bp, Artificial Sequence
  PCR primer for ORF amplification
aattacatgactcgagttactcgctcttttttgagttaca

SEQ ID NO: 20485 - DNA, 40 bp, Artificial Sequence
  PCR primer for ORF amplification
aattacatgactcgagctatgcttttcttgacctagattg

SEQ ID NO: 20486 - DNA, 40 bp, Artificial Sequence
  PCR primer for ORF amplification
aattacatgactcgagctagtatatttctgggtatttctt

SEQ ID NO: 20487 - DNA, 40 bp, Artificial Sequence
  PCR primer for ORF amplification
aattacatgactcgagttagttttgcctttttttccaatt

SEQ ID NO: 20488 - DNA, 40 bp, Artificial Sequence
  PCR primer for ORF amplification
aattacatgactcgagttatttcgagttgcgattcttttc

SEQ ID NO: 20489 - DNA, 40 bp, Artificial Sequence
  PCR primer for ORF amplification
aattacatgactcgagctaatttgcgatagtgtagatacc

SEQ ID NO: 20490 - DNA, 40 bp, Artificial Sequence
  PCR primer for ORF amplification
aattacatgactcgagctaaacagcatcttcgtcaccgtc

SEQ ID NO: 20491 - DNA, 40 bp, Artificial Sequence
  PCR primer for ORF amplification
aattacatgactcgagttagacaattgtatacaacactag

SEQ ID NO: 20492 - DNA, 40 bp, Artificial Sequence
  PCR primer for ORF amplification
aattacatgactcgagtcattgctttttatcagagcattt

SEQ ID NO: 20493 - DNA, 40 bp, Artificial Sequence
  PCR primer for ORF amplification
aattacatgactcgagttatacaagatcccttaattgttc

SEQ ID NO: 20494 - DNA, 40 bp, Artificial Sequence
  PCR primer for ORF amplification
aattacatgactcgagtcaccatgcaccaccgctatttat

SEQ ID NO: 20495 - DNA, 40 bp, Artificial Sequence
  PCR primer for ORF amplification
aattacatgactcgagtcactttggtattttgatattctc

SEQ ID NO: 20496 - DNA, 40 bp, Artificial Sequence
  PCR primer for ORF amplification
aattacatgactcgagctaaaattcgtagtgacagatgct

SEQ ID NO: 20497 - DNA, 40 bp, Artificial Sequence
  PCR primer for ORF amplification
aattacatgactcgagttagtttggaacagcagtgtagat

SEQ ID NO: 20498 - DNA, 40 bp, Artificial Sequence
  PCR primer for ORF amplification
aattacatgactcgagctattttggaatagcagtgtagat

SEQ ID NO: 20499 - DNA, 40 bp, Artificial Sequence
  PCR primer for ORF amplification
aattacatgactcgagctattttggaatagcagtgtaaat

SEQ ID NO: 20500 - DNA, 40 bp, Artificial Sequence; identical to SEQ ID NO: 20498
  PCR primer for ORF amplification

SEQ ID NO: 20501 - DNA, 40 bp, Artificial Sequence
  PCR primer for ORF amplification
aattacatgactcgagctagtttggtacagcagtgtagat

SEQ ID NO: 20502 - DNA, 40 bp, Artificial Sequence
  PCR primer for ORF amplification
aattacatgactcgagttattcctcgcggatgtagaaggg

SEQ ID NO: 20503 - DNA, 40 bp, Artificial Sequence
  PCR primer for ORF amplification
aattacatgactcgagtcatagtataatgcagataaaaaa

SEQ ID NO: 20504 - DNA, 40 bp, Artificial Sequence
  PCR primer for ORF amplification
aattacatgactcgagtcaaatttgaaatctggtaccttc

SEQ ID NO: 20505 - DNA, 40 bp, Artificial Sequence
  PCR primer for ORF amplification
aattacatgactcgagtcaatgactttctttggtttcctc

SEQ ID NO: 20506 - DNA, 40 bp, Artificial Sequence
  PCR primer for ORF amplification
aattacatgactcgagttatggtgtgtgcgtatcattata

SEQ ID NO: 20507 - DNA, 40 bp, Artificial Sequence
  PCR primer for ORF amplification
aattacatgactcgagtcaatgtacacgaaagtcaatata

SEQ ID NO: 20508 - DNA, 40 bp, Artificial Sequence
  PCR primer for ORF amplification
aattacatgactcgagttaagcagagtaattcaaacggaa

SEQ ID NO: 20509 - DNA, 40 bp, Artificial Sequence
  PCR primer for ORF amplification
aattacatgactcgagtcaattgttggtacggaacttgta

SEQ ID NO: 20510 - DNA, 40 bp, Artificial Sequence
  PCR primer for ORF amplification
aattacatgactcgagttagtttgcgtcgggattggaagc

SEQ ID NO: 20511 - DNA, 40 bp, Artificial Sequence
  PCR primer for ORF amplification
aattacatgactcgagttatcggtcctggtagaaggcaat

SEQ ID NO: 20512 - DNA, 40 bp, Artificial Sequence
  PCR primer for ORF amplification
aattacatgactcgagctacctctcttctcgtaagtaggc

SEQ ID NO: 20513 - DNA, 40 bp, Artificial Sequence
  PCR primer for ORF amplification
aattacatgactcgagtcagggatagtacaattgggctgt

SEQ ID NO: 20514 - DNA, 40 bp, Artificial Sequence
  PCR primer for ORF amplification
aattacatgactcgagctacttgtgaagccaaagaattgt

SEQ ID NO: 20515 - DNA, 40 bp, Artificial Sequence
  PCR primer for ORF amplification
aattacatgactcgagtcatgtgtgcactgaatccatctc

SEQ ID NO: 20516 - DNA, 40 bp, Artificial Sequence
  PCR primer for ORF amplification
aattacatgactcgagttaaattaataaagtttcaatctt

SEQ ID NO: 20517 - DNA, 40 bp, Artificial Sequence
  PCR primer for ORF amplification
aattacatgactcgagttataccaaaagaaaagcaaatag

SEQ ID NO: 20518 - DNA, 40 bp, Artificial Sequence
  PCR primer for ORF amplification
aattacatgactcgagctagtgatagaaccttctcctagg

SEQ ID NO: 20519 - DNA, 40 bp, Artificial Sequence
  PCR primer for ORF amplification
aattacatgactcgagttagatctttacatgttggtactc

SEQ ID NO: 20520 - DNA, 40 bp, Artificial Sequence
  PCR primer for ORF amplification
aattacatgactcgagttagtcccgtagtttttcgaattt

SEQ ID NO: 20521 - DNA, 40 bp, Artificial Sequence
  PCR primer for ORF amplification
aattacatgactcgagtcatttggagacctctatgttgtc

SEQ ID NO: 20522 - DNA, 40 bp, Artificial Sequence
  PCR primer for ORF amplification
aattacatgactcgagtcagttggcccatctttctaccat

SEQ ID NO: 20523 - DNA, 40 bp, Artificial Sequence
  PCR primer for ORF amplification
aattacatgactcgagttattcgatgtcgagactgctgcc

SEQ ID NO: 20524 - DNA, 40 bp, Artificial Sequence
  PCR primer for ORF amplification
aattacatgactcgagctaaaatgaagacagccacaatct

SEQ ID NO: 20525 - DNA, 40 bp, Artificial Sequence
  PCR primer for ORF amplification
aattacatgactcgagttatagatctttgattcccttctc

SEQ ID NO: 20526 - DNA, 40 bp, Artificial Sequence
  PCR primer for ORF amplification
aattacatgactcgagttaccatacgattgccagcaatac

SEQ ID NO: 20527 - DNA, 40 bp, Artificial Sequence
  PCR primer for ORF amplification
aattacatgactcgagtcataataagccatcttcatacaa

SEQ ID NO: 20528 - DNA, 40 bp, Artificial Sequence
  PCR primer for ORF amplification
aattacatgactcgagtcaatttcttttcggttttcgtac

SEQ ID NO: 20529 - DNA, 40 bp, Artificial Sequence
  PCR primer for ORF amplification
aattacatgactcgagttagaatagcatatccatggtgca

SEQ ID NO: 20530 - DNA, 40 bp, Artificial Sequence
  PCR primer for ORF amplification
aattacatgactcgagctattttatgaaggcacttatata

SEQ ID NO: 20531 - DNA, 40 bp, Artificial Sequence
  PCR primer for ORF amplification
aattacatgactcgagtcagtaattcacagttaacaacag

SEQ ID NO: 20532 - DNA, 40 bp, Artificial Sequence
  PCR primer for ORF amplification
aattacatgactcgagctaacgttcaaggttgatattatc

SEQ ID NO: 20533 - DNA, 40 bp, Artificial Sequence
  PCR primer for ORF amplification
aattacatgactcgagttaatctctttcggcagcaatggc

SEQ ID NO: 20534 - DNA, 40 bp, Artificial Sequence
  PCR primer for ORF amplification
aattacatgactcgagtcatgctttttcagcaagtgcttg

SEQ ID NO: 20535 - DNA, 40 bp, Artificial Sequence
  PCR primer for ORF amplification
aattacatgactcgagttatctgcccgtagtaatttcctt

SEQ ID NO: 20536 - DNA, 40 bp, Artificial Sequence
  PCR primer for ORF amplification
aattacatgactcgagctattcttccagtagttcctcaat

SEQ ID NO: 20537 - DNA, 40 bp, Artificial Sequence
  PCR primer for ORF amplification
aattacatgactcgagtcataacttagtgttagcgtcatt

SEQ ID NO: 20538 - DNA, 40 bp, Artificial Sequence
  PCR primer for ORF amplification
aattacatgactcgagttaatcgtcgtgctcgatgtgcct

SEQ ID NO: 20539 - DNA, 40 bp, Artificial Sequence
  PCR primer for ORF amplification
aattacatgactcgagttagtaaacgaaacccaaaatctt

SEQ ID NO: 20540 - DNA, 40 bp, Artificial Sequence
  PCR primer for ORF amplification
aattacatgactcgagctattgcttgttttcagctttcca

SEQ ID NO: 20541 - DNA, 40 bp, Artificial Sequence
  PCR primer for ORF amplification
aattacatgactcgagctaatcatcagaagtgcagcattc

SEQ ID NO: 20542 - DNA, 40 bp, Artificial Sequence
  PCR primer for ORF amplification
aattacatgactcgagtcaatttataaaatgtaaacaaac

SEQ ID NO: 20543 - DNA, 40 bp, Artificial Sequence
  PCR primer for ORF amplification
aattacatgactcgagttaagcttccaaagccaaacgacc

SEQ ID NO: 20544 - DNA, 40 bp, Artificial Sequence
  PCR primer for ORF amplification
aattacatgactcgagtcaaccactaacaatcaatttaag

SEQ ID NO: 20545 - DNA, 40 bp, Artificial Sequence
  PCR primer for ORF amplification
aattacatgactcgagttactgtttaccagttttttcttt

SEQ ID NO: 20546 - DNA, 40 bp, Artificial Sequence
  PCR primer for ORF amplification
aattacatgactcgagttattctgcaaattcaggtctcaa

SEQ ID NO: 20547 - DNA, 40 bp, Artificial Sequence
  PCR primer for ORF amplification
aattacatgactcgagtcaatggtttttgtaagcatctga

SEQ ID NO: 20548 - DNA, 40 bp, Artificial Sequence
  PCR primer for ORF amplification
aattacatgactcgagctagtgcatcggagaggagatccg

SEQ ID NO: 20549 - DNA, 40 bp, Artificial Sequence
  PCR primer for ORF amplification
aattacatgactcgagttacttggatttcgaaggatctaa

SEQ ID NO: 20550 - DNA, 40 bp, Artificial Sequence
  PCR primer for ORF amplification
aattacatgactcgagctaaatggattgataatcttcatt

SEQ ID NO: 20551 - DNA, 40 bp, Artificial Sequence
  PCR primer for ORF amplification
aattacatgactcgagtcatttatttggagatcttggtgg

SEQ ID NO: 20552 - DNA, 40 bp, Artificial Sequence
  PCR primer for ORF amplification
aattacatgactcgagttaggcttgagtagaggaggagta

SEQ ID NO: 20553 - DNA, 40 bp, Artificial Sequence
  PCR primer for ORF amplification
aattacatgactcgagtcaatgaaagcgcactacgtatat

SEQ ID NO: 20554 - DNA, 40 bp, Artificial Sequence
  PCR primer for ORF amplification
aattacatgactcgagttatgcttgagtagaggaagagta

SEQ ID NO: 20555 - DNA, 40 bp, Artificial Sequence
  PCR primer for ORF amplification
aattacatgactcgagtcaaaagaattttggggcctttct

SEQ ID NO: 20556 - DNA, 40 bp, Artificial Sequence
  PCR primer for ORF amplification
aattacatgactcgagttacagttcttgagaagctttggc

SEQ ID NO: 20557 - DNA, 40 bp, Artificial Sequence
  PCR primer for ORF amplification
aattacatgactcgagttataattcttgagaagccttggt

SEQ ID NO: 20558 - DNA, 40 bp, Artificial Sequence
  PCR primer for ORF amplification
aattacatgactcgagttagatcatgtgctccagccttgt

SEQ ID NO: 20559 - DNA, 40 bp, Artificial Sequence
  PCR primer for ORF amplification
aattacatgactcgagtcaatgaatataaacatataaaat

SEQ ID NO: 20560 - DNA, 40 bp, Artificial Sequence
  PCR primer for ORF amplification
aattacatgactcgagctattttgtatagtaagcagaacc

SEQ ID NO: 20561 - DNA, 40 bp, Artificial Sequence
  PCR primer for ORF amplification
aattacatgactcgagctaatccttgttgttccgcttcac

SEQ ID NO: 20562 - DNA, 40 bp, Artificial Sequence
  PCR primer for ORF amplification
aattacatgactcgagctaattttgaagagctttaactgc

SEQ ID NO: 20563 - DNA, 40 bp, Artificial Sequence
  PCR primer for ORF amplification
aattacatgactcgagttacaacaacaaagcagcggcacc

SEQ ID NO: 20564 - DNA, 40 bp, Artificial Sequence
  PCR primer for ORF amplification
aattacatgactcgagttacataataggtagaggcctatc

SEQ ID NO: 20565 - DNA, 40 bp, Artificial Sequence
  PCR primer for ORF amplification
aattacatgactcgagctaagtacggccggaagagagctg

SEQ ID NO: 20566 - DNA, 40 bp, Artificial Sequence
  PCR primer for ORF amplification
aattacatgactcgagttaaagtcttctcttggatccatt

SEQ ID NO: 20567 - DNA, 40 bp, Artificial Sequence
  PCR primer for ORF amplification
aattacatgactcgagtcattcgttaccatctaccctaat

SEQ ID NO: 20568 - DNA, 40 bp, Artificial Sequence
  PCR primer for ORF amplification
aattacatgactcgagttatttgcgctgaatgatgtactt

SEQ ID NO: 20569 - DNA, 40 bp, Artificial Sequence
  PCR primer for ORF amplification
aattacatgactcgagttatttcttacttccctttttttc

SEQ ID NO: 20570 - DNA, 40 bp, Artificial Sequence
  PCR primer for ORF amplification
aattacatgactcgagtcacttctgtattaacaattgttt

SEQ ID NO: 20571 - DNA, 40 bp, Artificial Sequence
  PCR primer for ORF amplification
aattacatgactcgagttataccaggtgtggaggtaacag

SEQ ID NO: 20572 - DNA, 40 bp, Artificial Sequence
  PCR primer for ORF amplification
aattacatgactcgagctaggcggctgatttcacgtctac

SEQ ID NO: 20573 - DNA, 40 bp, Artificial Sequence
  PCR primer for ORF amplification
aattacatgactcgagctattcatgtcgatgctgctcttc

SEQ ID NO: 20574 - DNA, 40 bp, Artificial Sequence
  PCR primer for ORF amplification
aattacatgactcgagctagacgtagacaccgaaagaatt

SEQ ID NO: 20575 - DNA, 40 bp, Artificial Sequence
  PCR primer for ORF amplification
aattacatgactcgagctaaaacagcatatccaaagtaca

SEQ ID NO: 20576 - DNA, 40 bp, Artificial Sequence
  PCR primer for ORF amplification
aattacatgactcgagctatgatctttcacctcttaatct

SEQ ID NO: 20577 - DNA, 40 bp, Artificial Sequence
  PCR primer for ORF amplification
aattacatgactcgagtcatgatctttcacctcttagtct

SEQ ID NO: 20578 - DNA, 40 bp, Artificial Sequence
  PCR primer for ORF amplification
aattacatgactcgagtcaaccatgccaagagcttctata

SEQ ID NO: 20579 - DNA, 40 bp, Artificial Sequence
  PCR primer for ORF amplification
aattacatgactcgagtcataccgatgacaaccacagtct

SEQ ID NO: 20580 - DNA, 40 bp, Artificial Sequence
  PCR primer for ORF amplification
aattacatgactcgagtcactcatcggcgaatgtagtttt

SEQ ID NO: 20581 - DNA, 40 bp, Artificial Sequence
  PCR primer for ORF amplification
aattacatgactcgagctaggatcttttccgatggcataa

SEQ ID NO: 20582 - DNA, 40 bp, Artificial Sequence
  PCR primer for ORF amplification
aattacatgactcgagttactcatcatcgtcgtctccatc

SEQ ID NO: 20583 - DNA, 40 bp, Artificial Sequence
  PCR primer for ORF amplification
aattacatgactcgagttaaatgtctacattcggcttgcg

SEQ ID NO: 20584 - DNA, 40 bp, Artificial Sequence
  PCR primer for ORF amplification
aattacatgactcgagttatataatactttcttgcggtcc

SEQ ID NO: 20585 - DNA, 40 bp, Artificial Sequence
  PCR primer for ORF amplification
aattacatgactcgagttatttcgagttcgcatcattgtc

SEQ ID NO: 20586 - DNA, 40 bp, Artificial Sequence
  PCR primer for ORF amplification
aattacatgactcgagttattttctttcagtcattacctc

SEQ ID NO: 20587 - DNA, 40 bp, Artificial Sequence
  PCR primer for ORF amplification
aattacatgactcgagttatatgaccctacttgccaaaga

SEQ ID NO: 20588 - DNA, 40 bp, Artificial Sequence
  PCR primer for ORF amplification
aattacatgactcgagttacttgacatcgcgcgatcttcc

SEQ ID NO: 20589 - DNA, 40 bp, Artificial Sequence
  PCR primer for ORF amplification
aattacatgactcgagtcacattaatcctattgcctggca

SEQ ID NO: 20590 - DNA, 40 bp, Artificial Sequence
  PCR primer for ORF amplification
aattacatgactcgagctatttaagcaactgttccatttt

SEQ ID NO: 20591 - DNA, 40 bp, Artificial Sequence
  PCR primer for ORF amplification
aattacatgactcgagtcaagtacatttacaaatgttttt

SEQ ID NO: 20592 - DNA, 40 bp, Artificial Sequence
  PCR primer for ORF amplification
aattacatgactcgagttagaagtcatcaccactttcagc

SEQ ID NO: 20593 - DNA, 40 bp, Artificial Sequence
  PCR primer for ORF amplification
aattacatgactcgagctagaaatccgttactcttccgtt

SEQ ID NO: 20594 - DNA, 40 bp, Artificial Sequence
  PCR primer for ORF amplification
aattacatgactcgagtcattgaaaattctgtttcccaca

SEQ ID NO: 20595 - DNA, 40 bp, Artificial Sequence
  PCR primer for ORF amplification
aattacatgactcgagtcaaatgtcaagaccggggatctt

SEQ ID NO: 20596 - DNA, 40 bp, Artificial Sequence
  PCR primer for ORF amplification
aattacatgactcgagctataagtcaagtttatcaccccc

SEQ ID NO: 20597 - DNA, 40 bp, Artificial Sequence
  PCR primer for ORF amplification
aattacatgactcgagttatgtgctcttttttgagtttgc

SEQ ID NO: 20598 - DNA, 40 bp, Artificial Sequence
  PCR primer for ORF amplification
aattacatgactcgagttaaccaaaaagggaatcatcttc

SEQ ID NO: 20599 - DNA, 40 bp, Artificial Sequence
  PCR primer for ORF amplification
aattacatgactcgagtcagccgctatcatcattgtcacg

SEQ ID NO: 20600 - DNA, 40 bp, Artificial Sequence
  PCR primer for ORF amplification
aattacatgactcgagttaaacataaatacgcaattctac

SEQ ID NO: 20601 - DNA, 40 bp, Artificial Sequence
  PCR primer for ORF amplification
aattacatgactcgagtcagtcataaatcatgttttccct

SEQ ID NO: 20602 - DNA, 40 bp, Artificial Sequence
  PCR primer for ORF amplification
aattacatgactcgagctaaattctatgccttttcgcagc

SEQ ID NO: 20603 - DNA, 40 bp, Artificial Sequence
  PCR primer for ORF amplification
aattacatgactcgagctatgtgctggtatggtcgttatc

SEQ ID NO: 20604 - DNA, 40 bp, Artificial Sequence
  PCR primer for ORF amplification
aattacatgactcgagttactcaacaggggtttttaacac

SEQ ID NO: 20605 - DNA, 40 bp, Artificial Sequence
  PCR primer for ORF amplification
aattacatgactcgagtcatggcacataaggaggaggaga

SEQ ID NO: 20606 - DNA, 40 bp, Artificial Sequence
  PCR primer for ORF amplification
aattacatgactcgagttagtttttaacgacttgaatctt

SEQ ID NO: 20607 - DNA, 40 bp, Artificial Sequence
  PCR primer for ORF amplification
aattacatgactcgagttaacgcgttcttgtaactccata

SEQ ID NO: 20608 - DNA, 40 bp, Artificial Sequence
  PCR primer for ORF amplification
aattacatgactcgagttatcgaccatctccagtgttctg

SEQ ID NO: 20609 - DNA, 40 bp, Artificial Sequence
  PCR primer for ORF amplification
aattacatgactcgagttattggatagatggcacatggta

SEQ ID NO: 20610 - DNA, 40 bp, Artificial Sequence
  PCR primer for ORF amplification
aattacatgactcgagttatttttctttttttacagtgtt

SEQ ID NO: 20611 - DNA, 40 bp, Artificial Sequence
  PCR primer for ORF amplification
aattacatgactcgagctagtttaaatgagatggaccaaa

SEQ ID NO: 20612 - DNA, 40 bp, Artificial Sequence
  PCR primer for ORF amplification
aattacatgactcgagctacatgctcttgattttttcagt

SEQ ID NO: 20613 - DNA, 40 bp, Artificial Sequence
  PCR primer for ORF amplification
aattacatgactcgagtcacccgttccccattagtatgat

SEQ ID NO: 20614 - DNA, 40 bp, Artificial Sequence
  PCR primer for ORF amplification
aattacatgactcgagtcaggcactctcttcctccggttg

SEQ ID NO: 20615 - DNA, 40 bp, Artificial Sequence
  PCR primer for ORF amplification
aattacatgactcgagttacgtacttccatttgcttcctc

SEQ ID NO: 20616 - DNA, 40 bp, Artificial Sequence
  PCR primer for ORF amplification
aattacatgactcgagttagcttatcaaatttgcatcatt

SEQ ID NO: 20617 - DNA, 40 bp, Artificial Sequence
  PCR primer for ORF amplification
aattacatgactcgagttatttcaatgggatgaaacggga

SEQ ID NO: 20618 - DNA, 40 bp, Artificial Sequence
  PCR primer for ORF amplification
aattacatgactcgagctaaacattattcgtaccatattt

SEQ ID NO: 20619 - DNA, 40 bp, Artificial Sequence
  PCR primer for ORF amplification
aattacatgactcgagctaattccttcccataatttgaag

SEQ ID NO: 20620 - DNA, 40 bp, Artificial Sequence
  PCR primer for ORF amplification
aattacatgactcgagctattgaaataccggcttcaatat

SEQ ID NO: 20621 - DNA, 40 bp, Artificial Sequence
  PCR primer for ORF amplification
aattacatgactcgagttatgaaacacgcttatgattata

SEQ ID NO: 20622 - DNA, 40 bp, Artificial Sequence
  PCR primer for ORF amplification
aattacatgactcgagctaatctaatccatgactggtcgt

SEQ ID NO: 20623 - DNA, 40 bp, Artificial Sequence
  PCR primer for ORF amplification
aattacatgactcgagtcacttgccaaagatacaagacca

SEQ ID NO: 20624 - DNA, 40 bp, Artificial Sequence
  PCR primer for ORF amplification
aattacatgactcgagttaaatcatgtcatcgtcatcgtc

SEQ ID NO: 20625 - DNA, 40 bp, Artificial Sequence
  PCR primer for ORF amplification
aattacatgactcgagttattgttgggagaagtgttccat

SEQ ID NO: 20626 - DNA, 40 bp, Artificial Sequence
  PCR primer for ORF amplification
aattacatgactcgagctatgaagagtttgtccgtaccaa

SEQ ID NO: 20627 - DNA, 40 bp, Artificial Sequence
  PCR primer for ORF amplification
aattacatgactcgagtcaaggcacctcttcgtcgtcctg

SEQ ID NO: 20628 - DNA, 40 bp, Artificial Sequence
  PCR primer for ORF amplification
aattacatgactcgagttatttcttgtatctcaagtagct

SEQ ID NO: 20629 - DNA, 40 bp, Artificial Sequence
  PCR primer for ORF amplification
aattacatgactcgagctaaatcatgtcggaaagcgataa

SEQ ID NO: 20630 - DNA, 40 bp, Artificial Sequence
  PCR primer for ORF amplification
aattacatgactcgagctaagaatttagtagattaccctc

SEQ ID NO: 20631 - DNA, 40 bp, Artificial Sequence
  PCR primer for ORF amplification
aattacatgactcgagttatacaattattctacaaagtgt

SEQ ID NO: 20632 - DNA, 40 bp, Artificial Sequence
  PCR primer for ORF amplification
aattacatgactcgagctaaaataacttaaacagggtata

SEQ ID NO: 20633 - DNA, 40 bp, Artificial Sequence
  PCR primer for ORF amplification
aattacatgactcgagctaatcaaagaagtcgtcatcatc

SEQ ID NO: 20634 - DNA, 40 bp, Artificial Sequence
  PCR primer for ORF amplification
aattacatgactcgagtcagatattacctggcgcatgcct

SEQ ID NO: 20635 - DNA, 40 bp, Artificial Sequence
  PCR primer for ORF amplification
aattacatgactcgagttattcatcgtcactatctaccaa

SEQ ID NO: 20636 - DNA, 40 bp, Artificial Sequence
  PCR primer for ORF amplification
aattacatgactcgagtcaaacaaaactaggtttgggtag

SEQ ID NO: 20637 - DNA, 40 bp, Artificial Sequence
  PCR primer for ORF amplification
aattacatgactcgagtcaattcttttcaacagcgataac

SEQ ID NO: 20638 - DNA, 40 bp, Artificial Sequence
  PCR primer for ORF amplification
aattacatgactcgagttatccacgctccttataacatga

SEQ ID NO: 20639 - DNA, 40 bp, Artificial Sequence
  PCR primer for ORF amplification
aattacatgactcgagtcatagacctcttcttggcctttt

SEQ ID NO: 20640 - DNA, 40 bp, Artificial Sequence
  PCR primer for ORF amplification
aattacatgactcgagtcattgtgtatctacaatctcttc

SEQ ID NO: 20641 - DNA, 40 bp, Artificial Sequence
  PCR primer for ORF amplification
aattacatgactcgagttattcttgtatgaaatcattcac

SEQ ID NO: 20642 - DNA, 40 bp, Artificial Sequence
  PCR primer for ORF amplification
aattacatgactcgagctaaaatttcttggttaataccct

SEQ ID NO: 20643 - DNA, 40 bp, Artificial Sequence
  PCR primer for ORF amplification
aattacatgactcgagtcagtttttcttcgctaccttgtt

SEQ ID NO: 20644 - DNA, 40 bp, Artificial Sequence
  PCR primer for ORF amplification
aattacatgactcgagttatctctttcttagtaaaacact

SEQ ID NO: 20645 - DNA, 40 bp, Artificial Sequence
  PCR primer for ORF amplification
aattacatgactcgagtcagtgcgttattggcggattagt

SEQ ID NO: 20646 - DNA, 40 bp, Artificial Sequence
  PCR primer for ORF amplification
aattacatgactcgagctaacgacgaatcaaaagataagc

SEQ ID NO: 20647 - DNA, 40 bp, Artificial Sequence
  PCR primer for ORF amplification
aattacatgactcgagtcatttctgaccgacaatccaatc

SEQ ID NO: 20648 - DNA, 40 bp, Artificial Sequence
  PCR primer for ORF amplification
aattacatgactcgagttagttaccagtgctaccaaagcc

SEQ ID NO: 20649 - DNA, 40 bp, Artificial Sequence
  PCR primer for ORF amplification
aattacatgactcgagtcaatgcatttccaacatatgttt

SEQ ID NO: 20650 - DNA, 40 bp, Artificial Sequence
  PCR primer for ORF amplification
aattacatgactcgagctatttttgcatatatagtacatc

SEQ ID NO: 20651 - DNA, 40 bp, Artificial Sequence
  PCR primer for ORF amplification
aattacatgactcgagtcattttcggaagttataatgcca

SEQ ID NO: 20652 - DNA, 40 bp, Artificial Sequence
  PCR primer for ORF amplification
aattacatgactcgagctagtctagtctatctaaaatact

SEQ ID NO: 20653 - DNA, 40 bp, Artificial Sequence
  PCR primer for ORF amplification
aattacatgactcgagctagagaatacattggtcaagaat

SEQ ID NO: 20654 - DNA, 40 bp, Artificial Sequence
  PCR primer for ORF amplification
aattacatgactcgagctactttaatttgtcaaataatct

SEQ ID NO: 20655 - DNA, 40 bp, Artificial Sequence
  PCR primer for ORF amplification
aattacatgactcgagctatttagataacaaagcagcgaa

SEQ ID NO: 20656 - DNA, 40 bp, Artificial Sequence
  PCR primer for ORF amplification
aattacatgactcgagttaatttggttggtcctttttagc

SEQ ID NO: 20657 - DNA, 40 bp, Artificial Sequence
  PCR primer for ORF amplification
aattacatgactcgagttaaatgcctaattgtttttcgat

SEQ ID NO: 20658 - DNA, 40 bp, Artificial Sequence
  PCR primer for ORF amplification
aattacatgactcgagctaaaaattttgaaatgatctgag

SEQ ID NO: 20659 - DNA, 40 bp, Artificial Sequence
  PCR primer for ORF amplification
aattacatgactcgagtcaacgccacagatcgggtaggta

SEQ ID NO: 20660 - DNA, 40 bp, Artificial Sequence
  PCR primer for ORF amplification
aattacatgactcgagtcatgattgttcttcgtcagacga

SEQ ID NO: 20661 - DNA, 40 bp, Artificial Sequence
  PCR primer for ORF amplification
aattacatgactcgagttaagagagctggaacttattacc

SEQ ID NO: 20662 - DNA, 40 bp, Artificial Sequence
  PCR primer for ORF amplification
aattacatgactcgagttatttcttgggtataactgtcag

SEQ ID NO: 20663 - DNA, 40 bp, Artificial Sequence
  PCR primer for ORF amplification
aattacatgactcgagttactcaccgagttcagttttcaa

SEQ ID NO: 20664 - DNA, 40 bp, Artificial Sequence
  PCR primer for ORF amplification
aattacatgactcgagttaagaagagcttggaaatagctc

SEQ ID NO: 20665 - DNA, 40 bp, Artificial Sequence
  PCR primer for ORF amplification
aattacatgactcgagttaccaagcaacaccagtgtagta

SEQ ID NO: 20666 - DNA, 40 bp, Artificial Sequence
  PCR primer for ORF amplification
aattacatgactcgagtcataaaagcatcataactgcacc

SEQ ID NO: 20667 - DNA, 40 bp, Artificial Sequence
  PCR primer for ORF amplification
aattacatgactcgagttatcgttgtaacttgcgataaag

SEQ ID NO: 20668 - DNA, 40 bp, Artificial Sequence
  PCR primer for ORF amplification
aattacatgactcgagttatacaaatccttcgtaagcttc

SEQ ID NO: 20669 - DNA, 40 bp, Artificial Sequence
  PCR primer for ORF amplification
aattacatgactcgagtcagctattcatcacttgttgttt

SEQ ID NO: 20670 - DNA, 40 bp, Artificial Sequence
  PCR primer for ORF amplification
aattacatgactcgagctactgattgctgcttgcactatt

SEQ ID NO: 20671 - DNA, 40 bp, Artificial Sequence
  PCR primer for ORF amplification
aattacatgactcgagtcattgtctcaaaacatcttcgat

SEQ ID NO: 20672 - DNA, 40 bp, Artificial Sequence
  PCR primer for ORF amplification
aattacatgactcgagctaacaattttctaattgctccct

SEQ ID NO: 20673 - DNA, 40 bp, Artificial Sequence
  PCR primer for ORF amplification
aattacatgactcgagctagcggcaccaccagcagccatc

SEQ ID NO: 20674 - DNA, 40 bp, Artificial Sequence
  PCR primer for ORF amplification
aattacatgactcgagttattttttgggcttaacgtcagc

SEQ ID NO: 20675 - DNA, 40 bp, Artificial Sequence
  PCR primer for ORF amplification
aattacatgactcgagttaaatcaattgcttaccagcaca

SEQ ID NO: 20676 - DNA, 40 bp, Artificial Sequence
  PCR primer for ORF amplification
aattacatgactcgagctatctgataatatggtcccagaa

SEQ ID NO: 20677 - DNA, 40 bp, Artificial Sequence
  PCR primer for ORF amplification
aattacatgactcgagtcatttcttcttttccgaatcctt

SEQ ID NO: 20678 - DNA, 40 bp, Artificial Sequence
  PCR primer for ORF amplification
aattacatgactcgagtcatttcgttccatctatttcgct

SEQ ID NO: 20679 - DNA, 40 bp, Artificial Sequence
  PCR primer for ORF amplification
aattacatgactcgagctaggagatttggggtggaacttg

SEQ ID NO: 20680 - DNA, 40 bp, Artificial Sequence
  PCR primer for ORF amplification
aattacatgactcgagtcacatgtgataaattgtggaatc

SEQ ID NO: 20681 - DNA, 40 bp, Artificial Sequence
  PCR primer for ORF amplification
aattacatgactcgagttaaatttgtatctttggagcctt

SEQ ID NO: 20682 - DNA, 40 bp, Artificial Sequence
  PCR primer for ORF amplification
aattacatgactcgagttaaatgaatatgctgtttggtgt

SEQ ID NO: 20683 - DNA, 40 bp, Artificial Sequence
  PCR primer for ORF amplification
aattacatgactcgagtcaacgatctttggtttcttcttc

SEQ ID NO: 20684 - DNA, 40 bp, Artificial Sequence
  PCR primer for ORF amplification
aattacatgactcgagttatgctgttttgaaaactaaaaa

SEQ ID NO: 20685 - DNA, 40 bp, Artificial Sequence
  PCR primer for ORF amplification
aattacatgactcgagctattttgagacatcctccaagtt

SEQ ID NO: 20686 - DNA, 40 bp, Artificial Sequence
  PCR primer for ORF amplification
aattacatgactcgagtcactgaccactctgtccatcacc

SEQ ID NO: 20687 - DNA, 40 bp, Artificial Sequence
  PCR primer for ORF amplification
aattacatgactcgagttatggctttgttacgcttgcact

SEQ ID NO: 20688 - DNA, 40 bp, Artificial Sequence
  PCR primer for ORF amplification
aattacatgactcgagtcattcccactgctgtctgttttt

SEQ ID NO: 20689 - DNA, 40 bp, Artificial Sequence
  PCR primer for ORF amplification
aattacatgactcgagctaggaggtataagtatcatccgt

SEQ ID NO: 20690 - DNA, 40 bp, Artificial Sequence
  PCR primer for ORF amplification
aattacatgactcgagtcatttcttctttggagctcccaa

SEQ ID NO: 20691 - DNA, 40 bp, Artificial Sequence
  PCR primer for ORF amplification
aattacatgactcgagtcatgtagttgaccgggaagagtt

SEQ ID NO: 20692 - DNA, 40 bp, Artificial Sequence
  PCR primer for ORF amplification
aattacatgactcgagttaatcgaaggaaatctgcgcaga

SEQ ID NO: 20693 - DNA, 40 bp, Artificial Sequence
  PCR primer for ORF amplification
aattacatgactcgagttataattcaacttcagttgaaat

SEQ ID NO: 20694 - DNA, 40 bp, Artificial Sequence
  PCR primer for ORF amplification
aattacatgactcgagttaagcgttaaccttgtagacgga

SEQ ID NO: 20695 - DNA, 40 bp, Artificial Sequence
  PCR primer for ORF amplification
aattacatgactcgagtcagatgtgcaagcctgctataat

SEQ ID NO: 20696 - DNA, 40 bp, Artificial Sequence
  PCR primer for ORF amplification
aattacatgactcgagttaattggctgttgctgcagcatc

SEQ ID NO: 20697 - DNA, 40 bp, Artificial Sequence
  PCR primer for ORF amplification
aattacatgactcgagtcatacgttcacgccaggctccgg

SEQ ID NO: 20698 - DNA, 40 bp, Artificial Sequence
  PCR primer for ORF amplification
aattacatgactcgagtcagtcttccttcttttgacctgc

SEQ ID NO: 20699 - DNA, 40 bp, Artificial Sequence
  PCR primer for ORF amplification
aattacatgactcgagttataataggtaagaaatcaaacc

SEQ ID NO: 20700 - DNA, 40 bp, Artificial Sequence
  PCR primer for ORF amplification
aattacatgactcgagctagttttcctctaatagattaat

SEQ ID NO: 20701 - DNA, 40 bp, Artificial Sequence
  PCR primer for ORF amplification
aattacatgactcgagtcagttcatcaaaattgaaatttc

SEQ ID NO: 20702 - DNA, 40 bp, Artificial Sequence
  PCR primer for ORF amplification
aattacatgactcgagttaaatgtcatcaatatcaagttc

SEQ ID NO: 20703 - DNA, 40 bp, Artificial Sequence
  PCR primer for ORF amplification
aattacatgactcgagttattcctttgcatacctgatttg

SEQ ID NO: 20704 - DNA, 40 bp, Artificial Sequence
  PCR primer for ORF amplification
aattacatgactcgagtcaaacttgtatatcctttgagtg

SEQ ID NO: 20705 - DNA, 40 bp, Artificial Sequence
  PCR primer for ORF amplification
aattacatgactcgagtcattcataaatccacttagcttg

SEQ ID NO: 20706 - DNA, 40 bp, Artificial Sequence
  PCR primer for ORF amplification
aattacatgactcgagctaagcctttggacaatccttgga

SEQ ID NO: 20707 - DNA, 40 bp, Artificial Sequence
  PCR primer for ORF amplification
aattacatgactcgagctactctttaaaatcatcgtcttc

SEQ ID NO: 20708 - DNA, 40 bp, Artificial Sequence
  PCR primer for ORF amplification
aattacatgactcgagtcatttagattggacctgagaata

SEQ ID NO: 20709 - DNA, 40 bp, Artificial Sequence
  PCR primer for ORF amplification
aattacatgactcgagtcacgatttacttggcttcttggc

SEQ ID NO: 20710 - DNA, 40 bp, Artificial Sequence
  PCR primer for ORF amplification
aattacatgactcgagttattcagaagaagctggactgaa

SEQ ID NO: 20711 - DNA, 40 bp, Artificial Sequence
  PCR primer for ORF amplification
aattacatgactcgagtcattttttcttctcaaggcctaa

SEQ ID NO: 20712 - DNA, 40 bp, Artificial Sequence
  PCR primer for ORF amplification
aattacatgactcgagtcatacagttcttctatccgatat

SEQ ID NO: 20713 - DNA, 40 bp, Artificial Sequence
  PCR primer for ORF amplification
aattacatgactcgagttagttggttagaccaatgacacc

SEQ ID NO: 20714 - DNA, 40 bp, Artificial Sequence
  PCR primer for ORF amplification
aattacatgactcgagctatcgactaaagtgaacagcaat

SEQ ID NO: 20715 - DNA, 40 bp, Artificial Sequence
  PCR primer for ORF amplification
aattacatgactcgagttaacgagaagtagcagcaacctt

SEQ ID NO: 20716 - DNA, 40 bp, Artificial Sequence
  PCR primer for ORF amplification
aattacatgactcgagttaacgggaagtggcggcaacctt

SEQ ID NO: 20717 - DNA, 40 bp, Artificial Sequence
  PCR primer for ORF amplification
aattacatgactcgagtcaccatttttcttcagggttttc

SEQ ID NO: 20718 - DNA, 40 bp, Artificial Sequence
  PCR primer for ORF amplification
aattacatgactcgagttaccttctcttgtttcttaagaa

SEQ ID NO: 20719 - DNA, 40 bp, Artificial Sequence
  PCR primer for ORF amplification
aattacatgactcgagtcagtccttcttttcctgctgttt

SEQ ID NO: 20720 - DNA, 40 bp, Artificial Sequence
  PCR primer for ORF amplification
aattacatgactcgagttaccggcggaataactcgcgcac

SEQ ID NO: 20721 - DNA, 40 bp, Artificial Sequence
  PCR primer for ORF amplification
aattacatgactcgagttaaatttcaaagtcaaacttgtt

SEQ ID NO: 20722 - DNA, 40 bp, Artificial Sequence
  PCR primer for ORF amplification
aattacatgactcgagttagtgatggtggtcatcatttgg

SEQ ID NO: 20723 - DNA, 40 bp, Artificial Sequence
  PCR primer for ORF amplification
aattacatgactcgagctatgtcggaacgtccagcccaac

SEQ ID NO: 20724 - DNA, 40 bp, Artificial Sequence
  PCR primer for ORF amplification
aattacatgactcgagtcattttactctgcatagtacttc

SEQ ID NO: 20725 - DNA, 40 bp, Artificial Sequence
  PCR primer for ORF amplification
aattacatgactcgagctaactcaataccctttcaagatt

SEQ ID NO: 20726 - DNA, 40 bp, Artificial Sequence
  PCR primer for ORF amplification
aattacatgactcgagttaatcttgcatactaacatccac

SEQ ID NO: 20727 - DNA, 40 bp, Artificial Sequence
  PCR primer for ORF amplification
aattacatgactcgagttacgcatccatatccacatcagt

SEQ ID NO: 20728 - DNA, 40 bp, Artificial Sequence
  PCR primer for ORF amplification
aattacatgactcgagttaaacttctatcgatacccacaa

SEQ ID NO: 20729 - DNA, 40 bp, Artificial Sequence
  PCR primer for ORF amplification
aattacatgactcgagttagtattgacgtgcagcttcctg

SEQ ID NO: 20730 - DNA, 40 bp, Artificial Sequence
  PCR primer for ORF amplification
aattacatgactcgagtcagtaatcgtcgatttcttcata

SEQ ID NO: 20731 - DNA, 40 bp, Artificial Sequence
  PCR primer for ORF amplification
aattacatgactcgagtcataaagcttgaacttctttgac

SEQ ID NO: 20732 - DNA, 40 bp, Artificial Sequence
  PCR primer for ORF amplification
aattacatgactcgagtcatcccaatagtaattcataaac

SEQ ID NO: 20733 - DNA, 40 bp, Artificial Sequence
  PCR primer for ORF amplification
aattacatgactcgagttaatatcccttcctcttgtataa

SEQ ID NO: 20734 - DNA, 40 bp, Artificial Sequence
  PCR primer for ORF amplification
aattacatgactcgagtcaatgcaaaacggaggggttcct

SEQ ID NO: 20735 - DNA, 40 bp, Artificial Sequence
  PCR primer for ORF amplification
aattacatgactcgagttacctactatcaaaggtgaatgc

SEQ ID NO: 20736 - DNA, 40 bp, Artificial Sequence
  PCR primer for ORF amplification
aattacatgactcgagtcacatagactttgggtcctcaag

SEQ ID NO: 20737 - DNA, 40 bp, Artificial Sequence
  PCR primer for ORF amplification
aattacatgactcgagttagtgagtattggagacattgtc

SEQ ID NO: 20738 - DNA, 40 bp, Artificial Sequence
  PCR primer for ORF amplification
aattacatgactcgagttatatcgatcctgcgatataata

SEQ ID NO: 20739 - DNA, 40 bp, Artificial Sequence
  PCR primer for ORF amplification
aattacatgactcgagttattcgacgtcagcatcaaaagt

SEQ ID NO: 20740 - DNA, 40 bp, Artificial Sequence
  PCR primer for ORF amplification
aattacatgactcgagttagtctgtgcttgcacatccacg

SEQ ID NO: 20741 - DNA, 40 bp, Artificial Sequence
  PCR primer for ORF amplification
aattacatgactcgagttaattcattttcacatctttact

SEQ ID NO: 20742 - DNA, 40 bp, Artificial Sequence
  PCR primer for ORF amplification
aattacatgactcgagtcagaaccagcctatactttggtt

SEQ ID NO: 20743 - DNA, 40 bp, Artificial Sequence
  PCR primer for ORF amplification
aattacatgactcgagctaatcagatcttggagcttcctt

SEQ ID NO: 20744 - DNA, 40 bp, Artificial Sequence
  PCR primer for ORF amplification
aattacatgactcgagttaatcggttctagcagcttcctt

SEQ ID NO: 20745 - DNA, 40 bp, Artificial Sequence
  PCR primer for ORF amplification
aattacatgactcgagtcactggaatccggtagcaaggaa

SEQ ID NO: 20746 - DNA, 40 bp, Artificial Sequence
  PCR primer for ORF amplification
aattacatgactcgagttattgtttggtgaatgaatgtag

SEQ ID NO: 20747 - DNA, 40 bp, Artificial Sequence
  PCR primer for ORF amplification
aattacatgactcgagctatatacatttacagtcttgttc

SEQ ID NO: 20748 - DNA, 40 bp, Artificial Sequence
  PCR primer for ORF amplification
aattacatgactcgagctactcaccaatatcttcaaacca

SEQ ID NO: 20749 - DNA, 40 bp, Artificial Sequence
  PCR primer for ORF amplification
aattacatgactcgagtcaaggtacaaccttaatacccat

SEQ ID NO: 20750 - DNA, 40 bp, Artificial Sequence
  PCR primer for ORF amplification
aattacatgactcgagctaagcttgcagaggttgagagga

SEQ ID NO: 20751 - DNA, 40 bp, Artificial Sequence
  PCR primer for ORF amplification
aattacatgactcgagttataaaaataatagcgctgctac

SEQ ID NO: 20752 - DNA, 40 bp, Artificial Sequence
  PCR primer for ORF amplification
aattacatgactcgagctattttctaatttgcatttccac

SEQ ID NO: 20753 - DNA, 40 bp, Artificial Sequence
  PCR primer for ORF amplification
aattacatgactcgagtcactgattaaccattggtgctag

SEQ ID NO: 20754 - DNA, 40 bp, Artificial Sequence
  PCR primer for ORF amplification
aattacatgactcgagttacttctttccaagcttattttc

SEQ ID NO: 20755 - DNA, 40 bp, Artificial Sequence
  PCR primer for ORF amplification
aattacatgactcgagttatttaagagagtccaaactttt

SEQ ID NO: 20756 - DNA, 40 bp, Artificial Sequence
  PCR primer for ORF amplification
aattacatgactcgagctagctgtggagagaatgctgcga

SEQ ID NO: 20757 - DNA, 40 bp, Artificial Sequence
  PCR primer for ORF amplification
aattacatgactcgagttaacagacaacatcttgagtagc

SEQ ID NO: 20758 - DNA, 40 bp, Artificial Sequence
  PCR primer for ORF amplification
aattacatgactcgagttaggagttagagatgttcagaaa

SEQ ID NO: 20759 - DNA, 40 bp, Artificial Sequence
  PCR primer for ORF amplification
aattacatgactcgagttaaaatttcttcttctgcaattc

SEQ ID NO: 20760 - DNA, 40 bp, Artificial Sequence
  PCR primer for ORF amplification
aattacatgactcgagtcaacggcgtcggttgcccatact

SEQ ID NO: 20761 - DNA, 40 bp, Artificial Sequence
  PCR primer for ORF amplification
aattacatgactcgagctatttcaatacggattgtaggtt

SEQ ID NO: 20762 - DNA, 40 bp, Artificial Sequence
  PCR primer for ORF amplification
aattacatgactcgagtcatgcgtagccagagatgatctc

SEQ ID NO: 20763 - DNA, 40 bp, Artificial Sequence
  PCR primer for ORF amplification
aattacatgactcgagttaagaaaacaaataagcgattgt

SEQ ID NO: 20764 - DNA, 40 bp, Artificial Sequence
  PCR primer for ORF amplification
aattacatgactcgagctacacaaaacacaaacgcaaagg

SEQ ID NO: 20765 - DNA, 40 bp, Artificial Sequence
  PCR primer for ORF amplification
aattacatgactcgagttaatttgcgcctacaggatgtgt

SEQ ID NO: 20766 - DNA, 40 bp, Artificial Sequence
  PCR primer for ORF amplification
aattacatgactcgagttataactctttttttaaaaactg

SEQ ID NO: 20767 - DNA, 40 bp, Artificial Sequence
  PCR primer for ORF amplification
aattacatgactcgagttaactatcggtgcaaatagctat

SEQ ID NO: 20768 - DNA, 40 bp, Artificial Sequence
  PCR primer for ORF amplification
aattacatgactcgagttatgcttcgtcgtcttcgtcttc

SEQ ID NO: 20769 - DNA, 40 bp, Artificial Sequence
  PCR primer for ORF amplification
aattacatgactcgagtcaaaccagcagccataccttcgg

SEQ ID NO: 20770 - DNA, 40 bp, Artificial Sequence
  PCR primer for ORF amplification
aattacatgactcgagtcagttcatactcagttctgatat

SEQ ID NO: 20771 - DNA, 40 bp, Artificial Sequence
  PCR primer for ORF amplification
aattacatgactcgagtcataaattttccaatgaattagc

SEQ ID NO: 20772 - DNA, 40 bp, Artificial Sequence
  PCR primer for ORF amplification
aattacatgactcgagttatttagatctcatacgtttatt

SEQ ID NO: 20773 - DNA, 40 bp, Artificial Sequence
  PCR primer for ORF amplification
aattacatgactcgagtcatttacttaacaggctttggat

SEQ ID NO: 20774 - DNA, 40 bp, Artificial Sequence
  PCR primer for ORF amplification
aattacatgactcgagctacttgttgttttcgctcgacag

SEQ ID NO: 20775 - DNA, 40 bp, Artificial Sequence
  PCR primer for ORF amplification
aattacatgactcgagttagttgtctaccgttttggatgg

SEQ ID NO: 20776 - DNA, 40 bp, Artificial Sequence
  PCR primer for ORF amplification
aattacatgactcgagtcattgatacttggacaagtccgg

SEQ ID NO: 20777 - DNA, 40 bp, Artificial Sequence
  PCR primer for ORF amplification
aattacatgactcgagtcagccgacaaacttttcagcttc

SEQ ID NO: 20778 - DNA, 40 bp, Artificial Sequence
  PCR primer for ORF amplification
aattacatgactcgagttactccaatatattctgtttgag

SEQ ID NO: 20779 - DNA, 40 bp, Artificial Sequence
  PCR primer for ORF amplification
aattacatgactcgagtcaacctagcttgtagccaaacaa

SEQ ID NO: 20780 - DNA, 40 bp, Artificial Sequence
  PCR primer for ORF amplification
aattacatgactcgagttataattcaccggacttggcaac

SEQ ID NO: 20781 - DNA, 40 bp, Artificial Sequence
  PCR primer for ORF amplification
aattacatgactcgagttatttaccaaataatacagttct

SEQ ID NO: 20782 - DNA, 40 bp, Artificial Sequence
  PCR primer for ORF amplification
aattacatgactcgagttattctgaagaagcagcattttc

SEQ ID NO: 20783 - DNA, 40 bp, Artificial Sequence
  PCR primer for ORF amplification
aattacatgactcgagctacgaagtcatgtcggaagacgt

SEQ ID NO: 20784 - DNA, 40 bp, Artificial Sequence
  PCR primer for ORF amplification
aattacatgactcgagttaatcggtgattgaatctaagaa

SEQ ID NO: 20785 - DNA, 40 bp, Artificial Sequence
  PCR primer for ORF amplification
aattacatgactcgagctattccacctctttcaaaagttc

SEQ ID NO: 20786 - DNA, 40 bp, Artificial Sequence
  PCR primer for ORF amplification
aattacatgactcgagctatttcaattggttaaaaattga

SEQ ID NO: 20787 - DNA, 40 bp, Artificial Sequence; identical to SEQ ID NO: 20498
  PCR primer for ORF amplification

SEQ ID NO: 20788 - DNA, 40 bp, Artificial Sequence
  PCR primer for ORF amplification
aattacatgactcgagttagatgagtggctgcaagggttc

SEQ ID NO: 20789 - DNA, 40 bp, Artificial Sequence
  PCR primer for ORF amplification
aattacatgactcgagttacagttccttgattaaagattc

SEQ ID NO: 20790 - DNA, 40 bp, Artificial Sequence
  PCR primer for ORF amplification
aattacatgactcgagttatttcttcaccgcatttaattt

SEQ ID NO: 20791 - DNA, 40 bp, Artificial Sequence
  PCR primer for ORF amplification
aattacatgactcgagtcattcagagcctctagtgttcaa

SEQ ID NO: 20792 - DNA, 40 bp, Artificial Sequence
  PCR primer for ORF amplification
aattacatgactcgagttagttttctggaatttcaatttc

SEQ ID NO: 20793 - DNA, 40 bp, Artificial Sequence
  PCR primer for ORF amplification
aattacatgactcgagctaattttctgggatttcgatttc

SEQ ID NO: 20794 - DNA, 40 bp, Artificial Sequence
  PCR primer for ORF amplification
aattacatgactcgagttatcgtaacaaaaagtcttcgtc

SEQ ID NO: 20795 - DNA, 40 bp, Artificial Sequence
  PCR primer for ORF amplification
aattacatgactcgagctatttctgtttgagtatttccaa

SEQ ID NO: 20796 - DNA, 40 bp, Artificial Sequence
  PCR primer for ORF amplification
aattacatgactcgagctaacgagattctcctccaaggca

SEQ ID NO: 20797 - DNA, 40 bp, Artificial Sequence
  PCR primer for ORF amplification
aattacatgactcgagttagtacattggttggccgggttt

SEQ ID NO: 20798 - DNA, 40 bp, Artificial Sequence
  PCR primer for ORF amplification
aattacatgactcgagctaatacgtatatgtcattgaaga

SEQ ID NO: 20799 - DNA, 40 bp, Artificial Sequence
  PCR primer for ORF amplification
aattacatgactcgagttacgataacatggttggagtgtt

SEQ ID NO: 20800 - DNA, 40 bp, Artificial Sequence
  PCR primer for ORF amplification
aattacatgactcgagtcagaatcctaatgatttcaaaat

SEQ ID NO: 20801 - DNA, 40 bp, Artificial Sequence
  PCR primer for ORF amplification
aattacatgactcgagctaaaaggtttctccttccttcgg

SEQ ID NO: 20802 - DNA, 40 bp, Artificial Sequence
  PCR primer for ORF amplification
aattacatgactcgagttatactggcagaaccctaactcc

SEQ ID NO: 20803 - DNA, 40 bp, Artificial Sequence
  PCR primer for ORF amplification
aattacatgactcgagctattttagaacgaagttggcccc

SEQ ID NO: 20804 - DNA, 40 bp, Artificial Sequence
  PCR primer for ORF amplification
aattacatgactcgagttaagtactggctgaggcagtaga

SEQ ID NO: 20805 - DNA, 40 bp, Artificial Sequence
  PCR primer for ORF amplification
aattacatgactcgagtcatgaaagtttaccctttcttgc

SEQ ID NO: 20806 - DNA, 40 bp, Artificial Sequence
  PCR primer for ORF amplification
aattacatgactcgagttatttcttgtcgtatctggagta

SEQ ID NO: 20807 - DNA, 40 bp, Artificial Sequence
  PCR primer for ORF amplification
aattacatgactcgagttattcttgatcagtaacgtcttc

SEQ ID NO: 20808 - DNA, 40 bp, Artificial Sequence
  PCR primer for ORF amplification
aattacatgactcgagctactcgccccccagcagagcact

SEQ ID NO: 20809 - DNA, 40 bp, Artificial Sequence
  PCR primer for ORF amplification
aattacatgactcgagttagatcttttcttccacaatacc

SEQ ID NO: 20810 - DNA, 40 bp, Artificial Sequence
  PCR primer for ORF amplification
aattacatgactcgagctatgaatcttcataacctaacca

SEQ ID NO: 20811 - DNA, 40 bp, Artificial Sequence
  PCR primer for ORF amplification
aattacatgactcgagttaaatctgttcttctggtggttg

SEQ ID NO: 20812 - DNA, 40 bp, Artificial Sequence
  PCR primer for ORF amplification
aattacatgactcgagttaattatcaaggatttcattgtt

SEQ ID NO: 20813 - DNA, 40 bp, Artificial Sequence
  PCR primer for ORF amplification
aattacatgactcgagttacaacatctctctaacaacggc

SEQ ID NO: 20814 - DNA, 40 bp, Artificial Sequence
  PCR primer for ORF amplification
aattacatgactcgagttataggtttgtgttgtaatattt

SEQ ID NO: 20815 - DNA, 40 bp, Artificial Sequence
  PCR primer for ORF amplification
aattacatgactcgagtcatttttttgttttcttgaggtt

SEQ ID NO: 20816 - DNA, 40 bp, Artificial Sequence
  PCR primer for ORF amplification
aattacatgactcgagttaacgcttttttttgcccttgtt

SEQ ID NO: 20817 - DNA, 40 bp, Artificial Sequence
  PCR primer for ORF amplification
aattacatgactcgagttataatacatgcccacgacatcg

SEQ ID NO: 20818 - DNA, 40 bp, Artificial Sequence
  PCR primer for ORF amplification
aattacatgactcgagttaatccttcttgaggtttaaaga

SEQ ID NO: 20819 - DNA, 40 bp, Artificial Sequence
  PCR primer for ORF amplification
aattacatgactcgagttatttgctaataccccttttttc

SEQ ID NO: 20820 - DNA, 40 bp, Artificial Sequence
  PCR primer for ORF amplification
aattacatgactcgagttacaaggcattgatatggacttc

SEQ ID NO: 20821 - DNA, 40 bp, Artificial Sequence
  PCR primer for ORF amplification
aattacatgactcgagttactgcctctttttttccacagg

SEQ ID NO: 20822 - DNA, 40 bp, Artificial Sequence
  PCR primer for ORF amplification
aattacatgactcgagctaccagacgccttggttcccact

SEQ ID NO: 20823 - DNA, 40 bp, Artificial Sequence
  PCR primer for ORF amplification
aattacatgactcgagttatctaatgggtgattcagtata

SEQ ID NO: 20824 - DNA, 40 bp, Artificial Sequence
  PCR primer for ORF amplification
aattacatgactcgagctactgcttagctgtttccgtctc

SEQ ID NO: 20825 - DNA, 40 bp, Artificial Sequence
  PCR primer for ORF amplification
aattacatgactcgagtcactttccagagctataagatat

SEQ ID NO: 20826 - DNA, 40 bp, Artificial Sequence
  PCR primer for ORF amplification
aattacatgactcgagctaccatatctcgaacactcttgc

SEQ ID NO: 20827 - DNA, 40 bp, Artificial Sequence
  PCR primer for ORF amplification
aattacatgactcgagctatatatagtaatctgttatccc

SEQ ID NO: 20828 - DNA, 40 bp, Artificial Sequence
  PCR primer for ORF amplification
aattacatgactcgagtcaaaaagcatttttaccgaactt

SEQ ID NO: 20829 - DNA, 40 bp, Artificial Sequence
  PCR primer for ORF amplification
aattacatgactcgagtcagaaacgctccactttacttcg

SEQ ID NO: 20830 - DNA, 40 bp, Artificial Sequence
  PCR primer for ORF amplification
aattacatgactcgagctatttctttcttcttagacctgc

SEQ ID NO: 20831 - DNA, 40 bp, Artificial Sequence
  PCR primer for ORF amplification
aattacatgactcgagtcacataatgctaatgggccggat

SEQ ID NO: 20832 - DNA, 40 bp, Artificial Sequence
  PCR primer for ORF amplification
aattacatgactcgagttaaggaagaaatccacccttctt

SEQ ID NO: 20833 - DNA, 40 bp, Artificial Sequence
  PCR primer for ORF amplification
aattacatgactcgagtcatcgtgactgtgggagagccag

SEQ ID NO: 20834 - DNA, 40 bp, Artificial Sequence
  PCR primer for ORF amplification
aattacatgactcgagctaccagaagcgccaccagctttt

SEQ ID NO: 20835 - DNA, 40 bp, Artificial Sequence
  PCR primer for ORF amplification
aattacatgactcgagctaacctacccgcttgatcacatg

SEQ ID NO: 20836 - DNA, 40 bp, Artificial Sequence
  PCR primer for ORF amplification
aattacatgactcgagtcaacaaaaaaagtattctgtgtt

SEQ ID NO: 20837 - DNA, 40 bp, Artificial Sequence
  PCR primer for ORF amplification
aattacatgactcgagtcaacccataacgagcttcttgaa

SEQ ID NO: 20838 - DNA, 40 bp, Artificial Sequence
  PCR primer for ORF amplification
aattacatgactcgagtcagtcatcatgaaccagtgtctt

SEQ ID NO: 20839 - DNA, 40 bp, Artificial Sequence
  PCR primer for ORF amplification
aattacatgactcgagttatatagaagactctttataatt

SEQ ID NO: 20840 - DNA, 40 bp, Artificial Sequence
  PCR primer for ORF amplification
aattacatgactcgagctaatagacaaattcatcaagata

SEQ ID NO: 20841 - DNA, 40 bp, Artificial Sequence
  PCR primer for ORF amplification
aattacatgactcgagttaaatagcacccaaataatcttc

SEQ ID NO: 20842 - DNA, 40 bp, Artificial Sequence
  PCR primer for ORF amplification
aattacatgactcgagttaactaaaatcgttgttattaac

SEQ ID NO: 20843 - DNA, 40 bp, Artificial Sequence
  PCR primer for ORF amplification
aattacatgactcgagtcaaaagatgaatgaaagccacga

SEQ ID NO: 20844 - DNA, 40 bp, Artificial Sequence
  PCR primer for ORF amplification
aattacatgactcgagttaactaaacatatctagttgttg

SEQ ID NO: 20845 - DNA, 40 bp, Artificial Sequence
  PCR primer for ORF amplification
aattacatgactcgagttattgtccttcttgctcttcctc

SEQ ID NO: 20846 - DNA, 40 bp, Artificial Sequence
  PCR primer for ORF amplification
aattacatgactcgagtcagtctgcttcgtcgtcgtcgtc

SEQ ID NO: 20847 - DNA, 40 bp, Artificial Sequence
  PCR primer for ORF amplification
aattacatgactcgagttagtacatgtcagatttatggaa

SEQ ID NO: 20848 - DNA, 40 bp, Artificial Sequence
  PCR primer for ORF amplification
aattacatgactcgagttaattaatagtcttcttctttct

SEQ ID NO: 20849 - DNA, 40 bp, Artificial Sequence
  PCR primer for ORF amplification
aattacatgactcgagtcaccttggtgggaagatgacttc

SEQ ID NO: 20850 - DNA, 40 bp, Artificial Sequence
  PCR primer for ORF amplification
aattacatgactcgagttactctctttctaccaagtttgt

SEQ ID NO: 20851 - DNA, 40 bp, Artificial Sequence
  PCR primer for ORF amplification
aattacatgactcgagttagacttgggaaatggttggaac

SEQ ID NO: 20852 - DNA, 40 bp, Artificial Sequence
  PCR primer for ORF amplification
aattacatgactcgagctaatcgtcctcgttttcgttttc

SEQ ID NO: 20853 - DNA, 40 bp, Artificial Sequence
  PCR primer for ORF amplification
aattacatgactcgagtcagttctccagttttctacccaa

SEQ ID NO: 20854 - DNA, 40 bp, Artificial Sequence
  PCR primer for ORF amplification
aattacatgactcgagttagtagaaatactcctcatcttc

SEQ ID NO: 20855 - DNA, 40 bp, Artificial Sequence
  PCR primer for ORF amplification
aattacatgactcgagttattggtcactgtcaagaatgat

SEQ ID NO: 20856 - DNA, 40 bp, Artificial Sequence
  PCR primer for ORF amplification
aattacatgactcgagtcagtgaaagtacgcatcgtagag

SEQ ID NO: 20857 - DNA, 40 bp, Artificial Sequence
  PCR primer for ORF amplification
aattacatgactcgagttattggcttttagaaatggcctt

SEQ ID NO: 20858 - DNA, 40 bp, Artificial Sequence
  PCR primer for ORF amplification
aattacatgactcgagtcatttctgggaagggtgagggag

SEQ ID NO: 20859 - DNA, 40 bp, Artificial Sequence
  PCR primer for ORF amplification
aattacatgactcgagtcatctgcagagtaaccgagaaag

SEQ ID NO: 20860 - DNA, 40 bp, Artificial Sequence
  PCR primer for ORF amplification
aattacatgactcgagttaaacctgggaaattgtaggtat

SEQ ID NO: 20861 - DNA, 40 bp, Artificial Sequence
  PCR primer for ORF amplification
aattacatgactcgagttattgtctttgcatccgcaaatt

SEQ ID NO: 20862 - DNA, 40 bp, Artificial Sequence
  PCR primer for ORF amplification
aattacatgactcgagttatttatcgagcacatcagcgtc

SEQ ID NO: 20863 - DNA, 40 bp, Artificial Sequence
  PCR primer for ORF amplification
aattacatgactcgagttatttgtccaaaacatcagcatc

SEQ ID NO: 20864 - DNA, 40 bp, Artificial Sequence
  PCR primer for ORF amplification
aattacatgactcgagttatttagacaaggacatgatagc

SEQ ID NO: 20865 - DNA, 40 bp, Artificial Sequence
  PCR primer for ORF amplification
aattacatgactcgagctacatcacattcaaattgccgaa

SEQ ID NO: 20866 - DNA, 40 bp, Artificial Sequence
  PCR primer for ORF amplification
aattacatgactcgagctataaggccaaatgtacaaacac

SEQ ID NO: 20867 - DNA, 40 bp, Artificial Sequence
  PCR primer for ORF amplification
aattacatgactcgagtcatttactagcattactctcttt

SEQ ID NO: 20868 - DNA, 40 bp, Artificial Sequence
  PCR primer for ORF amplification
aattacatgactcgagctatctaacatgcttatggagaaa

SEQ ID NO: 20869 - DNA, 40 bp, Artificial Sequence
  PCR primer for ORF amplification
aattacatgactcgagttatttggacaaatgcttacgtgc

SEQ ID NO: 20870 - DNA, 40 bp, Artificial Sequence
  PCR primer for ORF amplification
aattacatgactcgagtcatgggaaaaatgggccgcccag

SEQ ID NO: 20871 - DNA, 40 bp, Artificial Sequence
  PCR primer for ORF amplification
aattacatgactcgagttataactttaacatcaaatataa

SEQ ID NO: 20872 - DNA, 40 bp, Artificial Sequence
  PCR primer for ORF amplification
aattacatgactcgagtcattctttctgcattttgtcaaa

SEQ ID NO: 20873 - DNA, 40 bp, Artificial Sequence
  PCR primer for ORF amplification
aattacatgactcgagttaccgtctagcttccaggagagc

SEQ ID NO: 20874 - DNA, 40 bp, Artificial Sequence
  PCR primer for ORF amplification
aattacatgactcgagttataacctctttctgtatatttc

SEQ ID NO: 20875 - DNA, 40 bp, Artificial Sequence
  PCR primer for ORF amplification
aattacatgactcgagttatttatgtcgtgccatgtttat

SEQ ID NO: 20876 - DNA, 40 bp, Artificial Sequence
  PCR primer for ORF amplification
aattacatgactcgagtcaaaactgaggatttctcgcctc

SEQ ID NO: 20877 - DNA, 40 bp, Artificial Sequence
  PCR primer for ORF amplification
aattacatgactcgagttataaaaaacttggtttgggcaa

SEQ ID NO: 20878 - DNA, 40 bp, Artificial Sequence
  PCR primer for ORF amplification
aattacatgactcgagttatgtggccagccggccatgcat

SEQ ID NO: 20879 - DNA, 40 bp, Artificial Sequence
  PCR primer for ORF amplification
aattacatgactcgagttaagaaatgtgttttttcaataa

SEQ ID NO: 20880 - DNA, 40 bp, Artificial Sequence
  PCR primer for ORF amplification
aattacatgactcgagctacaaatgagccaagacactttc

SEQ ID NO: 20881 - DNA, 40 bp, Artificial Sequence
  PCR primer for ORF amplification
aattacatgactcgagtcaagaagaatcctccgacttaac

SEQ ID NO: 20882 - DNA, 40 bp, Artificial Sequence
  PCR primer for ORF amplification
aattacatgactcgagttacaacaggccggtaccattctt

SEQ ID NO: 20883 - DNA, 40 bp, Artificial Sequence
  PCR primer for ORF amplification
aattacatgactcgagtcagtttgccggagattgttcctg

SEQ ID NO: 20884 - DNA, 40 bp, Artificial Sequence
  PCR primer for ORF amplification
aattacatgactcgagtcacatctttaagtaacctagttt

SEQ ID NO: 20885 - DNA, 40 bp, Artificial Sequence
  PCR primer for ORF amplification
aattacatgactcgagttagctaccattaccgtactcacc

SEQ ID NO: 20886 - DNA, 40 bp, Artificial Sequence
  PCR primer for ORF amplification
aattacatgactcgagttacagctgatatactgtaaaact

SEQ ID NO: 20887 - DNA, 40 bp, Artificial Sequence
  PCR primer for ORF amplification
aattacatgactcgagttagtatcctttcctcttggcatc

SEQ ID NO: 20888 - DNA, 40 bp, Artificial Sequence
  PCR primer for ORF amplification
aattacatgactcgagtcacttcttgtctctcttcttact

SEQ ID NO: 20889 - DNA, 40 bp, Artificial Sequence
  PCR primer for ORF amplification
aattacatgactcgagttaattagattgagggcgtgcgta

SEQ ID NO: 20890 - DNA, 40 bp, Artificial Sequence
  PCR primer for ORF amplification
aattacatgactcgagtcattctaaaatggctcttttgct

SEQ ID NO: 20891 - DNA, 40 bp, Artificial Sequence
  PCR primer for ORF amplification
aattacatgactcgagctaaacgccccaaagaacgatgct

SEQ ID NO: 20892 - DNA, 40 bp, Artificial Sequence
  PCR primer for ORF amplification
aattacatgactcgagtcaaacctttccactcaggtaatc

SEQ ID NO: 20893 - DNA, 40 bp, Artificial Sequence
  PCR primer for ORF amplification
aattacatgactcgagttattcattttttttggtgtcgag

SEQ ID NO: 20894 - DNA, 40 bp, Artificial Sequence
  PCR primer for ORF amplification
aattacatgactcgagttattcatttcctccaacgacttg

SEQ ID NO: 20895 - DNA, 40 bp, Artificial Sequence
  PCR primer for ORF amplification
aattacatgactcgagttatagagatttgttcatgaatct

SEQ ID NO: 20896 - DNA, 40 bp, Artificial Sequence
  PCR primer for ORF amplification
aattacatgactcgagtcaaacagcatattttttagtcca

SEQ ID NO: 20897 - DNA, 40 bp, Artificial Sequence
  PCR primer for ORF amplification
aattacatgactcgagttactcgtttctcctcctatctaa

SEQ ID NO: 20898 - DNA, 40 bp, Artificial Sequence
  PCR primer for ORF amplification
aattacatgactcgagtcagtatccgtttctcttgtaaag

SEQ ID NO: 20899 - DNA, 40 bp, Artificial Sequence
  PCR primer for ORF amplification
aattacatgactcgagttattcgttagcatttttccagat

SEQ ID NO: 20900 - DNA, 40 bp, Artificial Sequence
  PCR primer for ORF amplification
aattacatgactcgagttatatcttcctcctttttatgcg

SEQ ID NO: 20901 - DNA, 40 bp, Artificial Sequence
  PCR primer for ORF amplification
aattacatgactcgagtcactttgcatacatatctttgat

SEQ ID NO: 20902 - DNA, 40 bp, Artificial Sequence
  PCR primer for ORF amplification
aattacatgactcgagtcatattgcaggtatgcccacatc

SEQ ID NO: 20903 - DNA, 40 bp, Artificial Sequence
  PCR primer for ORF amplification
aattacatgactcgagtcacgtactataaattaccttttg

SEQ ID NO: 20904 - DNA, 40 bp, Artificial Sequence
  PCR primer for ORF amplification
aattacatgactcgagttagtagtctaggtccggagcggg

SEQ ID NO: 20905 - DNA, 40 bp, Artificial Sequence
  PCR primer for ORF amplification
aattacatgactcgagtcaatccaaattcaaatcttcttc

SEQ ID NO: 20906 - DNA, 40 bp, Artificial Sequence
  PCR primer for ORF amplification
aattacatgactcgagttagtactgattgatcagggcaat

SEQ ID NO: 20907 - DNA, 40 bp, Artificial Sequence
  PCR primer for ORF amplification
aattacatgactcgagttaatgacgacgagaggcagcaat

SEQ ID NO: 20908 - DNA, 40 bp, Artificial Sequence
  PCR primer for ORF amplification
aattacatgactcgagttagatgttcatcttggttcttct

SEQ ID NO: 20909 - DNA, 40 bp, Artificial Sequence
  PCR primer for ORF amplification
aattacatgactcgagttatacagcgtatttctttgtcca

SEQ ID NO: 20910 - DNA, 40 bp, Artificial Sequence
  PCR primer for ORF amplification
aattacatgactcgagttaatctacgcaggcatgttctct

SEQ ID NO: 20911 - DNA, 40 bp, Artificial Sequence
  PCR primer for ORF amplification
aattacatgactcgagttaattgcataaagtgtcaatcag

SEQ ID NO: 20912 - DNA, 40 bp, Artificial Sequence
  PCR primer for ORF amplification
aattacatgactcgagttactcaaagcgcactccagcttt

SEQ ID NO: 20913 - DNA, 40 bp, Artificial Sequence
  PCR primer for ORF amplification
aattacatgactcgagttatttaaagacacatgatttatt

SEQ ID NO: 20914 - DNA, 40 bp, Artificial Sequence
  PCR primer for ORF amplification
aattacatgactcgagtcacaaatccacaatgagttcctc

SEQ ID NO: 20915 - DNA, 40 bp, Artificial Sequence
  PCR primer for ORF amplification
aattacatgactcgagtcattttttatcatcttcttcgtc

SEQ ID NO: 20916 - DNA, 40 bp, Artificial Sequence
  PCR primer for ORF amplification
aattacatgactcgagtcaaattgtgtaggatatgtttgt

SEQ ID NO: 20917 - DNA, 40 bp, Artificial Sequence
  PCR primer for ORF amplification
aattacatgactcgagctaagtaaacaaggtgtcttcatc

SEQ ID NO: 20918 - DNA, 40 bp, Artificial Sequence
  PCR primer for ORF amplification
aattacatgactcgagttattcctgctcagacaacgtttc

SEQ ID NO: 20919 - DNA, 40 bp, Artificial Sequence
  PCR primer for ORF amplification
aattacatgactcgagctacttcttggcttcaatcttttg

SEQ ID NO: 20920 - DNA, 40 bp, Artificial Sequence
  PCR primer for ORF amplification
aattacatgactcgagttatacaggttcaaatatactatc

SEQ ID NO: 20921 - DNA, 40 bp, Artificial Sequence
  PCR primer for ORF amplification
aattacatgactcgagttaacgatacttgtacttaatttt

SEQ ID NO: 20922 - DNA, 40 bp, Artificial Sequence
  PCR primer for ORF amplification
aattacatgactcgagttaggattgattcttcaagttgtt

SEQ ID NO: 20923 - DNA, 40 bp, Artificial Sequence
  PCR primer for ORF amplification
aattacatgactcgagttaagttgagtttttcaaactgtt

SEQ ID NO: 20924 - DNA, 40 bp, Artificial Sequence
  PCR primer for ORF amplification
aattacatgactcgagtcaggagtgcaatatggaaaaaat

SEQ ID NO: 20925 - DNA, 40 bp, Artificial Sequence
  PCR primer for ORF amplification
aattacatgactcgagttatttagattgaacttgagaata

SEQ ID NO: 20926 - DNA, 40 bp, Artificial Sequence
  PCR primer for ORF amplification
aattacatgactcgagtcataaatatttatatacaaatgg

SEQ ID NO: 20927 - DNA, 40 bp, Artificial Sequence
  PCR primer for ORF amplification
aattacatgactcgagttaagccaaggtggtcaagatatc

SEQ ID NO: 20928 - DNA, 40 bp, Artificial Sequence
  PCR primer for ORF amplification
aattacatgactcgagttatatcgtcgtcttttttctttt

SEQ ID NO: 20929 - DNA, 40 bp, Artificial Sequence
  PCR primer for ORF amplification
aattacatgactcgagttacttacctttaataatgcttga

SEQ ID NO: 20930 - DNA, 40 bp, Artificial Sequence
  PCR primer for ORF amplification
aattacatgactcgagtcagggactactaaactgaaatat

SEQ ID NO: 20931 - DNA, 40 bp, Artificial Sequence
  PCR primer for ORF amplification
aattacatgactcgagtcaccaaaaccatctcctatacca

SEQ ID NO: 20932 - DNA, 40 bp, Artificial Sequence
  PCR primer for ORF amplification
aattacatgactcgagtcataactcaccagcttcttcgat

SEQ ID NO: 20933 - DNA, 40 bp, Artificial Sequence
  PCR primer for ORF amplification
aattacatgactcgagctagttgagagggtagcgagcatt

SEQ ID NO: 20934 - DNA, 40 bp, Artificial Sequence
  PCR primer for ORF amplification
aattacatgactcgagctagtccttttttaaagtccgaac

SEQ ID NO: 20935 - DNA, 40 bp, Artificial Sequence
  PCR primer for ORF amplification
aattacatgactcgagtcaatggttgttgatccgctctct

SEQ ID NO: 20936 - DNA, 40 bp, Artificial Sequence
  PCR primer for ORF amplification
aattacatgactcgagttatttctttggaacgtttgtgtt

SEQ ID NO: 20937 - DNA, 40 bp, Artificial Sequence
  PCR primer for ORF amplification
aattacatgactcgagctataactgttcctcttttataac

SEQ ID NO: 20938 - DNA, 40 bp, Artificial Sequence
  PCR primer for ORF amplification
aattacatgactcgagttatgaaaaatcaaaatcgtcgat

SEQ ID NO: 20939 - DNA, 40 bp, Artificial Sequence
  PCR primer for ORF amplification
aattacatgactcgagttacttcctgtttttgagtagtcc

SEQ ID NO: 20940 - DNA, 40 bp, Artificial Sequence
  PCR primer for ORF amplification
aattacatgactcgagtcacggtcttcttgtggtagtgtt

SEQ ID NO: 20941 - DNA, 40 bp, Artificial Sequence
  PCR primer for ORF amplification
aattacatgactcgagtcagtcatcgatatcgttagcttc

SEQ ID NO: 20942 - DNA, 40 bp, Artificial Sequence
  PCR primer for ORF amplification
aattacatgactcgagttaagcttcaaccatttctcttaa

SEQ ID NO: 20943 - DNA, 40 bp, Artificial Sequence
  PCR primer for ORF amplification
aattacatgactcgagctaaatttttagcagagaatcctc

SEQ ID NO: 20944 - DNA, 40 bp, Artificial Sequence
  PCR primer for ORF amplification
aattacatgactcgagctacttcttccctcctttcttttt

SEQ ID NO: 20945 - DNA, 40 bp, Artificial Sequence
  PCR primer for ORF amplification
aattacatgactcgagttagagcgtcaaagaatatgaata

SEQ ID NO: 20946 - DNA, 40 bp, Artificial Sequence
  PCR primer for ORF amplification
aattacatgactcgagttaaaagggaaccgtcaaggggcc

SEQ ID NO: 20947 - DNA, 40 bp, Artificial Sequence
  PCR primer for ORF amplification
aattacatgactcgagctacatttctctcagataatgagt

SEQ ID NO: 20948 - DNA, 40 bp, Artificial Sequence
  PCR primer for ORF amplification
aattacatgactcgagctaaactttgtttttattttccac

SEQ ID NO: 20949 - DNA, 40 bp, Artificial Sequence
  PCR primer for ORF amplification
aattacatgactcgagttagtgattcatttccaattgttt

SEQ ID NO: 20950 - DNA, 40 bp, Artificial Sequence
  PCR primer for ORF amplification
aattacatgactcgagtcacataacggaaccaaccatgga

SEQ ID NO: 20951 - DNA, 40 bp, Artificial Sequence
  PCR primer for ORF amplification
aattacatgactcgagtcaactaaagtccaaaatttctaa

SEQ ID NO: 20952 - DNA, 40 bp, Artificial Sequence
  PCR primer for ORF amplification
aattacatgactcgagtcaaaatcccaaaaagttgtataa

SEQ ID NO: 20953 - DNA, 40 bp, Artificial Sequence
  PCR primer for ORF amplification
aattacatgactcgagtcattggtttcttaaaactttagc

SEQ ID NO: 20954 - DNA, 40 bp, Artificial Sequence
  PCR primer for ORF amplification
aattacatgactcgagtcatgacttattttttttgtcgtc

SEQ ID NO: 20955 - DNA, 40 bp, Artificial Sequence
  PCR primer for ORF amplification
aattacatgactcgagttaattttcaatatcaaaactact

SEQ ID NO: 20956 - DNA, 40 bp, Artificial Sequence
  PCR primer for ORF amplification
aattacatgactcgagttagagcagtccatcaaggaaatc

SEQ ID NO: 20957 - DNA, 40 bp, Artificial Sequence
  PCR primer for ORF amplification
aattacatgactcgagtcatttgaaaatttccttgaattg

SEQ ID NO: 20958 - DNA, 40 bp, Artificial Sequence
  PCR primer for ORF amplification
aattacatgactcgagttatgtaatccatacccaaaaaaa

SEQ ID NO: 20959 - DNA, 40 bp, Artificial Sequence
  PCR primer for ORF amplification
aattacatgactcgagttaaccaaacgctacggatgcaca

SEQ ID NO: 20960 - DNA, 40 bp, Artificial Sequence
  PCR primer for ORF amplification
aattacatgactcgagctacttttttgaatttctattttt

SEQ ID NO: 20961 - DNA, 40 bp, Artificial Sequence
  PCR primer for ORF amplification
aattacatgactcgagttattgattacttaatcttctaat

SEQ ID NO: 20962 - DNA, 40 bp, Artificial Sequence
  PCR primer for ORF amplification
aattacatgactcgagctacctgcccatgttccgtctctt

SEQ ID NO: 20963 - DNA, 40 bp, Artificial Sequence
  PCR primer for ORF amplification
aattacatgactcgagctatccacctttcctaccatcgtc

SEQ ID NO: 20964 - DNA, 40 bp, Artificial Sequence
  PCR primer for ORF amplification
aattacatgactcgagtcacttatttgcagtggtctccct

SEQ ID NO: 20965 - DNA, 40 bp, Artificial Sequence
  PCR primer for ORF amplification
aattacatgactcgagtcatgctttgaatccatctaggat

SEQ ID NO: 20966 - DNA, 40 bp, Artificial Sequence
  PCR primer for ORF amplification
aattacatgactcgagttaaaattcgaccttttgtggaga

SEQ ID NO: 20967 - DNA, 40 bp, Artificial Sequence
  PCR primer for ORF amplification
aattacatgactcgagtcatttttctgcaaagataaaatc

SEQ ID NO: 20968 - DNA, 40 bp, Artificial Sequence
  PCR primer for ORF amplification
aattacatgactcgagtcattttttcaacgcttccttttg

SEQ ID NO: 20969 - DNA, 40 bp, Artificial Sequence
  PCR primer for ORF amplification
aattacatgactcgagctatttatttttaaatataaaatt

SEQ ID NO: 20970 - DNA, 40 bp, Artificial Sequence
  PCR primer for ORF amplification
aattacatgactcgagctacaatctactaaggcttaagct

SEQ ID NO: 20971 - DNA, 40 bp, Artificial Sequence
  PCR primer for ORF amplification
aattacatgactcgagtcattcagccttaacaccagcgtt

SEQ ID NO: 20972 - DNA, 40 bp, Artificial Sequence
  PCR primer for ORF amplification
aattacatgactcgagtcatattttcaaagaggtcttcaa

SEQ ID NO: 20973 - DNA, 40 bp, Artificial Sequence
  PCR primer for ORF amplification
aattacatgactcgagtcagttagaagaatgagaatattt

SEQ ID NO: 20974 - DNA, 40 bp, Artificial Sequence
  PCR primer for ORF amplification
aattacatgactcgagtcagcacaatggagttgttaattt

SEQ ID NO: 20975 - DNA, 40 bp, Artificial Sequence
  PCR primer for ORF amplification
aattacatgactcgagctatttgtcgtctttaatgatagc

SEQ ID NO: 20976 - DNA, 40 bp, Artificial Sequence
  PCR primer for ORF amplification
aattacatgactcgagttaatggcaggcgagggagctgtc

SEQ ID NO: 20977 - DNA, 40 bp, Artificial Sequence
  PCR primer for ORF amplification
aattacatgactcgagttaaaagacatctggcaatttttc

SEQ ID NO: 20978 - DNA, 40 bp, Artificial Sequence
  PCR primer for ORF amplification
aattacatgactcgagttaaacggaagacgttgttgctat

SEQ ID NO: 20979 - DNA, 40 bp, Artificial Sequence
  PCR primer for ORF amplification
aattacatgactcgagctatttgttccagtacgtcttgac

SEQ ID NO: 20980 - DNA, 40 bp, Artificial Sequence
  PCR primer for ORF amplification
aattacatgactcgagtcataagccttgctgtaacctttc

SEQ ID NO: 20981 - DNA, 40 bp, Artificial Sequence
  PCR primer for ORF amplification
aattacatgactcgagtcagttgctcttagcctgcacatc

SEQ ID NO: 20982 - DNA, 40 bp, Artificial Sequence
  PCR primer for ORF amplification
aattacatgactcgagtcaatcggaaaaccattgtaatcc

SEQ ID NO: 20983 - DNA, 40 bp, Artificial Sequence
  PCR primer for ORF amplification
aattacatgactcgagttactcggtttcatcttttttctc

SEQ ID NO: 20984 - DNA, 40 bp, Artificial Sequence
  PCR primer for ORF amplification
aattacatgactcgagtcatattaagccatcgtaaaggtt

SEQ ID NO: 20985 - DNA, 40 bp, Artificial Sequence
  PCR primer for ORF amplification
aattacatgactcgagctaagcatttttgtatttgtattt

SEQ ID NO: 20986 - DNA, 40 bp, Artificial Sequence
  PCR primer for ORF amplification
aattacatgactcgagctatgaaatgtactgagtcagagc

SEQ ID NO: 20987 - DNA, 40 bp, Artificial Sequence
  PCR primer for ORF amplification
aattacatgactcgagctaggctgtagacgactccttttt

SEQ ID NO: 20988 - DNA, 40 bp, Artificial Sequence
  PCR primer for ORF amplification
aattacatgactcgagttatttattcctcgttgtttcgat

SEQ ID NO: 20989 - DNA, 40 bp, Artificial Sequence
  PCR primer for ORF amplification
aattacatgactcgagttataaatcttcagtaataaaacc

SEQ ID NO: 20990 - DNA, 40 bp, Artificial Sequence
  PCR primer for ORF amplification
aattacatgactcgagttacatgtcttcgacaatgaaacc

SEQ ID NO: 20991 - DNA, 40 bp, Artificial Sequence
  PCR primer for ORF amplification
aattacatgactcgagctacaaaattgcacattttttact

SEQ ID NO: 20992 - DNA, 40 bp, Artificial Sequence
  PCR primer for ORF amplification
aattacatgactcgagttacataatagcattataaaacaa

SEQ ID NO: 20993 - DNA, 40 bp, Artificial Sequence
  PCR primer for ORF amplification
aattacatgactcgagtcagccattactgctaccattgtg

SEQ ID NO: 20994 - DNA, 40 bp, Artificial Sequence
  PCR primer for ORF amplification
aattacatgactcgagctagttgtcgtattcttccttaat

SEQ ID NO: 20995 - DNA, 40 bp, Artificial Sequence
  PCR primer for ORF amplification
aattacatgactcgagttaaaaatatagggatgaaaactc

SEQ ID NO: 20996 - DNA, 40 bp, Artificial Sequence
  PCR primer for ORF amplification
aattacatgactcgagttattgggtaaaatggcaggattc

SEQ ID NO: 20997 - DNA, 40 bp, Artificial Sequence
  PCR primer for ORF amplification
aattacatgactcgagtcagtttcttccaaatatatacaa

SEQ ID NO: 20998 - DNA, 40 bp, Artificial Sequence
  PCR primer for ORF amplification
aattacatgactcgagttataaaattatgcaacagttagc

SEQ ID NO: 20999 - DNA, 40 bp, Artificial Sequence
  PCR primer for ORF amplification
aattacatgactcgagttactcaatattcaaaactttact

SEQ ID NO: 21000 - DNA, 40 bp, Artificial Sequence
  PCR primer for ORF amplification
aattacatgactcgagttaagcggtgtcaagattatttaa

SEQ ID NO: 21001 - DNA, 40 bp, Artificial Sequence
  PCR primer for ORF amplification
aattacatgactcgagttattcaccgttatattcggccag

SEQ ID NO: 21002 - DNA, 40 bp, Artificial Sequence
  PCR primer for ORF amplification
aattacatgactcgagctaatcttcgccgatcggtatttc

SEQ ID NO: 21003 - DNA, 40 bp, Artificial Sequence
  PCR primer for ORF amplification
aattacatgactcgagtcagtgataaacgttgattacgtt

SEQ ID NO: 21004 - DNA, 40 bp, Artificial Sequence
  PCR primer for ORF amplification
aattacatgactcgagttaattgaagatttcaacatcgtt

SEQ ID NO: 21005 - DNA, 40 bp, Artificial Sequence
  PCR primer for ORF amplification
aattacatgactcgagttattttggaatttttcttaacaa

SEQ ID NO: 21006 - DNA, 40 bp, Artificial Sequence
  PCR primer for ORF amplification
aattacatgactcgagctatttagagtactgtttagcttg

SEQ ID NO: 21007 - DNA, 40 bp, Artificial Sequence
  PCR primer for ORF amplification
aattacatgactcgagttattttttaaacatccacctttt

SEQ ID NO: 21008 - DNA, 40 bp, Artificial Sequence
  PCR primer for ORF amplification
aattacatgactcgagctaacggtcttcagcccattcatt

SEQ ID NO: 21009 - DNA, 40 bp, Artificial Sequence
  PCR primer for ORF amplification
aattacatgactcgagtcattctaaactgaccttagctcc

SEQ ID NO: 21010 - DNA, 40 bp, Artificial Sequence
  PCR primer for ORF amplification
aattacatgactcgagtcattttttagaggtggcaaaatt

SEQ ID NO: 21011 - DNA, 40 bp, Artificial Sequence
  PCR primer for ORF amplification
aattacatgactcgagttaacgtgagtaagaccagacgtt

SEQ ID NO: 21012 - DNA, 40 bp, Artificial Sequence
  PCR primer for ORF amplification
aattacatgactcgagttaaaatcttacatcatgtggata

SEQ ID NO: 21013 - DNA, 40 bp, Artificial Sequence
  PCR primer for ORF amplification
aattacatgactcgagttacttctctccaaacatgtgaag

SEQ ID NO: 21014 - DNA, 40 bp, Artificial Sequence
  PCR primer for ORF amplification
aattacatgactcgagtcacgcctggtaccacaggagttt

SEQ ID NO: 21015 - DNA, 40 bp, Artificial Sequence
  PCR primer for ORF amplification
aattacatgactcgagctaatcggagccttctagtttggc

SEQ ID NO: 21016 - DNA, 40 bp, Artificial Sequence
  PCR primer for ORF amplification
aattacatgactcgagttaaacgtaggattgaggcggtgg

SEQ ID NO: 21017 - DNA, 40 bp, Artificial Sequence
  PCR primer for ORF amplification
aattacatgactcgagttagatgataatacaaacgtcgcc

SEQ ID NO: 21018 - DNA, 40 bp, Artificial Sequence
  PCR primer for ORF amplification
aattacatgactcgagctacttttgcctcttcttcgagac

SEQ ID NO: 21019 - DNA, 40 bp, Artificial Sequence
  PCR primer for ORF amplification
aattacatgactcgagttagtattgaacaccaatcaagta

SEQ ID NO: 21020 - DNA, 40 bp, Artificial Sequence
  PCR primer for ORF amplification
aattacatgactcgagtcaaccgtgctgtttagcctcctt

SEQ ID NO: 21021 - DNA, 40 bp, Artificial Sequence
  PCR primer for ORF amplification
aattacatgactcgagttactgagccagtaaatacgttcc

SEQ ID NO: 21022 - DNA, 40 bp, Artificial Sequence
  PCR primer for ORF amplification
aattacatgactcgagtcatacggaattggagagcatttg

SEQ ID NO: 21023 - DNA, 40 bp, Artificial Sequence
  PCR primer for ORF amplification
aattacatgactcgagttattttcttttaaaacctggtgg

SEQ ID NO: 21024 - DNA, 40 bp, Artificial Sequence
  PCR primer for ORF amplification
aattacatgactcgagttatttacgtgccttctttttttt

SEQ ID NO: 21025 - DNA, 40 bp, Artificial Sequence
  PCR primer for ORF amplification
aattacatgactcgagctattctatacaggtttcctcatc

SEQ ID NO: 21026 - DNA, 40 bp, Artificial Sequence
  PCR primer for ORF amplification
aattacatgactcgagttacgtttgctcaaggttttgaac

SEQ ID NO: 21027 - DNA, 40 bp, Artificial Sequence
  PCR primer for ORF amplification
aattacatgactcgagtcattttcgatagtttgtagttgt

SEQ ID NO: 21028 - DNA, 40 bp, Artificial Sequence
  PCR primer for ORF amplification
aattacatgactcgagttaattattggcatttttgaaata

SEQ ID NO: 21029 - DNA, 40 bp, Artificial Sequence
  PCR primer for ORF amplification
aattacatgactcgagttatttgttggcagcttcgaagta

SEQ ID NO: 21030 - DNA, 40 bp, Artificial Sequence
  PCR primer for ORF amplification
aattacatgactcgagtcaactgttgtccttgcagaattg

SEQ ID NO: 21031 - DNA, 40 bp, Artificial Sequence
  PCR primer for ORF amplification
aattacatgactcgagttaatatttatagctgacctgcgc

SEQ ID NO: 21032 - DNA, 40 bp, Artificial Sequence
  PCR primer for ORF amplification
aattacatgactcgagtcatattggttgcttggcagtgag

SEQ ID NO: 21033 - DNA, 40 bp, Artificial Sequence
  PCR primer for ORF amplification
aattacatgactcgagttattcgaccacgggtggataatg

SEQ ID NO: 21034 - DNA, 40 bp, Artificial Sequence
  PCR primer for ORF amplification
aattacatgactcgagctaaaagtcattttgatacaagta

SEQ ID NO: 21035 - DNA, 40 bp, Artificial Sequence
  PCR primer for ORF amplification
aattacatgactcgagttatttcttcttcattctaccaaa

SEQ ID NO: 21036 - DNA, 40 bp, Artificial Sequence
  PCR primer for ORF amplification
aattacatgactcgagttaaattggtgtcttggtattttc

SEQ ID NO: 21037 - DNA, 40 bp, Artificial Sequence
  PCR primer for ORF amplification
aattacatgactcgagctatgcatggcgaaccgattttgt

SEQ ID NO: 21038 - DNA, 40 bp, Artificial Sequence
  PCR primer for ORF amplification
aattacatgactcgagctactcactgtcttcatcgtcttc

SEQ ID NO: 21039 - DNA, 40 bp, Artificial Sequence
  PCR primer for ORF amplification
aattacatgactcgagctagataaattgtccttccccata

SEQ ID NO: 21040 - DNA, 40 bp, Artificial Sequence
  PCR primer for ORF amplification
aattacatgactcgagtcacaaaaattctttggctttctt

SEQ ID NO: 21041 - DNA, 40 bp, Artificial Sequence
  PCR primer for ORF amplification
aattacatgactcgagctaagacgtgatagagctggtgat

SEQ ID NO: 21042 - DNA, 40 bp, Artificial Sequence
  PCR primer for ORF amplification
aattacatgactcgagtcaacttttcataaaactttctaa

SEQ ID NO: 21043 - DNA, 40 bp, Artificial Sequence
  PCR primer for ORF amplification
aattacatgactcgagtcatttgttagcatttaaacttgc

SEQ ID NO: 21044 - DNA, 40 bp, Artificial Sequence
  PCR primer for ORF amplification
aattacatgactcgagtcaggcaagtggctcgaaaccgtg

SEQ ID NO: 21045 - DNA, 40 bp, Artificial Sequence
  PCR primer for ORF amplification
aattacatgactcgagtcaaaactttgcaacggtttcgta

SEQ ID NO: 21046 - DNA, 40 bp, Artificial Sequence
  PCR primer for ORF amplification
aattacatgactcgagtcactgtgcctggaagtcatctac

SEQ ID NO: 21047 - DNA, 40 bp, Artificial Sequence
  PCR primer for ORF amplification
aattacatgactcgagttaattaggcatcgcattttcaaa

SEQ ID NO: 21048 - DNA, 40 bp, Artificial Sequence
  PCR primer for ORF amplification
aattacatgactcgagctaaaatttcagcaaaagatcgtt

SEQ ID NO: 21049 - DNA, 40 bp, Artificial Sequence
  PCR primer for ORF amplification
aattacatgactcgagctaactcaaatcatgtaaagcttt

SEQ ID NO: 21050 - DNA, 40 bp, Artificial Sequence
  PCR primer for ORF amplification
aattacatgactcgagttaccaggattgagcctgattttg

SEQ ID NO: 21051 - DNA, 40 bp, Artificial Sequence
  PCR primer for ORF amplification
aattacatgactcgagctaatggtcaatggtaggtttaga

SEQ ID NO: 21052 - DNA, 40 bp, Artificial Sequence
  PCR primer for ORF amplification
aattacatgactcgagctaatagcgttgaggctgggtgat

SEQ ID NO: 21053 - DNA, 40 bp, Artificial Sequence
  PCR primer for ORF amplification
aattacatgactcgagttattcattaaaagcaaccaccaa

SEQ ID NO: 21054 - DNA, 40 bp, Artificial Sequence
  PCR primer for ORF amplification
aattacatgactcgagtcataaagttaataaataagtacc

SEQ ID NO: 21055 - DNA, 40 bp, Artificial Sequence
  PCR primer for ORF amplification
aattacatgactcgagttacttggcagctccttctgcagc

SEQ ID NO: 21056 - DNA, 40 bp, Artificial Sequence
  PCR primer for ORF amplification
aattacatgactcgagtcatttataaatcggtggtcttga

SEQ ID NO: 21057 - DNA, 40 bp, Artificial Sequence
  PCR primer for ORF amplification
aattacatgactcgagttaccttggcacttggccattcac

SEQ ID NO: 21058 - DNA, 40 bp, Artificial Sequence
  PCR primer for ORF amplification
aattacatgactcgagctaaaaagcaattttctttgtatt

SEQ ID NO: 21059 - DNA, 40 bp, Artificial Sequence
  PCR primer for ORF amplification
aattacatgactcgagttaacatatacagccactgccgct

SEQ ID NO: 21060 - DNA, 40 bp, Artificial Sequence
  PCR primer for ORF amplification
aattacatgactcgagtcacaagttttccagagatgcagc

SEQ ID NO: 21061 - DNA, 40 bp, Artificial Sequence
  PCR primer for ORF amplification
aattacatgactcgagttatatcttgaggtttttagtccc

SEQ ID NO: 21062 - DNA, 40 bp, Artificial Sequence
  PCR primer for ORF amplification
aattacatgactcgagttattgtctctggaaaaacgattg

SEQ ID NO: 21063 - DNA, 40 bp, Artificial Sequence
  PCR primer for ORF amplification
aattacatgactcgagctaaataggcctagcatccaccgt

SEQ ID NO: 21064 - DNA, 40 bp, Artificial Sequence
  PCR primer for ORF amplification
aattacatgactcgagttactttcttctgaaagatgtacc

SEQ ID NO: 21065 - DNA, 40 bp, Artificial Sequence
  PCR primer for ORF amplification
aattacatgactcgagtcaccaacgtgaaccgccattgaa

SEQ ID NO: 21066 - DNA, 40 bp, Artificial Sequence
  PCR primer for ORF amplification
aattacatgactcgagctatttcttagcagtcaatcttct

SEQ ID NO: 21067 - DNA, 40 bp, Artificial Sequence
  PCR primer for ORF amplification
aattacatgactcgagctatgtggagaatgtaaggcgtgg

SEQ ID NO: 21068 - DNA, 40 bp, Artificial Sequence
  PCR primer for ORF amplification
aattacatgactcgagctacatgatgatgcaacacgaatt

SEQ ID NO: 21069 - DNA, 40 bp, Artificial Sequence
  PCR primer for ORF amplification
aattacatgactcgagctaaactatatctctccgttgtcc

SEQ ID NO: 21070 - DNA, 40 bp, Artificial Sequence
  PCR primer for ORF amplification
aattacatgactcgagttatgagtattgctcttgccataa

SEQ ID NO: 21071 - DNA, 40 bp, Artificial Sequence
  PCR primer for ORF amplification
aattacatgactcgagtcattttgttaatagttttttgta

SEQ ID NO: 21072 - DNA, 40 bp, Artificial Sequence
  PCR primer for ORF amplification
aattacatgactcgagttaactcttccctttacttagaaa

SEQ ID NO: 21073 - DNA, 40 bp, Artificial Sequence
  PCR primer for ORF amplification
aattacatgactcgagttagtctttatttatattcagttt

SEQ ID NO: 21074 - DNA, 40 bp, Artificial Sequence
  PCR primer for ORF amplification
aattacatgactcgagctattggacagatggacctgggtt

SEQ ID NO: 21075 - DNA, 40 bp, Artificial Sequence
  PCR primer for ORF amplification
aattacatgactcgagttacacatcgtattgcaatgtcag

SEQ ID NO: 21076 - DNA, 40 bp, Artificial Sequence
  PCR primer for ORF amplification
aattacatgactcgagtcattccaagacgtttttgtccat

SEQ ID NO: 21077 - DNA, 40 bp, Artificial Sequence
  PCR primer for ORF amplification
aattacatgactcgagttattcgcatacaacgccaatgaa

SEQ ID NO: 21078 - DNA, 40 bp, Artificial Sequence
  PCR primer for ORF amplification
aattacatgactcgagttatccgaatatgccatcaatggc

SEQ ID NO: 21079 - DNA, 40 bp, Artificial Sequence
  PCR primer for ORF amplification
aattacatgactcgagtcaaccccgaaattccatcttgaa

SEQ ID NO: 21080 - DNA, 40 bp, Artificial Sequence
  PCR primer for ORF amplification
aattacatgactcgagtcaatagttttccttcaattccaa

SEQ ID NO: 21081 - DNA, 40 bp, Artificial Sequence
  PCR primer for ORF amplification
aattacatgactcgagtcaagctaaaaaagctaactcagc

SEQ ID NO: 21082 - DNA, 40 bp, Artificial Sequence
  PCR primer for ORF amplification
aattacatgactcgagctaaggatcggtgcttttcgtatg

SEQ ID NO: 21083 - DNA, 40 bp, Artificial Sequence
  PCR primer for ORF amplification
aattacatgactcgagctaagcctttttgttgatttcttg

SEQ ID NO: 21084 - DNA, 40 bp, Artificial Sequence
  PCR primer for ORF amplification
aattacatgactcgagttacatgtcatagttgaaatcaac

SEQ ID NO: 21085 - DNA, 40 bp, Artificial Sequence
  PCR primer for ORF amplification
aattacatgactcgagctacgtgtaggctgccaaattgta

SEQ ID NO: 21086 - DNA, 40 bp, Artificial Sequence
  PCR primer for ORF amplification
aattacatgactcgagttaataattgaatttaattttact

SEQ ID NO: 21087 - DNA, 40 bp, Artificial Sequence
  PCR primer for ORF amplification
aattacatgactcgagttagctatgttttctgtctgactg

SEQ ID NO: 21088 - DNA, 40 bp, Artificial Sequence
  PCR primer for ORF amplification
aattacatgactcgagttattttttgacaatttcgacccc

SEQ ID NO: 21089 - DNA, 40 bp, Artificial Sequence
  PCR primer for ORF amplification
aattacatgactcgagttacaaatgcttacggatgatttt

SEQ ID NO: 21090 - DNA, 40 bp, Artificial Sequence
  PCR primer for ORF amplification
aattacatgactcgagctagctgtatatagtttcaactag

SEQ ID NO: 21091 - DNA, 40 bp, Artificial Sequence
  PCR primer for ORF amplification
aattacatgactcgagttaaacaaccttaatggcaattac

SEQ ID NO: 21092 - DNA, 40 bp, Artificial Sequence
  PCR primer for ORF amplification
aattacatgactcgagtcaaacagtttcttcatcaaatac

SEQ ID NO: 21093 - DNA, 40 bp, Artificial Sequence
  PCR primer for ORF amplification
aattacatgactcgagttaatgagaaccagcgcctctgct

SEQ ID NO: 21094 - DNA, 40 bp, Artificial Sequence
  PCR primer for ORF amplification
aattacatgactcgagttacaaaccggaaacagaaccacc

SEQ ID NO: 21095 - DNA, 40 bp, Artificial Sequence
  PCR primer for ORF amplification
aattacatgactcgagtcaatttaattgcccggttttacc

SEQ ID NO: 21096 - DNA, 40 bp, Artificial Sequence
  PCR primer for ORF amplification
aattacatgactcgagttattttggaacggaggggaacac

SEQ ID NO: 21097 - DNA, 40 bp, Artificial Sequence
  PCR primer for ORF amplification
aattacatgactcgagttacttcttttccaaatgtttttt

SEQ ID NO: 21098 - DNA, 40 bp, Artificial Sequence
  PCR primer for ORF amplification
aattacatgactcgagttaacctttcatgtaagcatctaa

SEQ ID NO: 21099 - DNA, 40 bp, Artificial Sequence
  PCR primer for ORF amplification
aattacatgactcgagtcaagtcagcaaactttgcaaatc

SEQ ID NO: 21100 - DNA, 40 bp, Artificial Sequence
  PCR primer for ORF amplification
aattacatgactcgagttagactagagatgtgacctcaaa

SEQ ID NO: 21101 - DNA, 40 bp, Artificial Sequence
  PCR primer for ORF amplification
aattacatgactcgagctaggcactctcagattgcgaatt

SEQ ID NO: 21102 - DNA, 40 bp, Artificial Sequence
  PCR primer for ORF amplification
aattacatgactcgagttatttttttgcatcgctatcatc

SEQ ID NO: 21103 - DNA, 40 bp, Artificial Sequence
  PCR primer for ORF amplification
aattacatgactcgagtcatatttggctttctaagtcttt

SEQ ID NO: 21104 - DNA, 40 bp, Artificial Sequence
  PCR primer for ORF amplification
aattacatgactcgagtcataaggcattcttcatatttct

SEQ ID NO: 21105 - DNA, 40 bp, Artificial Sequence
  PCR primer for ORF amplification
aattacatgactcgagttagttagaggaaactaaacttcc

SEQ ID NO: 21106 - DNA, 40 bp, Artificial Sequence
  PCR primer for ORF amplification
aattacatgactcgagctaatttatttcttcttgcaacga

SEQ ID NO: 21107 - DNA, 40 bp, Artificial Sequence
  PCR primer for ORF amplification
aattacatgactcgagttaaactggttgtactgtttggcc

SEQ ID NO: 21108 - DNA, 40 bp, Artificial Sequence
  PCR primer for ORF amplification
aattacatgactcgagttacaataacatgacggcagcaag

SEQ ID NO: 21109 - DNA, 40 bp, Artificial Sequence
  PCR primer for ORF amplification
aattacatgactcgagttataatagtaataaggcaccggc

SEQ ID NO: 21110 - DNA, 40 bp, Artificial Sequence
  PCR primer for ORF amplification
aattacatgactcgagctatttcagtacctggtacgtgtc

SEQ ID NO: 21111 - DNA, 40 bp, Artificial Sequence
  PCR primer for ORF amplification
aattacatgactcgagctataagctatcacggatagcgtc

SEQ ID NO: 21112 - DNA, 40 bp, Artificial Sequence
  PCR primer for ORF amplification
aattacatgactcgagctattgagcaaatgagactttttt

SEQ ID NO: 21113 - DNA, 40 bp, Artificial Sequence
  PCR primer for ORF amplification
aattacatgactcgagtcattttctatacctccataacga

SEQ ID NO: 21114 - DNA, 40 bp, Artificial Sequence
  PCR primer for ORF amplification
aattacatgactcgagttagtgtggccgtaagctgtcaat

SEQ ID NO: 21115 - DNA, 40 bp, Artificial Sequence
  PCR primer for ORF amplification
aattacatgactcgagttattttctgtatctccacaagga

SEQ ID NO: 21116 - DNA, 40 bp, Artificial Sequence
  PCR primer for ORF amplification
aattacatgactcgagtcagcccctcaatgctcttagtct

SEQ ID NO: 21117 - DNA, 40 bp, Artificial Sequence
  PCR primer for ORF amplification
aattacatgactcgagttatacattcatgaagatgagttc

SEQ ID NO: 21118 - DNA, 40 bp, Artificial Sequence
  PCR primer for ORF amplification
aattacatgactcgagtcagtagtatatccagccgacgag

SEQ ID NO: 21119 - DNA, 40 bp, Artificial Sequence
  PCR primer for ORF amplification
aattacatgactcgagtcaagaagagagctcaggcgtcca

SEQ ID NO: 21120 - DNA, 40 bp, Artificial Sequence
  PCR primer for ORF amplification
aattacatgactcgagctagtgctttcttcttccttttgg

SEQ ID NO: 21121 - DNA, 40 bp, Artificial Sequence
  PCR primer for ORF amplification
aattacatgactcgagttatcttctacctcctctgaaacc

SEQ ID NO: 21122 - DNA, 40 bp, Artificial Sequence
  PCR primer for ORF amplification
aattacatgactcgagttaaacctcgtcaccgcctgacga

SEQ ID NO: 21123 - DNA, 40 bp, Artificial Sequence
  PCR primer for ORF amplification
aattacatgactcgagtcaccagaacttgtaccatttctt

SEQ ID NO: 21124 - DNA, 40 bp, Artificial Sequence
  PCR primer for ORF amplification
aattacatgactcgagttactcagtcttttgatcagctcc

SEQ ID NO: 21125 - DNA, 40 bp, Artificial Sequence
  PCR primer for ORF amplification
aattacatgactcgagtcaatcttgtctcatcttcaagta

SEQ ID NO: 21126 - DNA, 40 bp, Artificial Sequence
  PCR primer for ORF amplification
aattacatgactcgagttacatattctttttggccttatc

SEQ ID NO: 21127 - DNA, 40 bp, Artificial Sequence
  PCR primer for ORF amplification
aattacatgactcgagtcaacagcagcccccaccggtgtt

SEQ ID NO: 21128 - DNA, 40 bp, Artificial Sequence
  PCR primer for ORF amplification
aattacatgactcgagttagtttcctttcttggaagcttc

SEQ ID NO: 21129 - DNA, 40 bp, Artificial Sequence
  PCR primer for ORF amplification
aattacatgactcgagtcaagcaaaaccagcgtctggtgg

SEQ ID NO: 21130 - DNA, 40 bp, Artificial Sequence
  PCR primer for ORF amplification
aattacatgactcgagttaatcaaaaccagcttctggtgg

SEQ ID NO: 21131 - DNA, 40 bp, Artificial Sequence
  PCR primer for ORF amplification
aattacatgactcgagtcattcttgaacactttccaaagg

SEQ ID NO: 21132 - DNA, 40 bp, Artificial Sequence
  PCR primer for ORF amplification
aattacatgactcgagttatttcatcttttttttgctttt

SEQ ID NO: 21133 - DNA, 40 bp, Artificial Sequence
  PCR primer for ORF amplification
aattacatgactcgagttagtaatatgaaggagcgtataa

SEQ ID NO: 21134 - DNA, 40 bp, Artificial Sequence
  PCR primer for ORF amplification
aattacatgactcgagctaacgataaaagtctgggcgacc

SEQ ID NO: 21135 - DNA, 40 bp, Artificial Sequence
  PCR primer for ORF amplification
aattacatgactcgagttaatcttcttcactagagtcttc

SEQ ID NO: 21136 - DNA, 40 bp, Artificial Sequence
  PCR primer for ORF amplification
aattacatgactcgagctaattgactaatcttccatcatt

SEQ ID NO: 21137 - DNA, 40 bp, Artificial Sequence
  PCR primer for ORF amplification
aattacatgactcgagttattggacggatggacctgggtt

SEQ ID NO: 21138 - DNA, 40 bp, Artificial Sequence; identical to SEQ ID NO: 20380
  PCR primer for ORF amplification

SEQ ID NO: 21139 - DNA, 40 bp, Artificial Sequence
  PCR primer for ORF amplification
aattacatgactcgagttacctagctgttggatttgctgt

SEQ ID NO: 21140 - DNA, 40 bp, Artificial Sequence
  PCR primer for ORF amplification
aattacatgactcgagttatttcttaataaggtgctttaa

SEQ ID NO: 21141 - DNA, 40 bp, Artificial Sequence
  PCR primer for ORF amplification
aattacatgactcgagctatacgtagtttttttggcgact

SEQ ID NO: 21142 - DNA, 40 bp, Artificial Sequence
  PCR primer for ORF amplification
aattacatgactcgagctatgttaataacctcatatatgc

SEQ ID NO: 21143 - DNA, 40 bp, Artificial Sequence
  PCR primer for ORF amplification
aattacatgactcgagtcattctttaaaatcgttttgagg

SEQ ID NO: 21144 - DNA, 40 bp, Artificial Sequence
  PCR primer for ORF amplification
aattacatgactcgagtcacggagagccttctttagaaga

SEQ ID NO: 21145 - DNA, 40 bp, Artificial Sequence
  PCR primer for ORF amplification
aattacatgactcgagttaaccgtacataccccaatcttc

SEQ ID NO: 21146 - DNA, 40 bp, Artificial Sequence
  PCR primer for ORF amplification
aattacatgactcgagttaagcagaagccttagaagcaga

SEQ ID NO: 21147 - DNA, 40 bp, Artificial Sequence
  PCR primer for ORF amplification
aattacatgactcgagtcaaacttcaccgtttataattgc

SEQ ID NO: 21148 - DNA, 40 bp, Artificial Sequence
  PCR primer for ORF amplification
aattacatgactcgagtcaatacaatttcaaatcacctgt

SEQ ID NO: 21149 - DNA, 40 bp, Artificial Sequence
  PCR primer for ORF amplification
aattacatgactcgagtcatacttccagttgcatatcgtc

SEQ ID NO: 21150 - DNA, 40 bp, Artificial Sequence
  PCR primer for ORF amplification
aattacatgactcgagtcacgtatgagagttcggatacga

SEQ ID NO: 21151 - DNA, 40 bp, Artificial Sequence
  PCR primer for ORF amplification
aattacatgactcgagtcatatcttctgcaaataaccttg

SEQ ID NO: 21152 - DNA, 40 bp, Artificial Sequence
  PCR primer for ORF amplification
aattacatgactcgagctactgaggtacgtagttatcatc

SEQ ID NO: 21153 - DNA, 40 bp, Artificial Sequence
  PCR primer for ORF amplification
aattacatgactcgagtcaacagctacaagaattattttc

SEQ ID NO: 21154 - DNA, 40 bp, Artificial Sequence
  PCR primer for ORF amplification
aattacatgactcgagttatttcttcaaatattgggccaa

SEQ ID NO: 21155 - DNA, 40 bp, Artificial Sequence
  PCR primer for ORF amplification
aattacatgactcgagtcacggtacttttctataactgtt

SEQ ID NO: 21156 - DNA, 40 bp, Artificial Sequence
  PCR primer for ORF amplification
aattacatgactcgagctaacggcttttcttacataggag

SEQ ID NO: 21157 - DNA, 40 bp, Artificial Sequence
  PCR primer for ORF amplification
aattacatgactcgagttactcatcttcatagacgtggaa

SEQ ID NO: 21158 - DNA, 40 bp, Artificial Sequence
  PCR primer for ORF amplification
aattacatgactcgagtcacattatagaacatttattatt

SEQ ID NO: 21159 - DNA, 40 bp, Artificial Sequence
  PCR primer for ORF amplification
aattacatgactcgagtcagtcatgaccttgagccttagc

SEQ ID NO: 21160 - DNA, 40 bp, Artificial Sequence
  PCR primer for ORF amplification
aattacatgactcgagctataacaagacacacttcttctt

SEQ ID NO: 21161 - DNA, 40 bp, Artificial Sequence; identical to SEQ ID NO: 20456
  PCR primer for ORF amplification

SEQ ID NO: 21162 - DNA, 40 bp, Artificial Sequence
  PCR primer for ORF amplification
aattacatgactcgagtcataaattcaaatattcaatata

SEQ ID NO: 21163 - DNA, 40 bp, Artificial Sequence
  PCR primer for ORF amplification
aattacatgactcgagctaacaactgcaagcactgtttgc

SEQ ID NO: 21164 - DNA, 40 bp, Artificial Sequence
  PCR primer for ORF amplification
aattacatgactcgagttaaaatccataatcgttattgcg

SEQ ID NO: 21165 - DNA, 40 bp, Artificial Sequence
  PCR primer for ORF amplification
aattacatgactcgagtcacttactcactttcgctcttgc

SEQ ID NO: 21166 - DNA, 40 bp, Artificial Sequence
  PCR primer for ORF amplification
aattacatgactcgagttacaaatctttgatacggtcgta

SEQ ID NO: 21167 - DNA, 40 bp, Artificial Sequence
  PCR primer for ORF amplification
aattacatgactcgagtcaagtgtgcacattgctgctatg

SEQ ID NO: 21168 - DNA, 40 bp, Artificial Sequence
  PCR primer for ORF amplification
aattacatgactcgagtcaccaactggtcgaattagtaat

SEQ ID NO: 21169 - DNA, 40 bp, Artificial Sequence
  PCR primer for ORF amplification
aattacatgactcgagtcattgtttttgcagcttgataac

SEQ ID NO: 21170 - DNA, 40 bp, Artificial Sequence
  PCR primer for ORF amplification
aattacatgactcgagttataacaataaagcagctgcacc

SEQ ID NO: 21171 - DNA, 40 bp, Artificial Sequence
  PCR primer for ORF amplification
aattacatgactcgagctattttttggcgttcttcctctt

SEQ ID NO: 21172 - DNA, 40 bp, Artificial Sequence
  PCR primer for ORF amplification
aattacatgactcgagttatttttttgcgtttggtgaagc

SEQ ID NO: 21173 - DNA, 40 bp, Artificial Sequence
  PCR primer for ORF amplification
aattacatgactcgagttaactggaggatagtctaaacca

SEQ ID NO: 21174 - DNA, 40 bp, Artificial Sequence
  PCR primer for ORF amplification
aattacatgactcgagctatagcgtttcattctctgatgt

SEQ ID NO: 21175 - DNA, 40 bp, Artificial Sequence
  PCR primer for ORF amplification
aattacatgactcgagttaaatgatatgtttcgttttgaa

SEQ ID NO: 21176 - DNA, 40 bp, Artificial Sequence
  PCR primer for ORF amplification
aattacatgactcgagttaaaaaaagtccaacgatgtcct

SEQ ID NO: 21177 - DNA, 40 bp, Artificial Sequence
  PCR primer for ORF amplification
aattacatgactcgagtcatatatgctcctttctatctct

SEQ ID NO: 21178 - DNA, 40 bp, Artificial Sequence
  PCR primer for ORF amplification
aattacatgactcgagttagggtgtttcagtgttgcggaa

SEQ ID NO: 21179 - DNA, 40 bp, Artificial Sequence
  PCR primer for ORF amplification
aattacatgactcgagttattgaaaccaatgtatggatcc

SEQ ID NO: 21180 - DNA, 40 bp, Artificial Sequence
  PCR primer for ORF amplification
aattacatgactcgagttaaaagtcactaccgtcaaatcc

SEQ ID NO: 21181 - DNA, 40 bp, Artificial Sequence
  PCR primer for ORF amplification
aattacatgactcgagtcatttacgattgtatagagtgaa

SEQ ID NO: 21182 - DNA, 40 bp, Artificial Sequence
  PCR primer for ORF amplification
aattacatgactcgagttaatcatcgtcatcagtatcgaa

SEQ ID NO: 21183 - DNA, 40 bp, Artificial Sequence
  PCR primer for ORF amplification
aattacatgactcgagttatactaccttctgtttgacaaa

SEQ ID NO: 21184 - DNA, 40 bp, Artificial Sequence
  PCR primer for ORF amplification
aattacatgactcgagttatttggccagagaccagccttt

SEQ ID NO: 21185 - DNA, 40 bp, Artificial Sequence
  PCR primer for ORF amplification
aattacatgactcgagttaatctatatccatgtaatcgtt

SEQ ID NO: 21186 - DNA, 40 bp, Artificial Sequence
  PCR primer for ORF amplification
aattacatgactcgagtcaacaggttccatttaccttgat

SEQ ID NO: 21187 - DNA, 40 bp, Artificial Sequence
  PCR primer for ORF amplification
aattacatgactcgagctacgtctctagtctctcatacaa

SEQ ID NO: 21188 - DNA, 40 bp, Artificial Sequence
  PCR primer for ORF amplification
aattacatgactcgagctattcttcaacatcgtctggcag

SEQ ID NO: 21189 - DNA, 40 bp, Artificial Sequence
  PCR primer for ORF amplification
aattacatgactcgagttaaatgctgtcctctaagacctt

SEQ ID NO: 21190 - DNA, 40 bp, Artificial Sequence
  PCR primer for ORF amplification
aattacatgactcgagtcattcccaccaactaacgagtcc

SEQ ID NO: 21191 - DNA, 40 bp, Artificial Sequence
  PCR primer for ORF amplification
aattacatgactcgagctagtatttcaaattaccttgttt

SEQ ID NO: 21192 - DNA, 40 bp, Artificial Sequence
  PCR primer for ORF amplification
aattacatgactcgagttactgaaattcagaagctttacc

SEQ ID NO: 21193 - DNA, 40 bp, Artificial Sequence
  PCR primer for ORF amplification
aattacatgactcgagttatttcaacatgttgtgctttaa

SEQ ID NO: 21194 - DNA, 40 bp, Artificial Sequence
  PCR primer for ORF amplification
aattacatgactcgagctacatcaacagatcgtccaaact

SEQ ID NO: 21195 - DNA, 40 bp, Artificial Sequence
  PCR primer for ORF amplification
aattacatgactcgagtcagaattgcaatctgtccattag

SEQ ID NO: 21196 - DNA, 40 bp, Artificial Sequence
  PCR primer for ORF amplification
aattacatgactcgagtcattcgaataatgaatctgcata

SEQ ID NO: 21197 - DNA, 40 bp, Artificial Sequence
  PCR primer for ORF amplification
aattacatgactcgagtcatgaccttgcatttacctttgc

SEQ ID NO: 21198 - DNA, 40 bp, Artificial Sequence
  PCR primer for ORF amplification
aattacatgactcgagtcactttcctaatctttcccagat

SEQ ID NO: 21199 - DNA, 40 bp, Artificial Sequence
  PCR primer for ORF amplification
aattacatgactcgagttaaatattgaattcttcttcatc

SEQ ID NO: 21200 - DNA, 40 bp, Artificial Sequence
  PCR primer for ORF amplification
aattacatgactcgagttacaaggtgattgatggttgagg

SEQ ID NO: 21201 - DNA, 40 bp, Artificial Sequence
  PCR primer for ORF amplification
aattacatgactcgagttattgtttcgagcccaaatgctt

SEQ ID NO: 21202 - DNA, 40 bp, Artificial Sequence
  PCR primer for ORF amplification
aattacatgactcgagctatgcaactcgttttgaaggctc

SEQ ID NO: 21203 - DNA, 40 bp, Artificial Sequence
  PCR primer for ORF amplification
aattacatgactcgagttaccctttattcaaagcctttct

SEQ ID NO: 21204 - DNA, 40 bp, Artificial Sequence
  PCR primer for ORF amplification
aattacatgactcgagctatttgaggaagatccaccagaa

SEQ ID NO: 21205 - DNA, 40 bp, Artificial Sequence
  PCR primer for ORF amplification
aattacatgactcgagttatttgtgaagctgctgtaaaac

SEQ ID NO: 21206 - DNA, 40 bp, Artificial Sequence
  PCR primer for ORF amplification
aattacatgactcgagttagttaccccacgattcttgaga

SEQ ID NO: 21207 - DNA, 40 bp, Artificial Sequence
  PCR primer for ORF amplification
aattacatgactcgagttatttgattttcttgtcctttag

SEQ ID NO: 21208 - DNA, 40 bp, Artificial Sequence
  PCR primer for ORF amplification
aattacatgactcgagttactccttcaaactgtcgaaaaa

SEQ ID NO: 21209 - DNA, 40 bp, Artificial Sequence
  PCR primer for ORF amplification
aattacatgactcgagctaacactgacaagcgctttgttc

SEQ ID NO: 21210 - DNA, 40 bp, Artificial Sequence
  PCR primer for ORF amplification
aattacatgactcgagtcagatgcgcagaacacctcttgc

SEQ ID NO: 21211 - DNA, 40 bp, Artificial Sequence
  PCR primer for ORF amplification
aattacatgactcgagttaggcgttgtaacaagattcaaa

SEQ ID NO: 21212 - DNA, 40 bp, Artificial Sequence
  PCR primer for ORF amplification
aattacatgactcgagttaaacgtaatttttttgacgacc

SEQ ID NO: 21213 - DNA, 40 bp, Artificial Sequence
  PCR primer for ORF amplification
aattacatgactcgagctacatacagattctgtaactggc

SEQ ID NO: 21214 - DNA, 40 bp, Artificial Sequence
  PCR primer for ORF amplification
aattacatgactcgagttattctgatccttttgattccct

SEQ ID NO: 21215 - DNA, 40 bp, Artificial Sequence
  PCR primer for ORF amplification
aattacatgactcgagtcagtgatagaatctaaaatcgag

SEQ ID NO: 21216 - DNA, 40 bp, Artificial Sequence
  PCR primer for ORF amplification
aattacatgactcgagtcattcttctttaaacttttcagc

SEQ ID NO: 21217 - DNA, 40 bp, Artificial Sequence
  PCR primer for ORF amplification
aattacatgactcgagtcaacagcaatttgatttagaact

SEQ ID NO: 21218 - DNA, 40 bp, Artificial Sequence
  PCR primer for ORF amplification
aattacatgactcgagtcacttcaacaattcctcgatgat

SEQ ID NO: 21219 - DNA, 40 bp, Artificial Sequence
  PCR primer for ORF amplification
aattacatgactcgagttaaaagatattattaacaatatc

SEQ ID NO: 21220 - DNA, 40 bp, Artificial Sequence
  PCR primer for ORF amplification
aattacatgactcgagctaaccaacaatgaccttatcacc

SEQ ID NO: 21221 - DNA, 40 bp, Artificial Sequence
  PCR primer for ORF amplification
aattacatgactcgagttacagtgtaatcttgcttagaac

SEQ ID NO: 21222 - DNA, 40 bp, Artificial Sequence
  PCR primer for ORF amplification
aattacatgactcgagtcatctatcatctgttagtctttg

SEQ ID NO: 21223 - DNA, 40 bp, Artificial Sequence
  PCR primer for ORF amplification
aattacatgactcgagttactcaacgctgaagttccataa

SEQ ID NO: 21224 - DNA, 40 bp, Artificial Sequence
  PCR primer for ORF amplification
aattacatgactcgagtcatttgaagaaaagaatcgtttt

SEQ ID NO: 21225 - DNA, 40 bp, Artificial Sequence
  PCR primer for ORF amplification
aattacatgactcgagttatttatccacgacattgatgtt

SEQ ID NO: 21226 - DNA, 40 bp, Artificial Sequence
  PCR primer for ORF amplification
aattacatgactcgagctagaagaacgaaaatttatcatg

SEQ ID NO: 21227 - DNA, 40 bp, Artificial Sequence
  PCR primer for ORF amplification
aattacatgactcgagctaactaatttgagcacggcccgt

SEQ ID NO: 21228 - DNA, 40 bp, Artificial Sequence
  PCR primer for ORF amplification
aattacatgactcgagtcaatcctcctccaggaagtccat

SEQ ID NO: 21229 - DNA, 40 bp, Artificial Sequence
  PCR primer for ORF amplification
aattacatgactcgagttaagctttcacttccggctctat

SEQ ID NO: 21230 - DNA, 40 bp, Artificial Sequence
  PCR primer for ORF amplification
aattacatgactcgagttaaacacagtagtatctgtcacc

SEQ ID NO: 21231 - DNA, 40 bp, Artificial Sequence
  PCR primer for ORF amplification
aattacatgactcgagtcataatactttctgcttaacaaa

SEQ ID NO: 21232 - DNA, 40 bp, Artificial Sequence
  PCR primer for ORF amplification
aattacatgactcgagctatttacaaagagatgaattgtg

SEQ ID NO: 21233 - DNA, 40 bp, Artificial Sequence
  PCR primer for ORF amplification
aattacatgactcgagctatagaaattttgggattttatc

SEQ ID NO: 21234 - DNA, 40 bp, Artificial Sequence
  PCR primer for ORF amplification
aattacatgactcgagctacacacccctcaattgaatagc

SEQ ID NO: 21235 - DNA, 40 bp, Artificial Sequence
  PCR primer for ORF amplification
aattacatgactcgagttattcgtcccagccgtccttcca

SEQ ID NO: 21236 - DNA, 40 bp, Artificial Sequence
  PCR primer for ORF amplification
aattacatgactcgagttatttaaactttgagaacaaaac

SEQ ID NO: 21237 - DNA, 40 bp, Artificial Sequence
  PCR primer for ORF amplification
aattacatgactcgagtcatagtcttctcatctttggtga

SEQ ID NO: 21238 - DNA, 40 bp, Artificial Sequence
  PCR primer for ORF amplification
aattacatgactcgagtcacctccgcttctttctcatctc

SEQ ID NO: 21239 - DNA, 40 bp, Artificial Sequence
  PCR primer for ORF amplification
aattacatgactcgagtcaaaagaggttgtcacttccatt

SEQ ID NO: 21240 - DNA, 40 bp, Artificial Sequence
  PCR primer for ORF amplification
aattacatgactcgagtcagcatcggtgaacatctttaat

SEQ ID NO: 21241 - DNA, 40 bp, Artificial Sequence
  PCR primer for ORF amplification
aattacatgactcgagtcaaattagtttcttcccgaaaga

SEQ ID NO: 21242 - DNA, 40 bp, Artificial Sequence
  PCR primer for ORF amplification
aattacatgactcgagttatttaagctcgaaatggctatt

SEQ ID NO: 21243 - DNA, 40 bp, Artificial Sequence
  PCR primer for ORF amplification
aattacatgactcgagttagtacaatctgaaagctggacc

SEQ ID NO: 21244 - DNA, 40 bp, Artificial Sequence; identical to SEQ ID NO: 21243
  PCR primer for ORF amplification

SEQ ID NO: 21245 - DNA, 40 bp, Artificial Sequence
  PCR primer for ORF amplification
aattacatgactcgagttaagcagaagtagccttagcaga

SEQ ID NO: 21246 - DNA, 40 bp, Artificial Sequence
  PCR primer for ORF amplification
aattacatgactcgagttaagcaaacagcgacgtgtccac

SEQ ID NO: 21247 - DNA, 40 bp, Artificial Sequence
  PCR primer for ORF amplification
aattacatgactcgagttagaaactttctttattcatatt

SEQ ID NO: 21248 - DNA, 40 bp, Artificial Sequence
  PCR primer for ORF amplification
aattacatgactcgagttatggggaccacaattcgcctgt

SEQ ID NO: 21249 - DNA, 40 bp, Artificial Sequence
  PCR primer for ORF amplification
aattacatgactcgagttatcttctgtaaccagagcggtt

SEQ ID NO: 21250 - DNA, 40 bp, Artificial Sequence
  PCR primer for ORF amplification
aattacatgactcgagtcagcagtcatggtcttcattcaa

SEQ ID NO: 21251 - DNA, 40 bp, Artificial Sequence
  PCR primer for ORF amplification
aattacatgactcgagctataattgttgtttgaatacttg

SEQ ID NO: 21252 - DNA, 40 bp, Artificial Sequence
  PCR primer for ORF amplification
aattacatgactcgagctatttcgtttccgcatagaagaa

SEQ ID NO: 21253 - DNA, 40 bp, Artificial Sequence
  PCR primer for ORF amplification
aattacatgactcgagttattgaatagcattatatattag

SEQ ID NO: 21254 - DNA, 40 bp, Artificial Sequence
  PCR primer for ORF amplification
aattacatgactcgagttatatataggcaccgatagtata

SEQ ID NO: 21255 - DNA, 40 bp, Artificial Sequence
  PCR primer for ORF amplification
aattacatgactcgagtcataaaattttttgcttaacaaa

SEQ ID NO: 21256 - DNA, 40 bp, Artificial Sequence
  PCR primer for ORF amplification
aattacatgactcgagttactttcttcttttttgccgttt

SEQ ID NO: 21257 - DNA, 40 bp, Artificial Sequence
  PCR primer for ORF amplification
aattacatgactcgagctattgtaggttttctaccatttt

SEQ ID NO: 21258 - DNA, 40 bp, Artificial Sequence
  PCR primer for ORF amplification
aattacatgactcgagtcaactacaacagcaggtcgagag

SEQ ID NO: 21259 - DNA, 40 bp, Artificial Sequence
  PCR primer for ORF amplification
aattacatgactcgagttaccatatttcggttcctcttct

SEQ ID NO: 21260 - DNA, 40 bp, Artificial Sequence
  PCR primer for ORF amplification
aattacatgactcgagttataaatcagcatcatcttcatc

SEQ ID NO: 21261 - DNA, 40 bp, Artificial Sequence
  PCR primer for ORF amplification
aattacatgactcgagtcatgaagaatgctcaattgaacc

SEQ ID NO: 21262 - DNA, 40 bp, Artificial Sequence
  PCR primer for ORF amplification
aattacatgactcgagttattgccccgttgcccattgtgc

SEQ ID NO: 21263 - DNA, 40 bp, Artificial Sequence
  PCR primer for ORF amplification
aattacatgactcgagctacataagaacacctttggtgga

SEQ ID NO: 21264 - DNA, 40 bp, Artificial Sequence
  PCR primer for ORF amplification
aattacatgactcgagtcagtaagtcttgttcttctcgtt

SEQ ID NO: 21265 - DNA, 40 bp, Artificial Sequence
  PCR primer for ORF amplification
aattacatgactcgagttatagctcttgtatcctacaacc

SEQ ID NO: 21266 - DNA, 40 bp, Artificial Sequence
  PCR primer for ORF amplification
aattacatgactcgagttagcagttacaacccccagtctc

SEQ ID NO: 21267 - DNA, 40 bp, Artificial Sequence
  PCR primer for ORF amplification
aattacatgactcgagctactccagcctccttcttttcat

SEQ ID NO: 21268 - DNA, 40 bp, Artificial Sequence
  PCR primer for ORF amplification
aattacatgactcgagtcaccatttgaattcgatacctga

SEQ ID NO: 21269 - DNA, 40 bp, Artificial Sequence
  PCR primer for ORF amplification
aattacatgactcgagttataaatcagcatcgtcttcatc

SEQ ID NO: 21270 - DNA, 40 bp, Artificial Sequence
  PCR primer for ORF amplification
aattacatgactcgagtcaactgctagcctccctcctctt

SEQ ID NO: 21271 - DNA, 40 bp, Artificial Sequence
  PCR primer for ORF amplification
aattacatgactcgagtcagttctccatttctttattttt

SEQ ID NO: 21272 - DNA, 40 bp, Artificial Sequence
  PCR primer for ORF amplification
aattacatgactcgagttaatagagtgtttctaggtttga

SEQ ID NO: 21273 - DNA, 40 bp, Artificial Sequence
  PCR primer for ORF amplification
aattacatgactcgagctattttggggtaacttttgtgta

SEQ ID NO: 21274 - DNA, 40 bp, Artificial Sequence
  PCR primer for ORF amplification
aattacatgactcgagtcaatcttgtgcatgtaacctcag

SEQ ID NO: 21275 - DNA, 40 bp, Artificial Sequence
  PCR primer for ORF amplification
aattacatgactcgagctatggattgtttcgatctatcct

SEQ ID NO: 21276 - DNA, 40 bp, Artificial Sequence
  PCR primer for ORF amplification
aattacatgactcgagtcaccttgtaaagctgtacacact

SEQ ID NO: 21277 - DNA, 40 bp, Artificial Sequence
  PCR primer for ORF amplification
aattacatgactcgagttataaagatgccagaagcatatc

SEQ ID NO: 21278 - DNA, 40 bp, Artificial Sequence
  PCR primer for ORF amplification
aattacatgactcgagttaagcttgagcagcaaagtattc

SEQ ID NO: 21279 - DNA, 40 bp, Artificial Sequence
  PCR primer for ORF amplification
aattacatgactcgagctattcagcgtgcggaaccgaatc

SEQ ID NO: 21280 - DNA, 40 bp, Artificial Sequence
  PCR primer for ORF amplification
aattacatgactcgagtcaggatagtaatgctaaaggttc

SEQ ID NO: 21281 - DNA, 40 bp, Artificial Sequence
  PCR primer for ORF amplification
aattacatgactcgagtcattgcttgtgttcctgctcagg

SEQ ID NO: 21282 - DNA, 40 bp, Artificial Sequence
  PCR primer for ORF amplification
aattacatgactcgagttatttactgtagtttttaagaac

SEQ ID NO: 21283 - DNA, 40 bp, Artificial Sequence
  PCR primer for ORF amplification
aattacatgactcgagttattttcttctcttggaatctgg

SEQ ID NO: 21284 - DNA, 40 bp, Artificial Sequence
  PCR primer for ORF amplification
aattacatgactcgagttagaactttttgttttgcaacaa

SEQ ID NO: 21285 - DNA, 40 bp, Artificial Sequence
  PCR primer for ORF amplification
aattacatgactcgagtcaactaatttgggcgcgacctgt

SEQ ID NO: 21286 - DNA, 40 bp, Artificial Sequence
  PCR primer for ORF amplification
aattacatgactcgagttaacaacagttgctggatttttt

SEQ ID NO: 21287 - DNA, 40 bp, Artificial Sequence
  PCR primer for ORF amplification
aattacatgactcgagtcattgtggaaagattaagctgta

SEQ ID NO: 21288 - DNA, 40 bp, Artificial Sequence
  PCR primer for ORF amplification
aattacatgactcgagtcattgggacgacgatggaggaga

SEQ ID NO: 21289 - DNA, 40 bp, Artificial Sequence
  PCR primer for ORF amplification
aattacatgactcgagtcatttttcaagtagtcttttctt

SEQ ID NO: 21290 - DNA, 40 bp, Artificial Sequence
  PCR primer for ORF amplification
aattacatgactcgagttaatccttacctagcttgttcaa

SEQ ID NO: 21291 - DNA, 40 bp, Artificial Sequence
  PCR primer for ORF amplification
aattacatgactcgagttaatctcgtaatatccttttcga

SEQ ID NO: 21292 - DNA, 40 bp, Artificial Sequence
  PCR primer for ORF amplification
aattacatgactcgagttaatacgcctgtataaataataa

SEQ ID NO: 21293 - DNA, 40 bp, Artificial Sequence
  PCR primer for ORF amplification
aattacatgactcgagtcaggtcaactgctggagccattg

SEQ ID NO: 21294 - DNA, 40 bp, Artificial Sequence
  PCR primer for ORF amplification
aattacatgactcgagttaacaacagttatttccatttgc

SEQ ID NO: 21295 - DNA, 40 bp, Artificial Sequence
  PCR primer for ORF amplification
aattacatgactcgagctatacaactagacgaggtgatat

SEQ ID NO: 21296 - DNA, 40 bp, Artificial Sequence
  PCR primer for ORF amplification
aattacatgactcgagttaccatgtgaaaaacaaaaacag

SEQ ID NO: 21297 - DNA, 40 bp, Artificial Sequence
  PCR primer for ORF amplification
aattacatgactcgagttatttaattaaccattttaggtg

SEQ ID NO: 21298 - DNA, 40 bp, Artificial Sequence
  PCR primer for ORF amplification
aattacatgactcgagttagtggaggtggttgatattgta

SEQ ID NO: 21299 - DNA, 40 bp, Artificial Sequence
  PCR primer for ORF amplification
aattacatgactcgagtcaattactagatgatgttgaagt

SEQ ID NO: 21300 - DNA, 40 bp, Artificial Sequence
  PCR primer for ORF amplification
aattacatgactcgagttactcaactatgttgatgtgcaa

SEQ ID NO: 21301 - DNA, 40 bp, Artificial Sequence
  PCR primer for ORF amplification
aattacatgactcgagctaagtcagagcttggtatataat

SEQ ID NO: 21302 - DNA, 40 bp, Artificial Sequence
  PCR primer for ORF amplification
aattacatgactcgagtcaagcaatgaatgccaaaactaa

SEQ ID NO: 21303 - DNA, 40 bp, Artificial Sequence
  PCR primer for ORF amplification
aattacatgactcgagttacgacttgaagatcttggagtt

SEQ ID NO: 21304 - DNA, 40 bp, Artificial Sequence
  PCR primer for ORF amplification
aattacatgactcgagttacatactatgaaattttagttt

SEQ ID NO: 21305 - DNA, 40 bp, Artificial Sequence
  PCR primer for ORF amplification
aattacatgactcgagttaaagggcaactgcaaagattcc

SEQ ID NO: 21306 - DNA, 40 bp, Artificial Sequence
  PCR primer for ORF amplification
aattacatgactcgagtcaaaagcctaaagatttccagaa

SEQ ID NO: 21307 - DNA, 40 bp, Artificial Sequence
  PCR primer for ORF amplification
aattacatgactcgagttaattagaaacaaactgtctgat

SEQ ID NO: 21308 - DNA, 40 bp, Artificial Sequence
  PCR primer for ORF amplification
aattacatgactcgagctagttttgcaaagctctcagcct

SEQ ID NO: 21309 - DNA, 40 bp, Artificial Sequence
  PCR primer for ORF amplification
aattacatgactcgagctatttcttagcatttttgacgaa

SEQ ID NO: 21310 - DNA, 40 bp, Artificial Sequence
  PCR primer for ORF amplification
aattacatgactcgagttaactaaacaggtaatctttaat

SEQ ID NO: 21311 - DNA, 40 bp, Artificial Sequence
  PCR primer for ORF amplification
aattacatgactcgagctaattaactgacccttcgccaag

SEQ ID NO: 21312 - DNA, 40 bp, Artificial Sequence
  PCR primer for ORF amplification
aattacatgactcgagttaatgaacagaagcacctgtagc

SEQ ID NO: 21313 - DNA, 40 bp, Artificial Sequence
  PCR primer for ORF amplification
aattacatgactcgagttagttatacccaaatgtattgca

SEQ ID NO: 21314 - DNA, 40 bp, Artificial Sequence
  PCR primer for ORF amplification
aattacatgactcgagtcaataatttcggaagataatatc

SEQ ID NO: 21315 - DNA, 40 bp, Artificial Sequence
  PCR primer for ORF amplification
aattacatgactcgagttagagttcatcgtgggctgcttc

SEQ ID NO: 21316 - DNA, 40 bp, Artificial Sequence
  PCR primer for ORF amplification
aattacatgactcgagttattttttataggtttctggcaa

SEQ ID NO: 21317 - DNA, 40 bp, Artificial Sequence
  PCR primer for ORF amplification
aattacatgactcgagtcatttaagtagtttggctctatc

SEQ ID NO: 21318 - DNA, 40 bp, Artificial Sequence
  PCR primer for ORF amplification
aattacatgactcgagttattgtgaatgtgagttatgcga

SEQ ID NO: 21319 - DNA, 40 bp, Artificial Sequence
  PCR primer for ORF amplification
aattacatgactcgagttacacattatgctttctcgattc

SEQ ID NO: 21320 - DNA, 40 bp, Artificial Sequence
  PCR primer for ORF amplification
aattacatgactcgagttaacggttagacttggcaacacg

SEQ ID NO: 21321 - DNA, 40 bp, Artificial Sequence
  PCR primer for ORF amplification
aattacatgactcgagttatttaatgggttgcatctcagt

SEQ ID NO: 21322 - DNA, 40 bp, Artificial Sequence
  PCR primer for ORF amplification
aattacatgactcgagctactgggaagacacttccgtctg

SEQ ID NO: 21323 - DNA, 40 bp, Artificial Sequence
  PCR primer for ORF amplification
aattacatgactcgagttaagcggaggcaccgtaggtttg

SEQ ID NO: 21324 - DNA, 40 bp, Artificial Sequence
  PCR primer for ORF amplification
aattacatgactcgagtcaaccgcttaaattgggaagaga

SEQ ID NO: 21325 - DNA, 40 bp, Artificial Sequence
  PCR primer for ORF amplification
aattacatgactcgagtcaatcttcccttgtgaaatcacc

SEQ ID NO: 21326 - DNA, 40 bp, Artificial Sequence
  PCR primer for ORF amplification
aattacatgactcgagctaacttccgttaatggcttcttg

SEQ ID NO: 21327 - DNA, 40 bp, Artificial Sequence
  PCR primer for ORF amplification
aattacatgactcgagtcaagcttcaaccatttctctcaa

SEQ ID NO: 21328 - DNA, 40 bp, Artificial Sequence
  PCR primer for ORF amplification
aattacatgactcgagctatgatgataagctcttcttgat

SEQ ID NO: 21329 - DNA, 40 bp, Artificial Sequence
  PCR primer for ORF amplification
aattacatgactcgagttaacagtcgaccaaagaaacagc

SEQ ID NO: 21330 - DNA, 40 bp, Artificial Sequence
  PCR primer for ORF amplification
aattacatgactcgagttaaagagtttcaaaattcttgta

SEQ ID NO: 21331 - DNA, 40 bp, Artificial Sequence
  PCR primer for ORF amplification
aattacatgactcgagctacaaactttgaatgaatttttc

SEQ ID NO: 21332 - DNA, 40 bp, Artificial Sequence
  PCR primer for ORF amplification
aattacatgactcgagtcatataccataggccttacggta

SEQ ID NO: 21333 - DNA, 40 bp, Artificial Sequence
  PCR primer for ORF amplification
aattacatgactcgagtcatggggctagtctaacgacttt

SEQ ID NO: 21334 - DNA, 40 bp, Artificial Sequence
  PCR primer for ORF amplification
aattacatgactcgagtcatggcatgcccttggcagcatt

SEQ ID NO: 21335 - DNA, 40 bp, Artificial Sequence
  PCR primer for ORF amplification
aattacatgactcgagttagttctcttcgcccttaacaat

SEQ ID NO: 21336 - DNA, 40 bp, Artificial Sequence
  PCR primer for ORF amplification
aattacatgactcgagctaaacagccaatctatcaaagtc

SEQ ID NO: 21337 - DNA, 40 bp, Artificial Sequence
  PCR primer for ORF amplification
aattacatgactcgagtcaaatgccctttgtatctgattg

SEQ ID NO: 21338 - DNA, 40 bp, Artificial Sequence
  PCR primer for ORF amplification
aattacatgactcgagttatacattatttaggaaaaactt

SEQ ID NO: 21339 - DNA, 40 bp, Artificial Sequence
  PCR primer for ORF amplification
aattacatgactcgagtcactgagcgctttctaaagcttt

SEQ ID NO: 21340 - DNA, 40 bp, Artificial Sequence
  PCR primer for ORF amplification
aattacatgactcgagttaacaagatttaatctgtttcca

SEQ ID NO: 21341 - DNA, 40 bp, Artificial Sequence
  PCR primer for ORF amplification
aattacatgactcgagttattcgtcatcctcttcttcgtc

SEQ ID NO: 21342 - DNA, 40 bp, Artificial Sequence
  PCR primer for ORF amplification
aattacatgactcgagtcatggttcttttgtcgtactatc

SEQ ID NO: 21343 - DNA, 40 bp, Artificial Sequence
  PCR primer for ORF amplification
aattacatgactcgagctaaataaactgtcccctgattct

SEQ ID NO: 21344 - DNA, 40 bp, Artificial Sequence
  PCR primer for ORF amplification
aattacatgactcgagctatgatttacgcaaatggtaatt

SEQ ID NO: 21345 - DNA, 40 bp, Artificial Sequence
  PCR primer for ORF amplification
aattacatgactcgagttaagcatcttcttcaacgacaac

SEQ ID NO: 21346 - DNA, 40 bp, Artificial Sequence
  PCR primer for ORF amplification
aattacatgactcgagctaattttcgtggttgtatgcgtc

SEQ ID NO: 21347 - DNA, 40 bp, Artificial Sequence
  PCR primer for ORF amplification
aattacatgactcgagctaacgtaatcttaagtcactgac

SEQ ID NO: 21348 - DNA, 40 bp, Artificial Sequence
  PCR primer for ORF amplification
aattacatgactcgagtcattttacaatgcttttttcaac

SEQ ID NO: 21349 - DNA, 40 bp, Artificial Sequence
  PCR primer for ORF amplification
aattacatgactcgagttaatcgaaaattctatgaaaaaa

SEQ ID NO: 21350 - DNA, 40 bp, Artificial Sequence
  PCR primer for ORF amplification
aattacatgactcgagttatatcttttcgagcggtatgtt

SEQ ID NO: 21351 - DNA, 40 bp, Artificial Sequence
  PCR primer for ORF amplification
aattacatgactcgagttataaccttgtacctaatgtctc

SEQ ID NO: 21352 - DNA, 40 bp, Artificial Sequence
  PCR primer for ORF amplification
aattacatgactcgagttatatatctaaatcactatcact

SEQ ID NO: 21353 - DNA, 40 bp, Artificial Sequence
  PCR primer for ORF amplification
aattacatgactcgagttagatttctgaacagtactcttg

SEQ ID NO: 21354 - DNA, 40 bp, Artificial Sequence
  PCR primer for ORF amplification
aattacatgactcgagttaggtagcaatcttctccagaga

SEQ ID NO: 21355 - DNA, 40 bp, Artificial Sequence
  PCR primer for ORF amplification
aattacatgactcgagttattttgatgcaataccgtttct

SEQ ID NO: 21356 - DNA, 40 bp, Artificial Sequence
  PCR primer for ORF amplification
aattacatgactcgagtcaagcaaaagaatcttttggctc

SEQ ID NO: 21357 - DNA, 40 bp, Artificial Sequence
  PCR primer for ORF amplification
aattacatgactcgagttaatttccataccgcctcctttt

SEQ ID NO: 21358 - DNA, 40 bp, Artificial Sequence
  PCR primer for ORF amplification
aattacatgactcgagtcaattattggaaggtttttcacg

SEQ ID NO: 21359 - DNA, 40 bp, Artificial Sequence
  PCR primer for ORF amplification
aattacatgactcgagctacaatctatgatttcccaactc

SEQ ID NO: 21360 - DNA, 40 bp, Artificial Sequence
  PCR primer for ORF amplification
aattacatgactcgagttacataatggtacagctggatcc

SEQ ID NO: 21361 - DNA, 40 bp, Artificial Sequence
  PCR primer for ORF amplification
aattacatgactcgagttacttacaagtcactaacatctt

SEQ ID NO: 21362 - DNA, 40 bp, Artificial Sequence
  PCR primer for ORF amplification
aattacatgactcgagttattgtccctttttcaaatgtgt

SEQ ID NO: 21363 - DNA, 40 bp, Artificial Sequence
  PCR primer for ORF amplification
aattacatgactcgagctatttgatgtggtattgcttggc

SEQ ID NO: 21364 - DNA, 40 bp, Artificial Sequence
  PCR primer for ORF amplification
aattacatgactcgagtcacctgtatttatttacagtctc

SEQ ID NO: 21365 - DNA, 40 bp, Artificial Sequence
  PCR primer for ORF amplification
aattacatgactcgagtcatgacagatcgtaatatctatc

SEQ ID NO: 21366 - DNA, 40 bp, Artificial Sequence
  PCR primer for ORF amplification
aattacatgactcgagctagtttggcatgggcttgagtgc

SEQ ID NO: 21367 - DNA, 40 bp, Artificial Sequence
  PCR primer for ORF amplification
aattacatgactcgagtcaacggaacttgataccatcttt

SEQ ID NO: 21368 - DNA, 40 bp, Artificial Sequence
  PCR primer for ORF amplification
aattacatgactcgagctactcttttaagactttattacc

SEQ ID NO: 21369 - DNA, 40 bp, Artificial Sequence
  PCR primer for ORF amplification
aattacatgactcgagttatatggaattagcctcagcata

SEQ ID NO: 21370 - DNA, 40 bp, Artificial Sequence
  PCR primer for ORF amplification
aattacatgactcgagtcaacgtcctctgaagagtttgta

SEQ ID NO: 21371 - DNA, 40 bp, Artificial Sequence
  PCR primer for ORF amplification
aattacatgactcgagtcaaggagaaactatgttatcata

SEQ ID NO: 21372 - DNA, 40 bp, Artificial Sequence
  PCR primer for ORF amplification
aattacatgactcgagtcacagttgcctcgtaatccaaga

SEQ ID NO: 21373 - DNA, 40 bp, Artificial Sequence
  PCR primer for ORF amplification
aattacatgactcgagttacgaggattttgaacggatttc

SEQ ID NO: 21374 - DNA, 40 bp, Artificial Sequence
  PCR primer for ORF amplification
aattacatgactcgagtcacttcacgttaacgccagtcca

SEQ ID NO: 21375 - DNA, 40 bp, Artificial Sequence
  PCR primer for ORF amplification
aattacatgactcgagttagactttggtttggtaattgaa

SEQ ID NO: 21376 - DNA, 40 bp, Artificial Sequence
  PCR primer for ORF amplification
aattacatgactcgagttactcaaaaaagtcatccttttc

SEQ ID NO: 21377 - DNA, 40 bp, Artificial Sequence
  PCR primer for ORF amplification
aattacatgactcgagttaagcaccgggagccttcgcgtt

SEQ ID NO: 21378 - DNA, 40 bp, Artificial Sequence
  PCR primer for ORF amplification
aattacatgactcgagtcaatctctatgtttctttttctt

SEQ ID NO: 21379 - DNA, 40 bp, Artificial Sequence
  PCR primer for ORF amplification
aattacatgactcgagtcaatcaaagaactttcttgtctt

SEQ ID NO: 21380 - DNA, 40 bp, Artificial Sequence
  PCR primer for ORF amplification
aattacatgactcgagttaaattctttcggcactccatat

SEQ ID NO: 21381 - DNA, 40 bp, Artificial Sequence
  PCR primer for ORF amplification
aattacatgactcgagtcagatcttgccagcatcgaatct

SEQ ID NO: 21382 - DNA, 40 bp, Artificial Sequence
  PCR primer for ORF amplification
aattacatgactcgagttaaaaaattccatttttgaattt

SEQ ID NO: 21383 - DNA, 40 bp, Artificial Sequence
  PCR primer for ORF amplification
aattacatgactcgagtcaaggtaaatcagcgtcaggata

SEQ ID NO: 21384 - DNA, 40 bp, Artificial Sequence
  PCR primer for ORF amplification
aattacatgactcgagctattccgtctttttaagaagcgc

SEQ ID NO: 21385 - DNA, 40 bp, Artificial Sequence; identical to SEQ ID NO: 21384
  PCR primer for ORF amplification

SEQ ID NO: 21386 - DNA, 40 bp, Artificial Sequence
  PCR primer for ORF amplification
aattacatgactcgagtcatgcttgctccaacttttcata

SEQ ID NO: 21387 - DNA, 40 bp, Artificial Sequence
  PCR primer for ORF amplification
aattacatgactcgagttaaatgtatttctttaatactga

SEQ ID NO: 21388 - DNA, 40 bp, Artificial Sequence
  PCR primer for ORF amplification
aattacatgactcgagttagaaattgctacctaaagcacg

SEQ ID NO: 21389 - DNA, 40 bp, Artificial Sequence
  PCR primer for ORF amplification
aattacatgactcgagctagatgtatttagcaacagcttc

SEQ ID NO: 21390 - DNA, 40 bp, Artificial Sequence
  PCR primer for ORF amplification
aattacatgactcgagtcaactgcaacaagatgttggatc

SEQ ID NO: 21391 - DNA, 40 bp, Artificial Sequence
  PCR primer for ORF amplification
aattacatgactcgagctactttgaggcaacggcagcata

SEQ ID NO: 21392 - DNA, 40 bp, Artificial Sequence
  PCR primer for ORF amplification
aattacatgactcgagctaaggcaaatcaacctctgggta

SEQ ID NO: 21393 - DNA, 40 bp, Artificial Sequence
  PCR primer for ORF amplification
aattacatgactcgagttattttaaaaaagtttcggatga

SEQ ID NO: 21394 - DNA, 40 bp, Artificial Sequence
  PCR primer for ORF amplification
aattacatgactcgagctaaaggttaagttcatccattag

SEQ ID NO: 21395 - DNA, 40 bp, Artificial Sequence
  PCR primer for ORF amplification
aattacatgactcgagtcatataaatttccaatgcaggta

SEQ ID NO: 21396 - DNA, 40 bp, Artificial Sequence
  PCR primer for ORF amplification
aattacatgactcgagtcaaactgtgacccccatctctgg

SEQ ID NO: 21397 - DNA, 40 bp, Artificial Sequence
  PCR primer for ORF amplification
aattacatgactcgagctaatctaaaataatggcatcgtc

SEQ ID NO: 21398 - DNA, 40 bp, Artificial Sequence
  PCR primer for ORF amplification
aattacatgactcgagttatatggttttgtaaaagctatt

SEQ ID NO: 21399 - DNA, 40 bp, Artificial Sequence
  PCR primer for ORF amplification
aattacatgactcgagttatctcctacgcttgttgtcgtt

SEQ ID NO: 21400 - DNA, 40 bp, Artificial Sequence
  PCR primer for ORF amplification
aattacatgactcgagttataaaatagttgacaaccaggc

SEQ ID NO: 21401 - DNA, 40 bp, Artificial Sequence
  PCR primer for ORF amplification
aattacatgactcgagttaagcagctttctgctcacaagc

SEQ ID NO: 21402 - DNA, 40 bp, Artificial Sequence
  PCR primer for ORF amplification
aattacatgactcgagtcacagtccatatttggacatttc

SEQ ID NO: 21403 - DNA, 40 bp, Artificial Sequence
  PCR primer for ORF amplification
aattacatgactcgagttattcccaattagggcccaatcc

SEQ ID NO: 21404 - DNA, 40 bp, Artificial Sequence
  PCR primer for ORF amplification
aattacatgactcgagttattccatgttgatgttagtgct

SEQ ID NO: 21405 - DNA, 40 bp, Artificial Sequence
  PCR primer for ORF amplification
aattacatgactcgagttacaggtccatatcctggcggaa

SEQ ID NO: 21406 - DNA, 40 bp, Artificial Sequence
  PCR primer for ORF amplification
aattacatgactcgagtcaatccgatatatctaattttgt

SEQ ID NO: 21407 - DNA, 40 bp, Artificial Sequence
  PCR primer for ORF amplification
aattacatgactcgagtcagtttgacaagctttctcttat

SEQ ID NO: 21408 - DNA, 40 bp, Artificial Sequence
  PCR primer for ORF amplification
aattacatgactcgagctatgtagctttccacatgtcttg

SEQ ID NO: 21409 - DNA, 40 bp, Artificial Sequence
  PCR primer for ORF amplification
aattacatgactcgagttaagggtgaagtaacaagtacag

SEQ ID NO: 21410 - DNA, 40 bp, Artificial Sequence
  PCR primer for ORF amplification
aattacatgactcgagttaaatatattgagataaccattg

SEQ ID NO: 21411 - DNA, 40 bp, Artificial Sequence
  PCR primer for ORF amplification
aattacatgactcgagtcagctatataatgcgtttatagc

SEQ ID NO: 21412 - DNA, 40 bp, Artificial Sequence
  PCR primer for ORF amplification
aattacatgactcgagctaaaaaaactcatcgacaccagg

SEQ ID NO: 21413 - DNA, 40 bp, Artificial Sequence
  PCR primer for ORF amplification
aattacatgactcgagttaaacaaggatgccgaaccactt

SEQ ID NO: 21414 - DNA, 40 bp, Artificial Sequence
  PCR primer for ORF amplification
aattacatgactcgagctattctacgtcttgttgggtcat

SEQ ID NO: 21415 - DNA, 40 bp, Artificial Sequence
  PCR primer for ORF amplification
aattacatgactcgagtcaaaaatctttttgagaaaattc

SEQ ID NO: 21416 - DNA, 40 bp, Artificial Sequence
  PCR primer for ORF amplification
aattacatgactcgagttaatagccttcgaacaactcatc

SEQ ID NO: 21417 - DNA, 40 bp, Artificial Sequence
  PCR primer for ORF amplification
aattacatgactcgagtcagttttttaaagcgtcgatgga

SEQ ID NO: 21418 - DNA, 40 bp, Artificial Sequence
  PCR primer for ORF amplification
aattacatgactcgagttactggcttggttgttgcatatc

SEQ ID NO: 21419 - DNA, 40 bp, Artificial Sequence
  PCR primer for ORF amplification
aattacatgactcgagtcataaatatctggatagttcgtc

SEQ ID NO: 21420 - DNA, 40 bp, Artificial Sequence
  PCR primer for ORF amplification
aattacatgactcgagtcatagtatgaattcgcattttat

SEQ ID NO: 21421 - DNA, 40 bp, Artificial Sequence
  PCR primer for ORF amplification
aattacatgactcgagctatttgggtcggggcacgacgaa

SEQ ID NO: 21422 - DNA, 40 bp, Artificial Sequence
  PCR primer for ORF amplification
aattacatgactcgagttaaacaccaccagagagtagttt

SEQ ID NO: 21423 - DNA, 40 bp, Artificial Sequence
  PCR primer for ORF amplification
aattacatgactcgagttacttctttaactcgcttaggat

SEQ ID NO: 21424 - DNA, 40 bp, Artificial Sequence
  PCR primer for ORF amplification
aattacatgactcgagttatttagttatcgattgagtcaa

SEQ ID NO: 21425 - DNA, 40 bp, Artificial Sequence
  PCR primer for ORF amplification
aattacatgactcgagttaaggtctgggaaccatgacata

SEQ ID NO: 21426 - DNA, 40 bp, Artificial Sequence
  PCR primer for ORF amplification
aattacatgactcgagctactccaaagctgtcagtaacca

SEQ ID NO: 21427 - DNA, 40 bp, Artificial Sequence
  PCR primer for ORF amplification
aattacatgactcgagttatttgatatgcgtgcctttagc

SEQ ID NO: 21428 - DNA, 40 bp, Artificial Sequence
  PCR primer for ORF amplification
aattacatgactcgagttatacaatgatatcatttacgcc

SEQ ID NO: 21429 - DNA, 40 bp, Artificial Sequence
  PCR primer for ORF amplification
aattacatgactcgagttagattaacatagcggcaacagc

SEQ ID NO: 21430 - DNA, 40 bp, Artificial Sequence
  PCR primer for ORF amplification
aattacatgactcgagtcaagacattatgttagatccatc

SEQ ID NO: 21431 - DNA, 40 bp, Artificial Sequence
  PCR primer for ORF amplification
aattacatgactcgagctaatctagcaaatctctagaacg

SEQ ID NO: 21432 - DNA, 40 bp, Artificial Sequence
  PCR primer for ORF amplification
aattacatgactcgagctacccgtgaaatatttcctcagg

SEQ ID NO: 21433 - DNA, 40 bp, Artificial Sequence
  PCR primer for ORF amplification
aattacatgactcgagttatttatttaggtagtttctaac

SEQ ID NO: 21434 - DNA, 40 bp, Artificial Sequence
  PCR primer for ORF amplification
aattacatgactcgagttacaacaagtaagcagctgcgac

SEQ ID NO: 21435 - DNA, 40 bp, Artificial Sequence
  PCR primer for ORF amplification
aattacatgactcgagctaatcccttttggatttatcatt

SEQ ID NO: 21436 - DNA, 40 bp, Artificial Sequence
  PCR primer for ORF amplification
aattacatgactcgagttaatcttttctggggccccatct

SEQ ID NO: 21437 - DNA, 40 bp, Artificial Sequence
  PCR primer for ORF amplification
aattacatgactcgagctaattcttatcacctttctttgc

SEQ ID NO: 21438 - DNA, 40 bp, Artificial Sequence
  PCR primer for ORF amplification
aattacatgactcgagttatataaaaggtattccgacacc

SEQ ID NO: 21439 - DNA, 40 bp, Artificial Sequence
  PCR primer for ORF amplification
aattacatgactcgagtcatggtatatcggcgtcaggata

SEQ ID NO: 21440 - DNA, 40 bp, Artificial Sequence
  PCR primer for ORF amplification
aattacatgactcgagttaagttagactggtctcattgaa

SEQ ID NO: 21441 - DNA, 40 bp, Artificial Sequence
  PCR primer for ORF amplification
aattacatgactcgagttaaacgtccacccgtcccaatac

SEQ ID NO: 21442 - DNA, 40 bp, Artificial Sequence
  PCR primer for ORF amplification
aattacatgactcgagttattcaatgaaccctctatatgt

SEQ ID NO: 21443 - DNA, 40 bp, Artificial Sequence
  PCR primer for ORF amplification
aattacatgactcgagtcataatcttctacctcttctacc

SEQ ID NO: 21444 - DNA, 40 bp, Artificial Sequence
  PCR primer for ORF amplification
aattacatgactcgagctattgtaattcccttatagtgtt

SEQ ID NO: 21445 - DNA, 40 bp, Artificial Sequence
  PCR primer for ORF amplification
aattacatgactcgagtcacgccaaactttgtatacaatt

SEQ ID NO: 21446 - DNA, 40 bp, Artificial Sequence
  PCR primer for ORF amplification
aattacatgactcgagctaatccttacaaagctttagaat

SEQ ID NO: 21447 - DNA, 40 bp, Artificial Sequence
  PCR primer for ORF amplification
aattacatgactcgagtcacatttttctaaattcacttag

SEQ ID NO: 21448 - DNA, 40 bp, Artificial Sequence
  PCR primer for ORF amplification
aattacatgactcgagctaagcttcaactggttcagcttg

SEQ ID NO: 21449 - DNA, 40 bp, Artificial Sequence
  PCR primer for ORF amplification
aattacatgactcgagtcacctgtaacctctttgggggcg

SEQ ID NO: 21450 - DNA, 40 bp, Artificial Sequence
  PCR primer for ORF amplification
aattacatgactcgagctactcctccttgaccgtaagtat

SEQ ID NO: 21451 - DNA, 40 bp, Artificial Sequence
  PCR primer for ORF amplification
aattacatgactcgagtcaaagccccatttctgcttgtag

SEQ ID NO: 21452 - DNA, 40 bp, Artificial Sequence
  PCR primer for ORF amplification
aattacatgactcgagttaacgggagtaagaccaaacgtt

SEQ ID NO: 21453 - DNA, 40 bp, Artificial Sequence
  PCR primer for ORF amplification
aattacatgactcgagttagtttctctttctgtaacgtct

SEQ ID NO: 21454 - DNA, 40 bp, Artificial Sequence
  PCR primer for ORF amplification
aattacatgactcgagctacaagcagcatttgcgatcatc

SEQ ID NO: 21455 - DNA, 40 bp, Artificial Sequence
  PCR primer for ORF amplification
aattacatgactcgagttagtcttcagaatcctcacctac

SEQ ID NO: 21456 - DNA, 40 bp, Artificial Sequence
  PCR primer for ORF amplification
aattacatgactcgagttataccgctgaagactttttatt

SEQ ID NO: 21457 - DNA, 40 bp, Artificial Sequence
  PCR primer for ORF amplification
aattacatgactcgagttaatctctttttagctcataaaa

SEQ ID NO: 21458 - DNA, 40 bp, Artificial Sequence
  PCR primer for ORF amplification
aattacatgactcgagttacgtcaggattctcggaacgga

SEQ ID NO: 21459 - DNA, 40 bp, Artificial Sequence
  PCR primer for ORF amplification
aattacatgactcgagctaattttccatcaattcagcgac

SEQ ID NO: 21460 - DNA, 40 bp, Artificial Sequence
  PCR primer for ORF amplification
aattacatgactcgagctaaaaaatgctgttgacaatatc

SEQ ID NO: 21461 - DNA, 40 bp, Artificial Sequence
  PCR primer for ORF amplification
aattacatgactcgagctaatcattggctttccttttctt

SEQ ID NO: 21462 - DNA, 40 bp, Artificial Sequence
  PCR primer for ORF amplification
aattacatgactcgagtcaaaagaaaaggtctcgaaaaat

SEQ ID NO: 21463 - DNA, 40 bp, Artificial Sequence
  PCR primer for ORF amplification
aattacatgactcgagttagtatcttctttgaggtctttg

SEQ ID NO: 21464 - DNA, 40 bp, Artificial Sequence
  PCR primer for ORF amplification
aattacatgactcgagtcattgtggaagaggtcttctagg

SEQ ID NO: 21465 - DNA, 40 bp, Artificial Sequence
  PCR primer for ORF amplification
aattacatgactcgagttatttttccgaattaaagtcact

SEQ ID NO: 21466 - DNA, 40 bp, Artificial Sequence
  PCR primer for ORF amplification
aattacatgactcgagttaatccagtaaagcataaaaact

SEQ ID NO: 21467 - DNA, 40 bp, Artificial Sequence
  PCR primer for ORF amplification
aattacatgactcgagttacttgctttttattccttccca

SEQ ID NO: 21468 - DNA, 40 bp, Artificial Sequence
  PCR primer for ORF amplification
aattacatgactcgagtcattcttcaagtgcggctatcct

SEQ ID NO: 21469 - DNA, 40 bp, Artificial Sequence
  PCR primer for ORF amplification
aattacatgactcgagctatgattcgctgctggtgtcgtt

SEQ ID NO: 21470 - DNA, 40 bp, Artificial Sequence
  PCR primer for ORF amplification
aattacatgactcgagtcaaggtaatttattttcattcat

SEQ ID NO: 21471 - DNA, 40 bp, Artificial Sequence
  PCR primer for ORF amplification
aattacatgactcgagttattcggcgatattcagtagagg

SEQ ID NO: 21472 - DNA, 40 bp, Artificial Sequence
  PCR primer for ORF amplification
aattacatgactcgagtcactcgggtttcttctttgcata

SEQ ID NO: 21473 - DNA, 40 bp, Artificial Sequence
  PCR primer for ORF amplification
aattacatgactcgagttattcagaagcttcttgtaagga

SEQ ID NO: 21474 - DNA, 40 bp, Artificial Sequence
  PCR primer for ORF amplification
aattacatgactcgagttagtatgctgtatgatctttgaa

SEQ ID NO: 21475 - DNA, 40 bp, Artificial Sequence
  PCR primer for ORF amplification
aattacatgactcgagtcaaatacttcttcttcctaaaag

SEQ ID NO: 21476 - DNA, 40 bp, Artificial Sequence
  PCR primer for ORF amplification
aattacatgactcgagctaatacgacaagtgggacgattc

SEQ ID NO: 21477 - DNA, 40 bp, Artificial Sequence
  PCR primer for ORF amplification
aattacatgactcgagtcacagctccagagcacgaacata

SEQ ID NO: 21478 - DNA, 40 bp, Artificial Sequence
  PCR primer for ORF amplification
aattacatgactcgagttactgtagagcatgttggaaata

SEQ ID NO: 21479 - DNA, 40 bp, Artificial Sequence
  PCR primer for ORF amplification
aattacatgactcgagttacttcaatttagaaagcaattg

SEQ ID NO: 21480 - DNA, 40 bp, Artificial Sequence
  PCR primer for ORF amplification
aattacatgactcgagttaagcgtgatattcaataacttc

SEQ ID NO: 21481 - DNA, 40 bp, Artificial Sequence
  PCR primer for ORF amplification
aattacatgactcgagttacagtttttcatctatccattc

SEQ ID NO: 21482 - DNA, 40 bp, Artificial Sequence
  PCR primer for ORF amplification
aattacatgactcgagttatttttgtgagttgacaaatct

SEQ ID NO: 21483 - DNA, 40 bp, Artificial Sequence
  PCR primer for ORF amplification
aattacatgactcgagttatctgtagaaccatcctaaaac

SEQ ID NO: 21484 - DNA, 40 bp, Artificial Sequence
  PCR primer for ORF amplification
aattacatgactcgagtcacggactggccatcttcagatg

SEQ ID NO: 21485 - DNA, 40 bp, Artificial Sequence
  PCR primer for ORF amplification
aattacatgactcgagttagtcatcggccagtctcgcaca

SEQ ID NO: 21486 - DNA, 40 bp, Artificial Sequence
  PCR primer for ORF amplification
aattacatgactcgagctatttttcttcttttggattccc

SEQ ID NO: 21487 - DNA, 40 bp, Artificial Sequence
  PCR primer for ORF amplification
aattacatgactcgagttaaaacaaagatccaaaaatgct

SEQ ID NO: 21488 - DNA, 40 bp, Artificial Sequence
  PCR primer for ORF amplification
aattacatgactcgagttatttagcacaatcctcgtgagc

SEQ ID NO: 21489 - DNA, 40 bp, Artificial Sequence
  PCR primer for ORF amplification
aattacatgactcgagttaacaatgggccttcagctttcc

SEQ ID NO: 21490 - DNA, 40 bp, Artificial Sequence
  PCR primer for ORF amplification
aattacatgactcgagttactcgctggtaaactgaatcga

SEQ ID NO: 21491 - DNA, 40 bp, Artificial Sequence
  PCR primer for ORF amplification
aattacatgactcgagtcagcccggcgacggcgcatttga

SEQ ID NO: 21492 - DNA, 40 bp, Artificial Sequence
  PCR primer for ORF amplification
aattacatgactcgagtcatgtattaacgcccggcgatgg

SEQ ID NO: 21493 - DNA, 40 bp, Artificial Sequence
  PCR primer for ORF amplification
aattacatgactcgagctatgagtaggtttcaatcaaagt

SEQ ID NO: 21494 - DNA, 40 bp, Artificial Sequence
  PCR primer for ORF amplification
aattacatgactcgagtcagtggatgatggaccggatgtc

SEQ ID NO: 21495 - DNA, 40 bp, Artificial Sequence
  PCR primer for ORF amplification
aattacatgactcgagttatagggccgggaataattgaat

SEQ ID NO: 21496 - DNA, 40 bp, Artificial Sequence
  PCR primer for ORF amplification
aattacatgactcgagctagtttttttgcttatcccttct

SEQ ID NO: 21497 - DNA, 40 bp, Artificial Sequence
  PCR primer for ORF amplification
aattacatgactcgagtcaaatagaagagttggatttgtc

SEQ ID NO: 21498 - DNA, 40 bp, Artificial Sequence
  PCR primer for ORF amplification
aattacatgactcgagtcagtttttcaatttaccaaattt

SEQ ID NO: 21499 - DNA, 40 bp, Artificial Sequence
  PCR primer for ORF amplification
aattacatgactcgagttaatctctcgtcaaagggttgtt

SEQ ID NO: 21500 - DNA, 40 bp, Artificial Sequence
  PCR primer for ORF amplification
aattacatgactcgagttacttcctgataagctgaaacaa

SEQ ID NO: 21501 - DNA, 40 bp, Artificial Sequence
  PCR primer for ORF amplification
aattacatgactcgagtcaggcccttgtcaaagggttgtt

SEQ ID NO: 21502 - DNA, 40 bp, Artificial Sequence
  PCR primer for ORF amplification
aattacatgactcgagttaaacattcgaaaaatgattgaa

SEQ ID NO: 21503 - DNA, 40 bp, Artificial Sequence
  PCR primer for ORF amplification
aattacatgactcgagctacctagcagaggcgttactgac

SEQ ID NO: 21504 - DNA, 40 bp, Artificial Sequence
  PCR primer for ORF amplification
aattacatgactcgagtcagagtttcaatatttggtctgt

SEQ ID NO: 21505 - DNA, 40 bp, Artificial Sequence
  PCR primer for ORF amplification
aattacatgactcgagtcagtccgatgaggacatcttcaa

SEQ ID NO: 21506 - DNA, 40 bp, Artificial Sequence
  PCR primer for ORF amplification
aattacatgactcgagctaatttttagttacttcatccaa

SEQ ID NO: 21507 - DNA, 40 bp, Artificial Sequence
  PCR primer for ORF amplification
aattacatgactcgagctataaccattgtgttaaaccagg

SEQ ID NO: 21508 - DNA, 40 bp, Artificial Sequence
  PCR primer for ORF amplification
aattacatgactcgagttaaacctccgtaaattccttgaa

SEQ ID NO: 21509 - DNA, 40 bp, Artificial Sequence
  PCR primer for ORF amplification
aattacatgactcgagttagcgaaacatcttccttgagct

SEQ ID NO: 21510 - DNA, 40 bp, Artificial Sequence
  PCR primer for ORF amplification
aattacatgactcgagttatttcttaccttggttggcaac

SEQ ID NO: 21511 - DNA, 40 bp, Artificial Sequence
  PCR primer for ORF amplification
aattacatgactcgagtcatctgaacgggttatttgaaga

SEQ ID NO: 21512 - DNA, 40 bp, Artificial Sequence
  PCR primer for ORF amplification
aattacatgactcgagttactttaattgaatatatgctct

SEQ ID NO: 21513 - DNA, 40 bp, Artificial Sequence
  PCR primer for ORF amplification
aattacatgactcgagttacatgacagtacagcaggataa

SEQ ID NO: 21514 - DNA, 40 bp, Artificial Sequence
  PCR primer for ORF amplification
aattacatgactcgagtcactgatgttttttctttgctat

SEQ ID NO: 21515 - DNA, 40 bp, Artificial Sequence
  PCR primer for ORF amplification
aattacatgactcgagtcaaaccaaagctgtcctcttttt

SEQ ID NO: 21516 - DNA, 40 bp, Artificial Sequence
  PCR primer for ORF amplification
aattacatgactcgagctactttagcttgttatgagcctt

SEQ ID NO: 21517 - DNA, 40 bp, Artificial Sequence
  PCR primer for ORF amplification
aattacatgactcgagtcatatggttgcgtttttctctgt

SEQ ID NO: 21518 - DNA, 40 bp, Artificial Sequence
  PCR primer for ORF amplification
aattacatgactcgagttagtttctagagttgatgatatc

SEQ ID NO: 21519 - DNA, 40 bp, Artificial Sequence
  PCR primer for ORF amplification
aattacatgactcgagtcagacaaaaattaccatgagggc

SEQ ID NO: 21520 - DNA, 40 bp, Artificial Sequence
  PCR primer for ORF amplification
aattacatgactcgagttacaagttacctagacagccacc

SEQ ID NO: 21521 - DNA, 40 bp, Artificial Sequence
  PCR primer for ORF amplification
aattacatgactcgagctatttgatgttgttggccaaggc

SEQ ID NO: 21522 - DNA, 40 bp, Artificial Sequence
  PCR primer for ORF amplification
aattacatgactcgagctacttctcaagagtagctgctag

SEQ ID NO: 21523 - DNA, 40 bp, Artificial Sequence
  PCR primer for ORF amplification
aattacatgactcgagttaattttgttttatttttgtatt

SEQ ID NO: 21524 - DNA, 40 bp, Artificial Sequence
  PCR primer for ORF amplification
aattacatgactcgagctaaaaagttttcgtttgaacttt

SEQ ID NO: 21525 - DNA, 40 bp, Artificial Sequence
  PCR primer for ORF amplification
aattacatgactcgagttattggttacttgtaaagagatg

SEQ ID NO: 21526 - DNA, 40 bp, Artificial Sequence
  PCR primer for ORF amplification
aattacatgactcgagttactttgatcccttcgattctgc

SEQ ID NO: 21527 - DNA, 40 bp, Artificial Sequence
  PCR primer for ORF amplification
aattacatgactcgagttaaagaatgttttccaaaaggcc

SEQ ID NO: 21528 - DNA, 40 bp, Artificial Sequence
  PCR primer for ORF amplification
aattacatgactcgagctaagtttcctggttcattaaaca

SEQ ID NO: 21529 - DNA, 40 bp, Artificial Sequence
  PCR primer for ORF amplification
aattacatgactcgagtcataatgcttctaatctatcatt

SEQ ID NO: 21530 - DNA, 40 bp, Artificial Sequence
  PCR primer for ORF amplification
aattacatgactcgagttaccttttctcggtcttttcttg

SEQ ID NO: 21531 - DNA, 40 bp, Artificial Sequence
  PCR primer for ORF amplification
aattacatgactcgagttaaaccatgaaactctcgccaca

SEQ ID NO: 21532 - DNA, 40 bp, Artificial Sequence
  PCR primer for ORF amplification
aattacatgactcgagttaaataaagccagatcctgaccc

SEQ ID NO: 21533 - DNA, 40 bp, Artificial Sequence
  PCR primer for ORF amplification
aattacatgactcgagtcaaaccttagatttcttatgtac

SEQ ID NO: 21534 - DNA, 40 bp, Artificial Sequence
  PCR primer for ORF amplification
aattacatgactcgagttagttatgcgttgtattatctat

SEQ ID NO: 21535 - DNA, 40 bp, Artificial Sequence
  PCR primer for ORF amplification
aattacatgactcgagttaccatttcaacaagtcatcctt

SEQ ID NO: 21536 - DNA, 40 bp, Artificial Sequence
  PCR primer for ORF amplification
aattacatgactcgagttaacgtaatatagcatcctggaa

SEQ ID NO: 21537 - DNA, 40 bp, Artificial Sequence
  PCR primer for ORF amplification
aattacatgactcgagctaacgtttccgttgtttcttcca

SEQ ID NO: 21538 - DNA, 40 bp, Artificial Sequence
  PCR primer for ORF amplification
aattacatgactcgagtcatttcataaaaaggccaaccaa

SEQ ID NO: 21539 - DNA, 40 bp, Artificial Sequence
  PCR primer for ORF amplification
aattacatgactcgagttaccatttcaacagatcgtcctt

SEQ ID NO: 21540 - DNA, 40 bp, Artificial Sequence
  PCR primer for ORF amplification
aattacatgactcgagttattcattgtcgcttcctgcggc

SEQ ID NO: 21541 - DNA, 40 bp, Artificial Sequence
  PCR primer for ORF amplification
aattacatgactcgagttatttcgaatctttttcttgggt

SEQ ID NO: 21542 - DNA, 40 bp, Artificial Sequence
  PCR primer for ORF amplification
aattacatgactcgagttatttcaacttcttctttggacg

SEQ ID NO: 21543 - DNA, 40 bp, Artificial Sequence
  PCR primer for ORF amplification
aattacatgactcgagttattcttcgtcttcttcttcgtc

SEQ ID NO: 21544 - DNA, 40 bp, Artificial Sequence
  PCR primer for ORF amplification
aattacatgactcgagttaatatcttctttgtggtctttg

SEQ ID NO: 21545 - DNA, 40 bp, Artificial Sequence
  PCR primer for ORF amplification
aattacatgactcgagtcatattttttgcaagaataacct

SEQ ID NO: 21546 - DNA, 40 bp, Artificial Sequence
  PCR primer for ORF amplification
aattacatgactcgagctaaaaggcggcctcttcatttgg

SEQ ID NO: 21547 - DNA, 40 bp, Artificial Sequence
  PCR primer for ORF amplification
aattacatgactcgagttaggctaagctatcgtggttgct

SEQ ID NO: 21548 - DNA, 40 bp, Artificial Sequence
  PCR primer for ORF amplification
aattacatgactcgagttataataacatggcggcagcggc

SEQ ID NO: 21549 - DNA, 40 bp, Artificial Sequence
  PCR primer for ORF amplification
aattacatgactcgagctaagcctctatatcttttaactg

SEQ ID NO: 21550 - DNA, 40 bp, Artificial Sequence
  PCR primer for ORF amplification
aattacatgactcgagttattgttcatttaatcattccaa

SEQ ID NO: 21551 - DNA, 40 bp, Artificial Sequence
  PCR primer for ORF amplification
aattacatgactcgagttatgatcttggcttttccttctt

SEQ ID NO: 21552 - DNA, 40 bp, Artificial Sequence
  PCR primer for ORF amplification
aattacatgactcgagttattttggcagtttgaaaccctt

SEQ ID NO: 21553 - DNA, 40 bp, Artificial Sequence
  PCR primer for ORF amplification
aattacatgactcgagttaccgcccattcaatcttctaga

SEQ ID NO: 21554 - DNA, 40 bp, Artificial Sequence
  PCR primer for ORF amplification
aattacatgactcgagctaattgtcttcgtcaacactcac

SEQ ID NO: 21555 - DNA, 40 bp, Artificial Sequence
  PCR primer for ORF amplification
aattacatgactcgagctataaaatattccaagcatcttc

SEQ ID NO: 21556 - DNA, 40 bp, Artificial Sequence
  PCR primer for ORF amplification
aattacatgactcgagttaatcttgttcagcaattgctac

SEQ ID NO: 21557 - DNA, 40 bp, Artificial Sequence
  PCR primer for ORF amplification
aattacatgactcgagtcacagaaatgctttattttcctt

SEQ ID NO: 21558 - DNA, 40 bp, Artificial Sequence
  PCR primer for ORF amplification
aattacatgactcgagtcaattgtgaaaagacgaagacaa

SEQ ID NO: 21559 - DNA, 40 bp, Artificial Sequence
  PCR primer for ORF amplification
aattacatgactcgagtcagaattgcaaagcttgaccctt

SEQ ID NO: 21560 - DNA, 40 bp, Artificial Sequence
  PCR primer for ORF amplification
aattacatgactcgagctagattataaaaggtattatggc

SEQ ID NO: 21561 - DNA, 40 bp, Artificial Sequence
  PCR primer for ORF amplification
aattacatgactcgagttacatatactgtttcaaaaccct

SEQ ID NO: 21562 - DNA, 40 bp, Artificial Sequence
  PCR primer for ORF amplification
aattacatgactcgagtcatccctcaagttttttcttcat

SEQ ID NO: 21563 - DNA, 40 bp, Artificial Sequence
  PCR primer for ORF amplification
aattacatgactcgagttatttcttagccttcttttcaga

SEQ ID NO: 21564 - DNA, 40 bp, Artificial Sequence
  PCR primer for ORF amplification
aattacatgactcgagttaagcatcttcttcgacaacaac

SEQ ID NO: 21565 - DNA, 40 bp, Artificial Sequence
  PCR primer for ORF amplification
aattacatgactcgagttatagttgttcatattcatcagg

SEQ ID NO: 21566 - DNA, 40 bp, Artificial Sequence
  PCR primer for ORF amplification
aattacatgactcgagtcaatcttttggtctgctcagggg

SEQ ID NO: 21567 - DNA, 40 bp, Artificial Sequence
  PCR primer for ORF amplification
aattacatgactcgagctataacaaaagggcaccaacggc

SEQ ID NO: 21568 - DNA, 40 bp, Artificial Sequence
  PCR primer for ORF amplification
aattacatgactcgagctataagttgaatagttcagtcaa

SEQ ID NO: 21569 - DNA, 40 bp, Artificial Sequence
  PCR primer for ORF amplification
aattacatgactcgagttaatggttagattttttcttttt

SEQ ID NO: 21570 - DNA, 40 bp, Artificial Sequence
  PCR primer for ORF amplification
aattacatgactcgagttactgcgcggctgtggtcccatt

SEQ ID NO: 21571 - DNA, 40 bp, Artificial Sequence
  PCR primer for ORF amplification
aattacatgactcgagttataacaacatagcggcagctgc

SEQ ID NO: 21572 - DNA, 40 bp, Artificial Sequence
  PCR primer for ORF amplification
aattacatgactcgagtcaaggcataaagtccgccaaggc

SEQ ID NO: 21573 - DNA, 40 bp, Artificial Sequence
  PCR primer for ORF amplification
aattacatgactcgagtcaaatttcatcatcgctctccac

SEQ ID NO: 21574 - DNA, 40 bp, Artificial Sequence
  PCR primer for ORF amplification
aattacatgactcgagttactggtcccagttttccaacag

SEQ ID NO: 21575 - DNA, 40 bp, Artificial Sequence
  PCR primer for ORF amplification
aattacatgactcgagttagaatctcttcttttgagcaga

SEQ ID NO: 21576 - DNA, 40 bp, Artificial Sequence
  PCR primer for ORF amplification
aattacatgactcgagttatgtgttgatttcaaatcctct

SEQ ID NO: 21577 - DNA, 40 bp, Artificial Sequence
  PCR primer for ORF amplification
aattacatgactcgagttagtgacgacgagaagcagcaat

SEQ ID NO: 21578 - DNA, 40 bp, Artificial Sequence
  PCR primer for ORF amplification
aattacatgactcgagttactctaacaaattcttacatag

SEQ ID NO: 21579 - DNA, 40 bp, Artificial Sequence
  PCR primer for ORF amplification
aattacatgactcgagtcaagtctgcttcttcaaagtgtt

SEQ ID NO: 21580 - DNA, 40 bp, Artificial Sequence
  PCR primer for ORF amplification
aattacatgactcgagttatattttatctccttggctggg

SEQ ID NO: 21581 - DNA, 40 bp, Artificial Sequence
  PCR primer for ORF amplification
aattacatgactcgagttataatactaatagaagcaacag

SEQ ID NO: 21582 - DNA, 40 bp, Artificial Sequence
  PCR primer for ORF amplification
aattacatgactcgagttacacagtttccaagacttcgtc

SEQ ID NO: 21583 - DNA, 40 bp, Artificial Sequence
  PCR primer for ORF amplification
aattacatgactcgagttacacagtttccaagacttcatc

SEQ ID NO: 21584 - DNA, 40 bp, Artificial Sequence
  PCR primer for ORF amplification
aattacatgactcgagtcatttattgtcaatatctaagtc

SEQ ID NO: 21585 - DNA, 40 bp, Artificial Sequence
  PCR primer for ORF amplification
aattacatgactcgagttaagccttgatagcgtactttct

SEQ ID NO: 21586 - DNA, 40 bp, Artificial Sequence
  PCR primer for ORF amplification
aattacatgactcgagttagcagttttcaggaatcaaggc

SEQ ID NO: 21587 - DNA, 40 bp, Artificial Sequence
  PCR primer for ORF amplification
aattacatgactcgagtcagatgatatcagctttacctac

SEQ ID NO: 21588 - DNA, 40 bp, Artificial Sequence
  PCR primer for ORF amplification
aattacatgactcgagctaaaagacgccttcgctgccgtc

SEQ ID NO: 21589 - DNA, 40 bp, Artificial Sequence
  PCR primer for ORF amplification
aattacatgactcgagctatttgggcttcacgatattctt

SEQ ID NO: 21590 - DNA, 40 bp, Artificial Sequence
  PCR primer for ORF amplification
aattacatgactcgagttacaaaagtttcctgcgatcact

SEQ ID NO: 21591 - DNA, 40 bp, Artificial Sequence
  PCR primer for ORF amplification
aattacatgactcgagttactcttccaaccttcttagcaa

SEQ ID NO: 21592 - DNA, 40 bp, Artificial Sequence
  PCR primer for ORF amplification
aattacatgactcgagttaagcggagtcggagttcttagc

SEQ ID NO: 21593 - DNA, 40 bp, Artificial Sequence
  PCR primer for ORF amplification
aattacatgactcgagttaagcggagtcggaagtcttagc

SEQ ID NO: 21594 - DNA, 40 bp, Artificial Sequence
  PCR primer for ORF amplification
aattacatgactcgagtcagaatataacatcgtcttcttg

SEQ ID NO: 21595 - DNA, 40 bp, Artificial Sequence
  PCR primer for ORF amplification
aattacatgactcgagctaaaatgctaaaaataataatga

SEQ ID NO: 21596 - DNA, 40 bp, Artificial Sequence
  PCR primer for ORF amplification
aattacatgactcgagttacttttcatggcttgtattttt

SEQ ID NO: 21597 - DNA, 40 bp, Artificial Sequence
  PCR primer for ORF amplification
aattacatgactcgagctaatccaattcagttgtctcatc

SEQ ID NO: 21598 - DNA, 40 bp, Artificial Sequence
  PCR primer for ORF amplification
aattacatgactcgagtcacctagaattccttcgtaaaat

SEQ ID NO: 21599 - DNA, 40 bp, Artificial Sequence
  PCR primer for ORF amplification
aattacatgactcgagtcagttttgtttaacaaatgctac

SEQ ID NO: 21600 - DNA, 40 bp, Artificial Sequence
  PCR primer for ORF amplification
aattacatgactcgagttatgctgtgataggacaagaatg

SEQ ID NO: 21601 - DNA, 40 bp, Artificial Sequence
  PCR primer for ORF amplification
aattacatgactcgagtcatgatttggtaaagagcttcag

SEQ ID NO: 21602 - DNA, 40 bp, Artificial Sequence
  PCR primer for ORF amplification
aattacatgactcgagctaaatgattctagcttcattttt

SEQ ID NO: 21603 - DNA, 40 bp, Artificial Sequence
  PCR primer for ORF amplification
aattacatgactcgagctaccattggaacaacgggtccgt

SEQ ID NO: 21604 - DNA, 40 bp, Artificial Sequence
  PCR primer for ORF amplification
aattacatgactcgagtcaatcaaatattgtcttattatt

SEQ ID NO: 21605 - DNA, 40 bp, Artificial Sequence
  PCR primer for ORF amplification
aattacatgactcgagttatacggtgatggtggataagtc

SEQ ID NO: 21606 - DNA, 40 bp, Artificial Sequence
  PCR primer for ORF amplification
aattacatgactcgagttacgagtcgaagccggccctgac

SEQ ID NO: 21607 - DNA, 40 bp, Artificial Sequence
  PCR primer for ORF amplification
aattacatgactcgagttacgtggagagtttgaccttctt

SEQ ID NO: 21608 - DNA, 40 bp, Artificial Sequence
  PCR primer for ORF amplification
aattacatgactcgagtcacttttcggtaacttcaacact

SEQ ID NO: 21609 - DNA, 40 bp, Artificial Sequence
  PCR primer for ORF amplification
aattacatgactcgagttaggttttaaaaccaccactttt

SEQ ID NO: 21610 - DNA, 40 bp, Artificial Sequence
  PCR primer for ORF amplification
aattacatgactcgagttatttcatatcttcatcagcttc

SEQ ID NO: 21611 - DNA, 40 bp, Artificial Sequence
  PCR primer for ORF amplification
aattacatgactcgagttattcttcgtcattaaatttagg

SEQ ID NO: 21612 - DNA, 40 bp, Artificial Sequence
  PCR primer for ORF amplification
aattacatgactcgagttatgtttctctaaattcatatgg

SEQ ID NO: 21613 - DNA, 40 bp, Artificial Sequence
  PCR primer for ORF amplification
aattacatgactcgagttattgatttgcgacttcgtcgta

SEQ ID NO: 21614 - DNA, 40 bp, Artificial Sequence
  PCR primer for ORF amplification
aattacatgactcgagctatttccttgctaggtttgccaa

SEQ ID NO: 21615 - DNA, 40 bp, Artificial Sequence
  PCR primer for ORF amplification
aattacatgactcgagtcattctgatttaggtcggagttc

SEQ ID NO: 21616 - DNA, 40 bp, Artificial Sequence
  PCR primer for ORF amplification
aattacatgactcgagtcaacttttccttttatttagcat

SEQ ID NO: 21617 - DNA, 40 bp, Artificial Sequence
  PCR primer for ORF amplification
aattacatgactcgagttaatgtaagtatactgcatcttt

SEQ ID NO: 21618 - DNA, 40 bp, Artificial Sequence
  PCR primer for ORF amplification
aattacatgactcgagttaaatgtgggtaccgttgttagc

SEQ ID NO: 21619 - DNA, 40 bp, Artificial Sequence
  PCR primer for ORF amplification
aattacatgactcgagttaacccctaactaattgagattt

SEQ ID NO: 21620 - DNA, 40 bp, Artificial Sequence
  PCR primer for ORF amplification
aattacatgactcgagctacagcgggtactctgacgccag

SEQ ID NO: 21621 - DNA, 40 bp, Artificial Sequence
  PCR primer for ORF amplification
aattacatgactcgagttatgacatttcaacatccgcttc

SEQ ID NO: 21622 - DNA, 40 bp, Artificial Sequence
  PCR primer for ORF amplification
aattacatgactcgagtcaaacttgtattagacgagggac

SEQ ID NO: 21623 - DNA, 40 bp, Artificial Sequence
  PCR primer for ORF amplification
aattacatgactcgagctaggcatcttgctttaaaaattg

SEQ ID NO: 21624 - DNA, 40 bp, Artificial Sequence
  PCR primer for ORF amplification
aattacatgactcgagttattctaaaactatgtcaccttc

SEQ ID NO: 21625 - DNA, 40 bp, Artificial Sequence
  PCR primer for ORF amplification
aattacatgactcgagctaaccttgcttttcattccatct

SEQ ID NO: 21626 - DNA, 40 bp, Artificial Sequence
  PCR primer for ORF amplification
aattacatgactcgagttatcctagcatacttctcttacg

SEQ ID NO: 21627 - DNA, 40 bp, Artificial Sequence
  PCR primer for ORF amplification
aattacatgactcgagttaaaccgtcatttcaccaataat

SEQ ID NO: 21628 - DNA, 40 bp, Artificial Sequence
  PCR primer for ORF amplification
aattacatgactcgagtcatacaagcaaaaccgcattgac

SEQ ID NO: 21629 - DNA, 40 bp, Artificial Sequence
  PCR primer for ORF amplification
aattacatgactcgagctacttatgcaagaccttattctc

SEQ ID NO: 21630 - DNA, 40 bp, Artificial Sequence
  PCR primer for ORF amplification
aattacatgactcgagtcattcctcctggggttgcttcga

SEQ ID NO: 21631 - DNA, 40 bp, Artificial Sequence
  PCR primer for ORF amplification
aattacatgactcgagtcaagccgttatatcgacttgttc

SEQ ID NO: 21632 - DNA, 40 bp, Artificial Sequence
  PCR primer for ORF amplification
aattacatgactcgagtcaacaaatattgtcaaaaatata

SEQ ID NO: 21633 - DNA, 40 bp, Artificial Sequence
  PCR primer for ORF amplification
aattacatgactcgagctacacaaagcgtcttccgggtag

SEQ ID NO: 21634 - DNA, 40 bp, Artificial Sequence
  PCR primer for ORF amplification
aattacatgactcgagctacttttcatgtgttaaatagta

SEQ ID NO: 21635 - DNA, 40 bp, Artificial Sequence
  PCR primer for ORF amplification
aattacatgactcgagttaaatggccttaacttcttttaa

SEQ ID NO: 21636 - DNA, 40 bp, Artificial Sequence
  PCR primer for ORF amplification
aattacatgactcgagttatttcgacttggtgaatcttaa

SEQ ID NO: 21637 - DNA, 40 bp, Artificial Sequence
  PCR primer for ORF amplification
aattacatgactcgagctaggcagtccctaggacagtgcc

SEQ ID NO: 21638 - DNA, 40 bp, Artificial Sequence
  PCR primer for ORF amplification
aattacatgactcgagctatgccgtttttataatggagac

SEQ ID NO: 21639 - DNA, 40 bp, Artificial Sequence
  PCR primer for ORF amplification
aattacatgactcgagtcaggtattgtgaacgaagggggg

SEQ ID NO: 21640 - DNA, 40 bp, Artificial Sequence
  PCR primer for ORF amplification
aattacatgactcgagtcaaatcaatggtttttcctcaat

SEQ ID NO: 21641 - DNA, 40 bp, Artificial Sequence
  PCR primer for ORF amplification
aattacatgactcgagctatttcaatgaaccagtttggaa

SEQ ID NO: 21642 - DNA, 40 bp, Artificial Sequence
  PCR primer for ORF amplification
aattacatgactcgagctaatgtagatcttctatgtacct

SEQ ID NO: 21643 - DNA, 40 bp, Artificial Sequence
  PCR primer for ORF amplification
aattacatgactcgagttaatctgttttgttccctttgaa

SEQ ID NO: 21644 - DNA, 40 bp, Artificial Sequence
  PCR primer for ORF amplification
aattacatgactcgagctagccctgcaccggccccagtcg

SEQ ID NO: 21645 - DNA, 40 bp, Artificial Sequence
  PCR primer for ORF amplification
aattacatgactcgagctagaagtggaggttctcggaagt

SEQ ID NO: 21646 - DNA, 40 bp, Artificial Sequence
  PCR primer for ORF amplification
aattacatgactcgagttagaatctcaacttggagaagaa

SEQ ID NO: 21647 - DNA, 40 bp, Artificial Sequence
  PCR primer for ORF amplification
aattacatgactcgagctaagcggatcttgctgtttccaa

SEQ ID NO: 21648 - DNA, 40 bp, Artificial Sequence
  PCR primer for ORF amplification
aattacatgactcgagtcagagaaacgaactatcctcgtt

SEQ ID NO: 21649 - DNA, 40 bp, Artificial Sequence
  PCR primer for ORF amplification
aattacatgactcgagttatttatagcattgcgcgtgaga

SEQ ID NO: 21650 - DNA, 40 bp, Artificial Sequence
  PCR primer for ORF amplification
aattacatgactcgagttattttatcccgagcgcacaaat

SEQ ID NO: 21651 - DNA, 40 bp, Artificial Sequence
  PCR primer for ORF amplification
aattacatgactcgagtcatataacccttctatgagttat

SEQ ID NO: 21652 - DNA, 40 bp, Artificial Sequence
  PCR primer for ORF amplification
aattacatgactcgagttattgatttgctatttcggtctt

SEQ ID NO: 21653 - DNA, 40 bp, Artificial Sequence
  PCR primer for ORF amplification
aattacatgactcgagctaatggaaaaactcgttaaccgt

SEQ ID NO: 21654 - DNA, 40 bp, Artificial Sequence
  PCR primer for ORF amplification
aattacatgactcgagttaattgtttttttttattgggtt

SEQ ID NO: 21655 - DNA, 40 bp, Artificial Sequence
  PCR primer for ORF amplification
aattacatgactcgagttatgtttttttgtctgctgcagc

SEQ ID NO: 21656 - DNA, 40 bp, Artificial Sequence
  PCR primer for ORF amplification
aattacatgactcgagttataaattctccagtgatcgtac

SEQ ID NO: 21657 - DNA, 40 bp, Artificial Sequence
  PCR primer for ORF amplification
aattacatgactcgagttacataaagtcgtcatcaccgaa

SEQ ID NO: 21658 - DNA, 40 bp, Artificial Sequence
  PCR primer for ORF amplification
aattacatgactcgagttactttcttctgaaagaagtacc

SEQ ID NO: 21659 - DNA, 40 bp, Artificial Sequence
  PCR primer for ORF amplification
aattacatgactcgagtcatacatcggcttgttcttgttc

SEQ ID NO: 21660 - DNA, 40 bp, Artificial Sequence
  PCR primer for ORF amplification
aattacatgactcgagctaaattttttgagtaccgtagcc

SEQ ID NO: 21661 - DNA, 40 bp, Artificial Sequence
  PCR primer for ORF amplification
aattacatgactcgagttacaatttacccaaggaatcgat

SEQ ID NO: 21662 - DNA, 40 bp, Artificial Sequence
  PCR primer for ORF amplification
aattacatgactcgagttacttcgatataccagagaatat

SEQ ID NO: 21663 - DNA, 40 bp, Artificial Sequence
  PCR primer for ORF amplification
aattacatgactcgagtcaataatcctcctgtagggtgta

SEQ ID NO: 21664 - DNA, 40 bp, Artificial Sequence
  PCR primer for ORF amplification
aattacatgactcgagttagtggaaaaacttcttcatctt

SEQ ID NO: 21665 - DNA, 40 bp, Artificial Sequence
  PCR primer for ORF amplification
aattacatgactcgagctaggcaaatgccaaagatttctt

SEQ ID NO: 21666 - DNA, 40 bp, Artificial Sequence
  PCR primer for ORF amplification
aattacatgactcgagttaagatcttggcttttccttctt

SEQ ID NO: 21667 - DNA, 40 bp, Artificial Sequence
  PCR primer for ORF amplification
aattacatgactcgagttaaaagaccaaatggtatagctg

SEQ ID NO: 21668 - DNA, 40 bp, Artificial Sequence
  PCR primer for ORF amplification
aattacatgactcgagtcaattgtataaatctacaaattt

SEQ ID NO: 21669 - DNA, 40 bp, Artificial Sequence
  PCR primer for ORF amplification
aattacatgactcgagtcaaaagcgacctcgctttgtggt

SEQ ID NO: 21670 - DNA, 40 bp, Artificial Sequence
  PCR primer for ORF amplification
aattacatgactcgagctaacgccatatattactatctaa

SEQ ID NO: 21671 - DNA, 40 bp, Artificial Sequence
  PCR primer for ORF amplification
aattacatgactcgagtcataaaacatcgatggcttgact

SEQ ID NO: 21672 - DNA, 40 bp, Artificial Sequence
  PCR primer for ORF amplification
aattacatgactcgagttactttggtgcttcaccttcggc

SEQ ID NO: 21673 - DNA, 40 bp, Artificial Sequence
  PCR primer for ORF amplification
aattacatgactcgagttatccacggaagatatgatgagg

SEQ ID NO: 21674 - DNA, 40 bp, Artificial Sequence
  PCR primer for ORF amplification
aattacatgactcgagttagttttgctggccgcatcttct

SEQ ID NO: 21675 - DNA, 40 bp, Artificial Sequence
  PCR primer for ORF amplification
aattacatgactcgagttaacactccctgcgccaattctg

SEQ ID NO: 21676 - DNA, 40 bp, Artificial Sequence
  PCR primer for ORF amplification
aattacatgactcgagctaaagggtttggaagccagcggc

SEQ ID NO: 21677 - DNA, 40 bp, Artificial Sequence
  PCR primer for ORF amplification
aattacatgactcgagtcactttatatagatataagagcc

SEQ ID NO: 21678 - DNA, 40 bp, Artificial Sequence
  PCR primer for ORF amplification
aattacatgactcgagttatctgtgcctcaaagcattaac

SEQ ID NO: 21679 - DNA, 40 bp, Artificial Sequence
  PCR primer for ORF amplification
aattacatgactcgagtcatcctttaacgcgcttgttcga

SEQ ID NO: 21680 - DNA, 40 bp, Artificial Sequence
  PCR primer for ORF amplification
aattacatgactcgagctatttgtcttggtgttgttcagg

SEQ ID NO: 21681 - DNA, 40 bp, Artificial Sequence
  PCR primer for ORF amplification
aattacatgactcgagttactgcggcattgtgacttgaac

SEQ ID NO: 21682 - DNA, 40 bp, Artificial Sequence
  PCR primer for ORF amplification
aattacatgactcgagtcatttgccttctgccgcattctt

SEQ ID NO: 21683 - DNA, 40 bp, Artificial Sequence
  PCR primer for ORF amplification
aattacatgactcgagttaaactctctttctgtaacgtct

SEQ ID NO: 21684 - DNA, 40 bp, Artificial Sequence
  PCR primer for ORF amplification
aattacatgactcgagctatttataaggatattcaacttg

SEQ ID NO: 21685 - DNA, 40 bp, Artificial Sequence
  PCR primer for ORF amplification
aattacatgactcgagttaagtgagatcaataacttcgat

SEQ ID NO: 21686 - DNA, 40 bp, Artificial Sequence
  PCR primer for ORF amplification
aattacatgactcgagttaaaaatcggtgcgttgtctttt

SEQ ID NO: 21687 - DNA, 40 bp, Artificial Sequence
  PCR primer for ORF amplification
aattacatgactcgagttagactcctcatcagtagaagac

SEQ ID NO: 21688 - DNA, 40 bp, Artificial Sequence
  PCR primer for ORF amplification
aattacatgactcgagttaaggggcggaggacgaagagga

SEQ ID NO: 21689 - DNA, 40 bp, Artificial Sequence
  PCR primer for ORF amplification
aattacatgactcgagttaatgttgtgggtgagattgtac

SEQ ID NO: 21690 - DNA, 40 bp, Artificial Sequence
  PCR primer for ORF amplification
aattacatgactcgagttaaaatttagcaaattgtttgtt

SEQ ID NO: 21691 - DNA, 40 bp, Artificial Sequence
  PCR primer for ORF amplification
aattacatgactcgagtcaagtttttttgattgcatcttg

SEQ ID NO: 21692 - DNA, 40 bp, Artificial Sequence
  PCR primer for ORF amplification
aattacatgactcgagtcataagagcatagcagcggcacc

SEQ ID NO: 21693 - DNA, 40 bp, Artificial Sequence
  PCR primer for ORF amplification
aattacatgactcgagtcatctgtaaatctcatcaaacgg

SEQ ID NO: 21694 - DNA, 40 bp, Artificial Sequence
  PCR primer for ORF amplification
aattacatgactcgagctataaatccaaagtaattaatgc

SEQ ID NO: 21695 - DNA, 40 bp, Artificial Sequence
  PCR primer for ORF amplification
aattacatgactcgagttaatcttcagacacagattcctt

SEQ ID NO: 21696 - DNA, 40 bp, Artificial Sequence
  PCR primer for ORF amplification
aattacatgactcgagtcactccatttttagttttccgct

SEQ ID NO: 21697 - DNA, 40 bp, Artificial Sequence
  PCR primer for ORF amplification
aattacatgactcgagtcaaaacatatcaagccatttaaa

SEQ ID NO: 21698 - DNA, 40 bp, Artificial Sequence
  PCR primer for ORF amplification
aattacatgactcgagttaagccttagccaaagccttctt

SEQ ID NO: 21699 - DNA, 40 bp, Artificial Sequence; identical to SEQ ID NO: 21698
  PCR primer for ORF amplification

SEQ ID NO: 21700 - DNA, 40 bp, Artificial Sequence; identical to SEQ ID NO: 20356
  PCR primer for ORF amplification

SEQ ID NO: 21701 - DNA, 40 bp, Artificial Sequence
  PCR primer for ORF amplification
aattacatgactcgagttataacttgtggcgcctgtttcc

SEQ ID NO: 21702 - DNA, 40 bp, Artificial Sequence
  PCR primer for ORF amplification
aattacatgactcgagttacacatcgccatgctgggattc

SEQ ID NO: 21703 - DNA, 40 bp, Artificial Sequence
  PCR primer for ORF amplification
aattacatgactcgagtcaaattccgaggggttcgtgaac

SEQ ID NO: 21704 - DNA, 40 bp, Artificial Sequence
  PCR primer for ORF amplification
aattacatgactcgagttagtcgtttgttatcataaagat

SEQ ID NO: 21705 - DNA, 40 bp, Artificial Sequence
  PCR primer for ORF amplification
aattacatgactcgagttaaacggcgctataaccgcctct

SEQ ID NO: 21706 - DNA, 40 bp, Artificial Sequence
  PCR primer for ORF amplification
aattacatgactcgagttacaaccgtcttctggtgaatat

SEQ ID NO: 21707 - DNA, 40 bp, Artificial Sequence
  PCR primer for ORF amplification
aattacatgactcgagttagtacactggtgaggcggtcag

SEQ ID NO: 21708 - DNA, 40 bp, Artificial Sequence
  PCR primer for ORF amplification
aattacatgactcgagttactcatcaccatcgttgaaatc

SEQ ID NO: 21709 - DNA, 40 bp, Artificial Sequence
  PCR primer for ORF amplification
aattacatgactcgagttaatcagcgttacgacgagcaac

SEQ ID NO: 21710 - DNA, 40 bp, Artificial Sequence
  PCR primer for ORF amplification
aattacatgactcgagtcaaataaaagagtttttaacttg

SEQ ID NO: 21711 - DNA, 40 bp, Artificial Sequence
  PCR primer for ORF amplification
aattacatgactcgagctatagaatagtgcaagtggaagc

SEQ ID NO: 21712 - DNA, 40 bp, Artificial Sequence
  PCR primer for ORF amplification
aattacatgactcgagctaaggacccaccagggtgaaatc

SEQ ID NO: 21713 - DNA, 40 bp, Artificial Sequence
  PCR primer for ORF amplification
aattacatgactcgagttataaaccatcattttcgatgaa

SEQ ID NO: 21714 - DNA, 40 bp, Artificial Sequence
  PCR primer for ORF amplification
aattacatgactcgagctattcttcgacatctatttggtc

SEQ ID NO: 21715 - DNA, 40 bp, Artificial Sequence
  PCR primer for ORF amplification
aattacatgactcgagtcattttaacttcttctttggacg

SEQ ID NO: 21716 - DNA, 40 bp, Artificial Sequence
  PCR primer for ORF amplification
aattacatgactcgagctacacaggtatcttccaaaacac

SEQ ID NO: 21717 - DNA, 40 bp, Artificial Sequence
  PCR primer for ORF amplification
aattacatgactcgagtcatcttctaactactttgtactt

SEQ ID NO: 21718 - DNA, 40 bp, Artificial Sequence
  PCR primer for ORF amplification
aattacatgactcgagttatagcacattttgtgggctctt

SEQ ID NO: 21719 - DNA, 40 bp, Artificial Sequence
  PCR primer for ORF amplification
aattacatgactcgagttagcgataaaatagttttgttga

SEQ ID NO: 21720 - DNA, 40 bp, Artificial Sequence
  PCR primer for ORF amplification
aattacatgactcgagctatattatgctaccatagctgga

SEQ ID NO: 21721 - DNA, 40 bp, Artificial Sequence
  PCR primer for ORF amplification
aattacatgactcgagttaataattgtaaaagcttaattt

SEQ ID NO: 21722 - DNA, 40 bp, Artificial Sequence
  PCR primer for ORF amplification
aattacatgactcgagttaagccaaagatggcaagttaga

SEQ ID NO: 21723 - DNA, 40 bp, Artificial Sequence
  PCR primer for ORF amplification
aattacatgactcgagttatttggttggttcaccttgagt

SEQ ID NO: 21724 - DNA, 40 bp, Artificial Sequence
  PCR primer for ORF amplification
aattacatgactcgagttaacaaacgtgctccaaaggtgt

SEQ ID NO: 21725 - DNA, 40 bp, Artificial Sequence
  PCR primer for ORF amplification
aattacatgactcgagctatcctacacgccatacttccaa

SEQ ID NO: 21726 - DNA, 40 bp, Artificial Sequence
  PCR primer for ORF amplification
aattacatgactcgagctatcttaaccatttcaacacata

SEQ ID NO: 21727 - DNA, 40 bp, Artificial Sequence
  PCR primer for ORF amplification
aattacatgactcgagtcaaatacgttttttatattcacc

SEQ ID NO: 21728 - DNA, 40 bp, Artificial Sequence
  PCR primer for ORF amplification
aattacatgactcgagctattccttaaccttaggtttgga

SEQ ID NO: 21729 - DNA, 40 bp, Artificial Sequence
  PCR primer for ORF amplification
aattacatgactcgagtcatagatataagtaattgtgtag

SEQ ID NO: 21730 - DNA, 40 bp, Artificial Sequence
  PCR primer for ORF amplification
aattacatgactcgagctaaacactaaccggtgaaggaag

SEQ ID NO: 21731 - DNA, 40 bp, Artificial Sequence
  PCR primer for ORF amplification
aattacatgactcgagctacatacggtttttcatagctct

SEQ ID NO: 21732 - DNA, 40 bp, Artificial Sequence
  PCR primer for ORF amplification
aattacatgactcgagttattcgtcttcttccaaagtttg

SEQ ID NO: 21733 - DNA, 40 bp, Artificial Sequence
  PCR primer for ORF amplification
aattacatgactcgagttacacaatattttcaatacttat

SEQ ID NO: 21734 - DNA, 40 bp, Artificial Sequence
  PCR primer for ORF amplification
aattacatgactcgagtcatttgtggtcgtcttcattcac

SEQ ID NO: 21735 - DNA, 40 bp, Artificial Sequence
  PCR primer for ORF amplification
aattacatgactcgagttagtactctatagcatgtaacgt

SEQ ID NO: 21736 - DNA, 40 bp, Artificial Sequence
  PCR primer for ORF amplification
aattacatgactcgagctagctttttaccttcttcttgac

SEQ ID NO: 21737 - DNA, 40 bp, Artificial Sequence; identical to SEQ ID NO: 21443
  PCR primer for ORF amplification

SEQ ID NO: 21738 - DNA, 40 bp, Artificial Sequence
  PCR primer for ORF amplification
aattacatgactcgagtcaagacgagcagtactcgctaag

SEQ ID NO: 21739 - DNA, 40 bp, Artificial Sequence
  PCR primer for ORF amplification
aattacatgactcgagtcagctctcctggttcgagaactt

SEQ ID NO: 21740 - DNA, 40 bp, Artificial Sequence
  PCR primer for ORF amplification
aattacatgactcgagttacaatttaatatcactcagatc

SEQ ID NO: 21741 - DNA, 40 bp, Artificial Sequence
  PCR primer for ORF amplification
aattacatgactcgagttagtagcgttcttttaatctaga

SEQ ID NO: 21742 - DNA, 40 bp, Artificial Sequence
  PCR primer for ORF amplification
aattacatgactcgagtcagttttgttcggctttttcatt

SEQ ID NO: 21743 - DNA, 40 bp, Artificial Sequence
  PCR primer for ORF amplification
aattacatgactcgagttaattagatttttcgtcggcgtt

SEQ ID NO: 21744 - DNA, 40 bp, Artificial Sequence
  PCR primer for ORF amplification
aattacatgactcgagttaaggagcatttggcattgtgtg

SEQ ID NO: 21745 - DNA, 40 bp, Artificial Sequence
  PCR primer for ORF amplification
aattacatgactcgagttaaccaaatccagcccattctat

SEQ ID NO: 21746 - DNA, 40 bp, Artificial Sequence
  PCR primer for ORF amplification
aattacatgactcgagctagaacctgtgtcttcttttcct

SEQ ID NO: 21747 - DNA, 40 bp, Artificial Sequence
  PCR primer for ORF amplification
aattacatgactcgagttatttatggcgctggtataattc

SEQ ID NO: 21748 - DNA, 40 bp, Artificial Sequence
  PCR primer for ORF amplification
aattacatgactcgagtcactccttgtgctcctcatcgtc

SEQ ID NO: 21749 - DNA, 40 bp, Artificial Sequence
  PCR primer for ORF amplification
aattacatgactcgagtcatacttttctcatgttgatttt

SEQ ID NO: 21750 - DNA, 40 bp, Artificial Sequence
  PCR primer for ORF amplification
aattacatgactcgagttattccaacttaccgccctttct

SEQ ID NO: 21751 - DNA, 40 bp, Artificial Sequence
  PCR primer for ORF amplification
aattacatgactcgagtcagaacttagctaaatttgtaga

SEQ ID NO: 21752 - DNA, 40 bp, Artificial Sequence
  PCR primer for ORF amplification
aattacatgactcgagctatggctttggaattttcaagct

SEQ ID NO: 21753 - DNA, 40 bp, Artificial Sequence; identical to SEQ ID NO: 21559
  PCR primer for ORF amplification

SEQ ID NO: 21754 - DNA, 40 bp, Artificial Sequence
  PCR primer for ORF amplification
aattacatgactcgagtcaaagctcgtcatgactactggt

SEQ ID NO: 21755 - DNA, 40 bp, Artificial Sequence
  PCR primer for ORF amplification
aattacatgactcgagtcaaaattctataggctgtccatt

SEQ ID NO: 21756 - DNA, 40 bp, Artificial Sequence
  PCR primer for ORF amplification
aattacatgactcgagttatgctttaagtatttcctcaag

SEQ ID NO: 21757 - DNA, 40 bp, Artificial Sequence
  PCR primer for ORF amplification
aattacatgactcgagctaatcgtggtggcaaaaaaatat

SEQ ID NO: 21758 - DNA, 40 bp, Artificial Sequence
  PCR primer for ORF amplification
aattacatgactcgagttagatttttttcctctttgtgta

SEQ ID NO: 21759 - DNA, 40 bp, Artificial Sequence
  PCR primer for ORF amplification
aattacatgactcgagtcagttaactgaatgaaacaataa

SEQ ID NO: 21760 - DNA, 40 bp, Artificial Sequence
  PCR primer for ORF amplification
aattacatgactcgagttaattatccctataaaatgaaac

SEQ ID NO: 21761 - DNA, 40 bp, Artificial Sequence
  PCR primer for ORF amplification
aattacatgactcgagttaaatgacacgagagaaggagac

SEQ ID NO: 21762 - DNA, 40 bp, Artificial Sequence
  PCR primer for ORF amplification
aattacatgactcgagttagcttggaggtaaacgatatat

SEQ ID NO: 21763 - DNA, 40 bp, Artificial Sequence
  PCR primer for ORF amplification
aattacatgactcgagttacgtctccaaagcagttctact

SEQ ID NO: 21764 - DNA, 40 bp, Artificial Sequence
  PCR primer for ORF amplification
aattacatgactcgagtcaaaatcccttccactcttcctc

SEQ ID NO: 21765 - DNA, 40 bp, Artificial Sequence
  PCR primer for ORF amplification
aattacatgactcgagttacgcgtatctggcaacttcttc

SEQ ID NO: 21766 - DNA, 40 bp, Artificial Sequence
  PCR primer for ORF amplification
aattacatgactcgagttaaaccgccggtgtctcgaactc

SEQ ID NO: 21767 - DNA, 40 bp, Artificial Sequence
  PCR primer for ORF amplification
aattacatgactcgagtcatttgagagactttcctcgttt

SEQ ID NO: 21768 - DNA, 40 bp, Artificial Sequence
  PCR primer for ORF amplification
aattacatgactcgagtcattttgttttttccttctccga

SEQ ID NO: 21769 - DNA, 40 bp, Artificial Sequence
  PCR primer for ORF amplification
aattacatgactcgagctatctcttgacccatgttggcat

SEQ ID NO: 21770 - DNA, 40 bp, Artificial Sequence
  PCR primer for ORF amplification
aattacatgactcgagttatttcttagacttcttttcaga

SEQ ID NO: 21771 - DNA, 40 bp, Artificial Sequence
  PCR primer for ORF amplification
aattacatgactcgagttagtctagcttcgacgttggggc

SEQ ID NO: 21772 - DNA, 40 bp, Artificial Sequence
  PCR primer for ORF amplification
aattacatgactcgagtcacagacgtttggcaaacttcca

SEQ ID NO: 21773 - DNA, 40 bp, Artificial Sequence
  PCR primer for ORF amplification
aattacatgactcgagtcatctcttctgggccaccaccca

SEQ ID NO: 21774 - DNA, 40 bp, Artificial Sequence
  PCR primer for ORF amplification
aattacatgactcgagttactctagtgctcttctcatgaa

SEQ ID NO: 21775 - DNA, 40 bp, Artificial Sequence
  PCR primer for ORF amplification
aattacatgactcgagctaattctgtatataatatagcat

SEQ ID NO: 21776 - DNA, 40 bp, Artificial Sequence
  PCR primer for ORF amplification
aattacatgactcgagttatgatatcataccatcgtcaat

SEQ ID NO: 21777 - DNA, 40 bp, Artificial Sequence
  PCR primer for ORF amplification
aattacatgactcgagttactcggtatttttcttaacgta

SEQ ID NO: 21778 - DNA, 40 bp, Artificial Sequence
  PCR primer for ORF amplification
aattacatgactcgagttaattcgttgaacgtgccgcatc

SEQ ID NO: 21779 - DNA, 40 bp, Artificial Sequence
  PCR primer for ORF amplification
aattacatgactcgagtcaattctgcttcttggtcacttg

SEQ ID NO: 21780 - DNA, 40 bp, Artificial Sequence
  PCR primer for ORF amplification
aattacatgactcgagttaaaacccatgttgactcatgat

SEQ ID NO: 21781 - DNA, 40 bp, Artificial Sequence
  PCR primer for ORF amplification
aattacatgactcgagttaagctcttcttctaccagtggt

SEQ ID NO: 21782 - DNA, 40 bp, Artificial Sequence
  PCR primer for ORF amplification
aattacatgactcgagtcaacagaaaacatcagctttcat

SEQ ID NO: 21783 - DNA, 40 bp, Artificial Sequence
  PCR primer for ORF amplification
aattacatgactcgagctatctatttctgcacctagtttc

SEQ ID NO: 21784 - DNA, 40 bp, Artificial Sequence
  PCR primer for ORF amplification
aattacatgactcgagctaatccaatattggtgttcttgc

SEQ ID NO: 21785 - DNA, 40 bp, Artificial Sequence
  PCR primer for ORF amplification
aattacatgactcgagttagaacaggtcggacacaacgtg

SEQ ID NO: 21786 - DNA, 40 bp, Artificial Sequence
  PCR primer for ORF amplification
aattacatgactcgagttagtatcctacccaactgaacct

SEQ ID NO: 21787 - DNA, 40 bp, Artificial Sequence
  PCR primer for ORF amplification
aattacatgactcgagttattttttacttttctttaacct

SEQ ID NO: 21788 - DNA, 40 bp, Artificial Sequence
  PCR primer for ORF amplification
aattacatgactcgagttaaatgtaaccgattctgttagc

SEQ ID NO: 21789 - DNA, 40 bp, Artificial Sequence
  PCR primer for ORF amplification
aattacatgactcgagtcaatcctgagttgtgaatgcttg

SEQ ID NO: 21790 - DNA, 40 bp, Artificial Sequence
  PCR primer for ORF amplification
aattacatgactcgagtcataaacgatgcttcctttgttt

SEQ ID NO: 21791 - DNA, 40 bp, Artificial Sequence
  PCR primer for ORF amplification
aattacatgactcgagtcatatgtataccggcaatagtaa

SEQ ID NO: 21792 - DNA, 40 bp, Artificial Sequence
  PCR primer for ORF amplification
aattacatgactcgagttaagtaaaagagcttttgaaacc

SEQ ID NO: 21793 - DNA, 40 bp, Artificial Sequence
  PCR primer for ORF amplification
aattacatgactcgagtcaattatccgctaaaagaaattc

SEQ ID NO: 21794 - DNA, 40 bp, Artificial Sequence
  PCR primer for ORF amplification
aattacatgactcgagttagaggaagacaaccatgaccgt

SEQ ID NO: 21795 - DNA, 40 bp, Artificial Sequence
  PCR primer for ORF amplification
aattacatgactcgagttatttatttgaagtatgataaat

SEQ ID NO: 21796 - DNA, 40 bp, Artificial Sequence
  PCR primer for ORF amplification
aattacatgactcgagtcagggcgagaacgatagagacca

SEQ ID NO: 21797 - DNA, 40 bp, Artificial Sequence
  PCR primer for ORF amplification
aattacatgactcgagttaccattgtagaggcaaccagtt

SEQ ID NO: 21798 - DNA, 40 bp, Artificial Sequence
  PCR primer for ORF amplification
aattacatgactcgagtcagcgttcgccaactaatttctt

SEQ ID NO: 21799 - DNA, 40 bp, Artificial Sequence
  PCR primer for ORF amplification
aattacatgactcgagttagtaatatctatcgctttggtt

SEQ ID NO: 21800 - DNA, 40 bp, Artificial Sequence
  PCR primer for ORF amplification
aattacatgactcgagtcaaactagattatctatatagtc

SEQ ID NO: 21801 - DNA, 40 bp, Artificial Sequence
  PCR primer for ORF amplification
aattacatgactcgagtcagttacgttttcttttcagttt

SEQ ID NO: 21802 - DNA, 40 bp, Artificial Sequence
  PCR primer for ORF amplification
aattacatgactcgagttagatgttggatgggtacaagaa

SEQ ID NO: 21803 - DNA, 40 bp, Artificial Sequence
  PCR primer for ORF amplification
aattacatgactcgagttaagtcaaagatattgagttttt

SEQ ID NO: 21804 - DNA, 40 bp, Artificial Sequence
  PCR primer for ORF amplification
aattacatgactcgagttatggcgcgtctgtgcattccca

SEQ ID NO: 21805 - DNA, 40 bp, Artificial Sequence
  PCR primer for ORF amplification
aattacatgactcgagttagaagaacaccttatcattgct

SEQ ID NO: 21806 - DNA, 40 bp, Artificial Sequence
  PCR primer for ORF amplification
aattacatgactcgagttaaatgttagatgggtacaagaa

SEQ ID NO: 21807 - DNA, 40 bp, Artificial Sequence
  PCR primer for ORF amplification
aattacatgactcgagttacaattttacaacaccagattt

SEQ ID NO: 21808 - DNA, 40 bp, Artificial Sequence
  PCR primer for ORF amplification
aattacatgactcgagttaagcaattctgtcttcaacatc

SEQ ID NO: 21809 - DNA, 40 bp, Artificial Sequence
  PCR primer for ORF amplification
aattacatgactcgagctattttaaaagtttaaaagcgtt

SEQ ID NO: 21810 - DNA, 40 bp, Artificial Sequence
  PCR primer for ORF amplification
aattacatgactcgagctagtcgagtaggataggttcatt

SEQ ID NO: 21811 - DNA, 40 bp, Artificial Sequence
  PCR primer for ORF amplification
aattacatgactcgagttaccaagtggaaatttctgtttc

SEQ ID NO: 21812 - DNA, 40 bp, Artificial Sequence
  PCR primer for ORF amplification
aattacatgactcgagctaacttaatacagcaagcaatac

SEQ ID NO: 21813 - DNA, 40 bp, Artificial Sequence
  PCR primer for ORF amplification
aattacatgactcgagtcagccaaatctcaaaccttccct

SEQ ID NO: 21814 - DNA, 40 bp, Artificial Sequence
  PCR primer for ORF amplification
aattacatgactcgagtcaagcgtcgaaggacaaagacca

SEQ ID NO: 21815 - DNA, 40 bp, Artificial Sequence
  PCR primer for ORF amplification
aattacatgactcgagctaattggtcgacacagccgcggg

SEQ ID NO: 21816 - DNA, 40 bp, Artificial Sequence
  PCR primer for ORF amplification
aattacatgactcgagttaaaagattaccctttcagtaga

SEQ ID NO: 21817 - DNA, 40 bp, Artificial Sequence
  PCR primer for ORF amplification
aattacatgactcgagttaacatgcaaatgcaccgcgagt

SEQ ID NO: 21818 - DNA, 40 bp, Artificial Sequence
  PCR primer for ORF amplification
aattacatgactcgagttaagccttaatagcgtactttct

SEQ ID NO: 21819 - DNA, 40 bp, Artificial Sequence
  PCR primer for ORF amplification
aattacatgactcgagctatagcaagcttgaagagtacat

SEQ ID NO: 21820 - DNA, 40 bp, Artificial Sequence
  PCR primer for ORF amplification
aattacatgactcgagttacgctctcatttctccagccgt

SEQ ID NO: 21821 - DNA, 40 bp, Artificial Sequence
  PCR primer for ORF amplification
aattacatgactcgagttataaatccaaggtcaaaatcct

SEQ ID NO: 21822 - DNA, 40 bp, Artificial Sequence
  PCR primer for ORF amplification
aattacatgactcgagtcaatgctcttgatccctagattg

SEQ ID NO: 21823 - DNA, 40 bp, Artificial Sequence
  PCR primer for ORF amplification
aattacatgactcgagttaagaattagaagggatgtcttt

SEQ ID NO: 21824 - DNA, 40 bp, Artificial Sequence
  PCR primer for ORF amplification
aattacatgactcgagttaaaacacaaacacctggtcttc

SEQ ID NO: 21825 - DNA, 40 bp, Artificial Sequence
  PCR primer for ORF amplification
aattacatgactcgagctattgtaagcgcttcactccagt

SEQ ID NO: 21826 - DNA, 40 bp, Artificial Sequence
  PCR primer for ORF amplification
aattacatgactcgagctagaagtcgtccggatcaaacag

SEQ ID NO: 21827 - DNA, 40 bp, Artificial Sequence
  PCR primer for ORF amplification
aattacatgactcgagttagataaaacccttctctattag

SEQ ID NO: 21828 - DNA, 40 bp, Artificial Sequence
  PCR primer for ORF amplification
aattacatgactcgagtcagctatgtttcttggatttttc

SEQ ID NO: 21829 - DNA, 40 bp, Artificial Sequence
  PCR primer for ORF amplification
aattacatgactcgagttacatagcgtttttaagctttct

SEQ ID NO: 21830 - DNA, 40 bp, Artificial Sequence
  PCR primer for ORF amplification
aattacatgactcgagtcacggcatgtgaaggcaatatac

SEQ ID NO: 21831 - DNA, 40 bp, Artificial Sequence
  PCR primer for ORF amplification
aattacatgactcgagttaagcaaaatcgattacaatacc

SEQ ID NO: 21832 - DNA, 40 bp, Artificial Sequence
  PCR primer for ORF amplification
aattacatgactcgagctactggtcgttccagaatttata

SEQ ID NO: 21833 - DNA, 40 bp, Artificial Sequence
  PCR primer for ORF amplification
aattacatgactcgagctatataaggtcatcttccacttc

SEQ ID NO: 21834 - DNA, 40 bp, Artificial Sequence
  PCR primer for ORF amplification
aattacatgactcgagtcacattctccttctcttaccaac

SEQ ID NO: 21835 - DNA, 40 bp, Artificial Sequence
  PCR primer for ORF amplification
aattacatgactcgagttataagtacgtcaataagcctaa

SEQ ID NO: 21836 - DNA, 40 bp, Artificial Sequence
  PCR primer for ORF amplification
aattacatgactcgagtcaccaggtcattctctgcaaagc

SEQ ID NO: 21837 - DNA, 40 bp, Artificial Sequence
  PCR primer for ORF amplification
aattacatgactcgagttaagattggagagcatgctgcaa

SEQ ID NO: 21838 - DNA, 40 bp, Artificial Sequence
  PCR primer for ORF amplification
aattacatgactcgagttacaatatggctggcgttggtaa

SEQ ID NO: 21839 - DNA, 40 bp, Artificial Sequence
  PCR primer for ORF amplification
aattacatgactcgagctatttcttcttttggcctaattg

SEQ ID NO: 21840 - DNA, 40 bp, Artificial Sequence
  PCR primer for ORF amplification
aattacatgactcgagctagattgtttgaccaaaagatct

SEQ ID NO: 21841 - DNA, 40 bp, Artificial Sequence
  PCR primer for ORF amplification
aattacatgactcgagttagtcaaaaaatccatcatcatc

SEQ ID NO: 21842 - DNA, 40 bp, Artificial Sequence
  PCR primer for ORF amplification
aattacatgactcgagttaattcaactttttttctttcaa

SEQ ID NO: 21843 - DNA, 40 bp, Artificial Sequence
  PCR primer for ORF amplification
aattacatgactcgagttattccaatttaccaccctttct

SEQ ID NO: 21844 - DNA, 40 bp, Artificial Sequence
  PCR primer for ORF amplification
aattacatgactcgagttaagcagcaatacgcttttgggc

SEQ ID NO: 21845 - DNA, 40 bp, Artificial Sequence
  PCR primer for ORF amplification
aattacatgactcgagttaaaatacggcatcatggaaagg

SEQ ID NO: 21846 - DNA, 40 bp, Artificial Sequence
  PCR primer for ORF amplification
aattacatgactcgagttagtattggccttgttgcggttc

SEQ ID NO: 21847 - DNA, 40 bp, Artificial Sequence
  PCR primer for ORF amplification
aattacatgactcgagttatacccactccgcttccacttg

SEQ ID NO: 21848 - DNA, 40 bp, Artificial Sequence
  PCR primer for ORF amplification
aattacatgactcgagctaaaatgtagcccttttttgttt

SEQ ID NO: 21849 - DNA, 40 bp, Artificial Sequence
  PCR primer for ORF amplification
aattacatgactcgagttaaacagaaccggagatgaagaa

SEQ ID NO: 21850 - DNA, 40 bp, Artificial Sequence
  PCR primer for ORF amplification
aattacatgactcgagttagccaataacgttgttgaaaga

SEQ ID NO: 21851 - DNA, 40 bp, Artificial Sequence
  PCR primer for ORF amplification
aattacatgactcgagtcaacaatcgacgagaccaactgt

SEQ ID NO: 21852 - DNA, 40 bp, Artificial Sequence
  PCR primer for ORF amplification
aattacatgactcgagttattctgatattacagtactctt

SEQ ID NO: 21853 - DNA, 40 bp, Artificial Sequence
  PCR primer for ORF amplification
aattacatgactcgagttaacggccaatgttcaaaagcaa

SEQ ID NO: 21854 - DNA, 40 bp, Artificial Sequence
  PCR primer for ORF amplification
aattacatgactcgagctataaagactgtaaacctctgat

SEQ ID NO: 21855 - DNA, 40 bp, Artificial Sequence
  PCR primer for ORF amplification
aattacatgactcgagttaacggtaagatttttggaatct

SEQ ID NO: 21856 - DNA, 40 bp, Artificial Sequence; identical to SEQ ID NO: 20856
  PCR primer for ORF amplification

SEQ ID NO: 21857 - DNA, 40 bp, Artificial Sequence
  PCR primer for ORF amplification
aattacatgactcgagctattctaggtgaatatcaccctc

SEQ ID NO: 21858 - DNA, 40 bp, Artificial Sequence
  PCR primer for ORF amplification
aattacatgactcgagttatagcattctatgaatttgcct

SEQ ID NO: 21859 - DNA, 40 bp, Artificial Sequence
  PCR primer for ORF amplification
aattacatgactcgagctatgcaacagtcaaaggatcgca

SEQ ID NO: 21860 - DNA, 40 bp, Artificial Sequence
  PCR primer for ORF amplification
aattacatgactcgagtcacattaggccatcaaaccattt

SEQ ID NO: 21861 - DNA, 40 bp, Artificial Sequence
  PCR primer for ORF amplification
aattacatgactcgagtcaatcaagtatgtctttgtgaat

SEQ ID NO: 21862 - DNA, 40 bp, Artificial Sequence
  PCR primer for ORF amplification
aattacatgactcgagctactcatcatgacagtaaattag

SEQ ID NO: 21863 - DNA, 40 bp, Artificial Sequence
  PCR primer for ORF amplification
aattacatgactcgagctaatcttcgaagctaatcttggc

SEQ ID NO: 21864 - DNA, 40 bp, Artificial Sequence
  PCR primer for ORF amplification
aattacatgactcgagttacaatttcataatgagaaaaat

SEQ ID NO: 21865 - DNA, 40 bp, Artificial Sequence
  PCR primer for ORF amplification
aattacatgactcgagttatagttttccttttggcaaccg

SEQ ID NO: 21866 - DNA, 40 bp, Artificial Sequence
  PCR primer for ORF amplification
aattacatgactcgagttacataccttcatcggacaaagg

SEQ ID NO: 21867 - DNA, 40 bp, Artificial Sequence
  PCR primer for ORF amplification
aattacatgactcgagctaagtagcagccacggttggacg

SEQ ID NO: 21868 - DNA, 40 bp, Artificial Sequence
  PCR primer for ORF amplification
aattacatgactcgagtcagaatacgcctggccctgtaat

SEQ ID NO: 21869 - DNA, 40 bp, Artificial Sequence
  PCR primer for ORF amplification
aattacatgactcgagttagttgaaagtgtttctgtgaat

SEQ ID NO: 21870 - DNA, 40 bp, Artificial Sequence
  PCR primer for ORF amplification
aattacatgactcgagttatataccaatctctttgtcagg

SEQ ID NO: 21871 - DNA, 40 bp, Artificial Sequence
  PCR primer for ORF amplification
aattacatgactcgagttataacacatcatcaagtaaatc

SEQ ID NO: 21872 - DNA, 40 bp, Artificial Sequence
  PCR primer for ORF amplification
aattacatgactcgagttagatgaaagtttcgtatggaac

SEQ ID NO: 21873 - DNA, 40 bp, Artificial Sequence
  PCR primer for ORF amplification
aattacatgactcgagttaagcagagatacgtttttgggc

SEQ ID NO: 21874 - DNA, 40 bp, Artificial Sequence
  PCR primer for ORF amplification
aattacatgactcgagttaacgcgttttgacaacggctgg

SEQ ID NO: 21875 - DNA, 40 bp, Artificial Sequence
  PCR primer for ORF amplification
aattacatgactcgagttattttctttctcgttctatatg

SEQ ID NO: 21876 - DNA, 40 bp, Artificial Sequence
  PCR primer for ORF amplification
aattacatgactcgagtcacaaatagtcttttttattggc

SEQ ID NO: 21877 - DNA, 40 bp, Artificial Sequence
  PCR primer for ORF amplification
aattacatgactcgagtcataatacatactttacggctaa

SEQ ID NO: 21878 - DNA, 40 bp, Artificial Sequence
  PCR primer for ORF amplification
aattacatgactcgagttagttaaaagggattctaatgga

SEQ ID NO: 21879 - DNA, 40 bp, Artificial Sequence
  PCR primer for ORF amplification
aattacatgactcgagttatttcttgaatgttttgattac

SEQ ID NO: 21880 - DNA, 40 bp, Artificial Sequence
  PCR primer for ORF amplification
aattacatgactcgagttaattttctgcaaacatactgat

SEQ ID NO: 21881 - DNA, 40 bp, Artificial Sequence
  PCR primer for ORF amplification
aattacatgactcgagtcactgaaaaatatttattttttc

SEQ ID NO: 21882 - DNA, 40 bp, Artificial Sequence
  PCR primer for ORF amplification
aattacatgactcgagttaaacatcaacgaagaaattctt

SEQ ID NO: 21883 - DNA, 40 bp, Artificial Sequence
  PCR primer for ORF amplification
aattacatgactcgagctattcaatacatctcgttttcgt

SEQ ID NO: 21884 - DNA, 40 bp, Artificial Sequence
  PCR primer for ORF amplification
aattacatgactcgagttaagcgttgctagcgttagtgta

SEQ ID NO: 21885 - DNA, 40 bp, Artificial Sequence
  PCR primer for ORF amplification
aattacatgactcgagttaatcggcgttacgacgagcaac

SEQ ID NO: 21886 - DNA, 40 bp, Artificial Sequence
  PCR primer for ORF amplification
aattacatgactcgagttatttttggtcttgtttcaaagt

SEQ ID NO: 21887 - DNA, 40 bp, Artificial Sequence
  PCR primer for ORF amplification
aattacatgactcgagttacattataatacacttgttttt

SEQ ID NO: 21888 - DNA, 40 bp, Artificial Sequence
  PCR primer for ORF amplification
aattacatgactcgagttaatagacaaaacccaagatttt

SEQ ID NO: 21889 - DNA, 40 bp, Artificial Sequence
  PCR primer for ORF amplification
aattacatgactcgagttacttatgtttcggtatttccgt

SEQ ID NO: 21890 - DNA, 40 bp, Artificial Sequence
  PCR primer for ORF amplification
aattacatgactcgagctaatgcgcatttacatcggagta

SEQ ID NO: 21891 - DNA, 40 bp, Artificial Sequence
  PCR primer for ORF amplification
aattacatgactcgagttatataaccgaatattcagtttc

SEQ ID NO: 21892 - DNA, 40 bp, Artificial Sequence
  PCR primer for ORF amplification
aattacatgactcgagtcattctcttttcctacataagta

SEQ ID NO: 21893 - DNA, 40 bp, Artificial Sequence
  PCR primer for ORF amplification
aattacatgactcgagctatttttttcgtgatttaggttc

SEQ ID NO: 21894 - DNA, 40 bp, Artificial Sequence
  PCR primer for ORF amplification
aattacatgactcgagttaattaagggaagactcactatc

SEQ ID NO: 21895 - DNA, 40 bp, Artificial Sequence
  PCR primer for ORF amplification
aattacatgactcgagttaattgaataaatatctgcccaa

SEQ ID NO: 21896 - DNA, 40 bp, Artificial Sequence
  PCR primer for ORF amplification
aattacatgactcgagttaatataacagtattttcacgga

SEQ ID NO: 21897 - DNA, 40 bp, Artificial Sequence
  PCR primer for ORF amplification
aattacatgactcgagttatttaaacaaggcatcgtttga

SEQ ID NO: 21898 - DNA, 40 bp, Artificial Sequence; identical to SEQ ID NO: 21781
  PCR primer for ORF amplification

SEQ ID NO: 21899 - DNA, 40 bp, Artificial Sequence
  PCR primer for ORF amplification
aattacatgactcgagttataatttagatgtcatactctt

SEQ ID NO: 21900 - DNA, 40 bp, Artificial Sequence
  PCR primer for ORF amplification
aattacatgactcgagttaggcaatttcaaatccacttga

SEQ ID NO: 21901 - DNA, 40 bp, Artificial Sequence
  PCR primer for ORF amplification
aattacatgactcgagttatttctcctctccgaaaaatgg

SEQ ID NO: 21902 - DNA, 40 bp, Artificial Sequence
  PCR primer for ORF amplification
aattacatgactcgagttaaagtgcagaaagagtctcaaa

SEQ ID NO: 21903 - DNA, 40 bp, Artificial Sequence
  PCR primer for ORF amplification
aattacatgactcgagctatctattcgtagaaaaatgaat

SEQ ID NO: 21904 - DNA, 40 bp, Artificial Sequence
  PCR primer for ORF amplification
aattacatgactcgagtcaaaaaggtttggcacatttgcg

SEQ ID NO: 21905 - DNA, 40 bp, Artificial Sequence
  PCR primer for ORF amplification
aattacatgactcgagttagtattctaactcacccgcaac

SEQ ID NO: 21906 - DNA, 40 bp, Artificial Sequence
  PCR primer for ORF amplification
aattacatgactcgagttattcttcttcacttatgtcgtc

SEQ ID NO: 21907 - DNA, 40 bp, Artificial Sequence
  PCR primer for ORF amplification
aattacatgactcgagctaaaaacctctcacaagacaaaa

SEQ ID NO: 21908 - DNA, 40 bp, Artificial Sequence
  PCR primer for ORF amplification
aattacatgactcgagtcatatcttattcaaaattaattc

SEQ ID NO: 21909 - DNA, 40 bp, Artificial Sequence
  PCR primer for ORF amplification
aattacatgactcgagttagcattcaaactctaaaataac

SEQ ID NO: 21910 - DNA, 40 bp, Artificial Sequence
  PCR primer for ORF amplification
aattacatgactcgagtcattcactaagatgttcaattaa

SEQ ID NO: 21911 - DNA, 40 bp, Artificial Sequence
  PCR primer for ORF amplification
aattacatgactcgagctatacatcgttgtagagagttat

SEQ ID NO: 21912 - DNA, 40 bp, Artificial Sequence
  PCR primer for ORF amplification
aattacatgactcgagttaaggcttgtgtcttttggaagc

SEQ ID NO: 21913 - DNA, 40 bp, Artificial Sequence
  PCR primer for ORF amplification
aattacatgactcgagttaatctggctttgatcgcttgtt

SEQ ID NO: 21914 - DNA, 40 bp, Artificial Sequence
  PCR primer for ORF amplification
aattacatgactcgagttattttggagattctatctgggg

SEQ ID NO: 21915 - DNA, 40 bp, Artificial Sequence
  PCR primer for ORF amplification
aattacatgactcgagctaatttaattccttggctgccca

SEQ ID NO: 21916 - DNA, 40 bp, Artificial Sequence
  PCR primer for ORF amplification
aattacatgactcgagctaccattctctgtccaaaaacct

SEQ ID NO: 21917 - DNA, 40 bp, Artificial Sequence
  PCR primer for ORF amplification
aattacatgactcgagctaatcaacttcccaccgggtgca

SEQ ID NO: 21918 - DNA, 40 bp, Artificial Sequence
  PCR primer for ORF amplification
aattacatgactcgagctatgtgtcctttggagctggcga

SEQ ID NO: 21919 - DNA, 40 bp, Artificial Sequence
  PCR primer for ORF amplification
aattacatgactcgagtcactcaacgtcctcgatgatttg

SEQ ID NO: 21920 - DNA, 40 bp, Artificial Sequence
  PCR primer for ORF amplification
aattacatgactcgagttaactttccttggatgatttttc

SEQ ID NO: 21921 - DNA, 40 bp, Artificial Sequence
  PCR primer for ORF amplification
aattacatgactcgagtcatttcttttttagtaggtacgt

SEQ ID NO: 21922 - DNA, 40 bp, Artificial Sequence
  PCR primer for ORF amplification
aattacatgactcgagttagagctcagaggaagctttatc

SEQ ID NO: 21923 - DNA, 40 bp, Artificial Sequence
  PCR primer for ORF amplification
aattacatgactcgagctaaactttgatcttaccatcaat

SEQ ID NO: 21924 - DNA, 40 bp, Artificial Sequence
  PCR primer for ORF amplification
aattacatgactcgagtcaactattctgtgttgattgtct

SEQ ID NO: 21925 - DNA, 40 bp, Artificial Sequence
  PCR primer for ORF amplification
aattacatgactcgagtcaaataagagcaactttgtcgtc

SEQ ID NO: 21926 - DNA, 40 bp, Artificial Sequence
  PCR primer for ORF amplification
aattacatgactcgagttagacagaattgctagcattctc

SEQ ID NO: 21927 - DNA, 40 bp, Artificial Sequence
  PCR primer for ORF amplification
aattacatgactcgagttataattttgacgaaaagacctt

SEQ ID NO: 21928 - DNA, 40 bp, Artificial Sequence
  PCR primer for ORF amplification
aattacatgactcgagttaaacaacaacaccagagttgga

SEQ ID NO: 21929 - DNA, 40 bp, Artificial Sequence
  PCR primer for ORF amplification
aattacatgactcgagttaggtccattttaaatttttaat

SEQ ID NO: 21930 - DNA, 40 bp, Artificial Sequence
  PCR primer for ORF amplification
aattacatgactcgagttattcttgcttttcttcagaacc

SEQ ID NO: 21931 - DNA, 40 bp, Artificial Sequence
  PCR primer for ORF amplification
aattacatgactcgagctataagtaagcgcgaaacaactg

SEQ ID NO: 21932 - DNA, 40 bp, Artificial Sequence
  PCR primer for ORF amplification
aattacatgactcgagtcatttacgtgaatagatcacttt

SEQ ID NO: 21933 - DNA, 40 bp, Artificial Sequence
  PCR primer for ORF amplification
aattacatgactcgagtcatatgtagtttggggtggatcg

SEQ ID NO: 21934 - DNA, 40 bp, Artificial Sequence
  PCR primer for ORF amplification
aattacatgactcgagtcagtcatatttcaaatggccatc

SEQ ID NO: 21935 - DNA, 40 bp, Artificial Sequence
  PCR primer for ORF amplification
aattacatgactcgagttactttcttgtttccacaacgga

SEQ ID NO: 21936 - DNA, 40 bp, Artificial Sequence
  PCR primer for ORF amplification
aattacatgactcgagttatattttctttgaaactctttc

SEQ ID NO: 21937 - DNA, 40 bp, Artificial Sequence
  PCR primer for ORF amplification
aattacatgactcgagttaagacgtctccacttcggtatc

SEQ ID NO: 21938 - DNA, 40 bp, Artificial Sequence
  PCR primer for ORF amplification
aattacatgactcgagtcaatgagccagtttcaatgagaa

SEQ ID NO: 21939 - DNA, 40 bp, Artificial Sequence
  PCR primer for ORF amplification
aattacatgactcgagttatttgaataagaaggagtacca

SEQ ID NO: 21940 - DNA, 40 bp, Artificial Sequence
  PCR primer for ORF amplification
aattacatgactcgagttatttttttaacatatttgaaat

SEQ ID NO: 21941 - DNA, 40 bp, Artificial Sequence
  PCR primer for ORF amplification
aattacatgactcgagtcaattaaacatagttttcaaaga

SEQ ID NO: 21942 - DNA, 40 bp, Artificial Sequence
  PCR primer for ORF amplification
aattacatgactcgagctataaataaaactttttcttttc

SEQ ID NO: 21943 - DNA, 40 bp, Artificial Sequence
  PCR primer for ORF amplification
aattacatgactcgagctactcttgcaagttggctatctc

SEQ ID NO: 21944 - DNA, 40 bp, Artificial Sequence
  PCR primer for ORF amplification
aattacatgactcgagtcagagcctgccgcgatcggccgt

SEQ ID NO: 21945 - DNA, 40 bp, Artificial Sequence
  PCR primer for ORF amplification
aattacatgactcgagtcaagcgttgtttttttccaattc

SEQ ID NO: 21946 - DNA, 40 bp, Artificial Sequence
  PCR primer for ORF amplification
aattacatgactcgagttattcttttaatttcgactttaa

SEQ ID NO: 21947 - DNA, 40 bp, Artificial Sequence
  PCR primer for ORF amplification
aattacatgactcgagctaaactttccttttcttagagct

SEQ ID NO: 21948 - DNA, 40 bp, Artificial Sequence
  PCR primer for ORF amplification
aattacatgactcgagttagtaacccaaagcggctaattg

SEQ ID NO: 21949 - DNA, 40 bp, Artificial Sequence
  PCR primer for ORF amplification
aattacatgactcgagttaggatttcacgaaattttcttc

SEQ ID NO: 21950 - DNA, 40 bp, Artificial Sequence
  PCR primer for ORF amplification
aattacatgactcgagttaattatctattagtattttctc

SEQ ID NO: 21951 - DNA, 40 bp, Artificial Sequence
  PCR primer for ORF amplification
aattacatgactcgagtcaaaatgcaccaaattctcccct

SEQ ID NO: 21952 - DNA, 40 bp, Artificial Sequence
  PCR primer for ORF amplification
aattacatgactcgagtcataccctagaagtattacgtga

SEQ ID NO: 21953 - DNA, 40 bp, Artificial Sequence
  PCR primer for ORF amplification
aattacatgactcgagctaatatatgtaagatgccttcgc

SEQ ID NO: 21954 - DNA, 40 bp, Artificial Sequence
  PCR primer for ORF amplification
aattacatgactcgagtcagttggacgtatcatatttcct

SEQ ID NO: 21955 - DNA, 40 bp, Artificial Sequence
  PCR primer for ORF amplification
aattacatgactcgagctacttattgtacgttacagccgg

SEQ ID NO: 21956 - DNA, 40 bp, Artificial Sequence
  PCR primer for ORF amplification
aattacatgactcgagtcaccacccaatttcggaaagtct

SEQ ID NO: 21957 - DNA, 40 bp, Artificial Sequence
  PCR primer for ORF amplification
aattacatgactcgagttattgaatagcttgatatttcaa

SEQ ID NO: 21958 - DNA, 40 bp, Artificial Sequence
  PCR primer for ORF amplification
aattacatgactcgagttatacacgacaattagaaatttc

SEQ ID NO: 21959 - DNA, 40 bp, Artificial Sequence
  PCR primer for ORF amplification
aattacatgactcgagttattgttgaccagccaaagcagc

SEQ ID NO: 21960 - DNA, 40 bp, Artificial Sequence
  PCR primer for ORF amplification
aattacatgactcgagttaagtgtatggattgaattttct

SEQ ID NO: 21961 - DNA, 40 bp, Artificial Sequence
  PCR primer for ORF amplification
aattacatgactcgagtcactgatgaacttcaccagcggg

SEQ ID NO: 21962 - DNA, 40 bp, Artificial Sequence
  PCR primer for ORF amplification
aattacatgactcgagttaattgtcgtcgttagagttggc

SEQ ID NO: 21963 - DNA, 40 bp, Artificial Sequence
  PCR primer for ORF amplification
aattacatgactcgagtcacggacacacttcttgttcctc

SEQ ID NO: 21964 - DNA, 40 bp, Artificial Sequence
  PCR primer for ORF amplification
aattacatgactcgagctaatcgtccttattcttctgttt

SEQ ID NO: 21965 - DNA, 40 bp, Artificial Sequence
  PCR primer for ORF amplification
aattacatgactcgagttattctcttttttgtttttccaa

SEQ ID NO: 21966 - DNA, 40 bp, Artificial Sequence
  PCR primer for ORF amplification
aattacatgactcgagctaccatccgatttcagaaagtct

SEQ ID NO: 21967 - DNA, 40 bp, Artificial Sequence
  PCR primer for ORF amplification
aattacatgactcgagtcagtttaagctatagttcgcacg

SEQ ID NO: 21968 - DNA, 40 bp, Artificial Sequence
  PCR primer for ORF amplification
aattacatgactcgagttatgattcttggaagtaggggtg

SEQ ID NO: 21969 - DNA, 40 bp, Artificial Sequence
  PCR primer for ORF amplification
aattacatgactcgagctaaatagcagcttgatcgcaaca

SEQ ID NO: 21970 - DNA, 40 bp, Artificial Sequence
  PCR primer for ORF amplification
aattacatgactcgagctaaactttggaatgcaatgtaga

SEQ ID NO: 21971 - DNA, 40 bp, Artificial Sequence
  PCR primer for ORF amplification
aattacatgactcgagctacttgtcttcctttggcatgcc

SEQ ID NO: 21972 - DNA, 40 bp, Artificial Sequence
  PCR primer for ORF amplification
aattacatgactcgagtcaactccagacgttcttaaataa

SEQ ID NO: 21973 - DNA, 40 bp, Artificial Sequence; identical to SEQ ID NO: 21412
  PCR primer for ORF amplification

SEQ ID NO: 21974 - DNA, 40 bp, Artificial Sequence
  PCR primer for ORF amplification
aattacatgactcgagctataacaatagagcggcggcacc

SEQ ID NO: 21975 - DNA, 40 bp, Artificial Sequence
  PCR primer for ORF amplification
aattacatgactcgagttaagctaggggctcgacattatc

SEQ ID NO: 21976 - DNA, 40 bp, Artificial Sequence
  PCR primer for ORF amplification
aattacatgactcgagttatattttcccccttggggactg

SEQ ID NO: 21977 - DNA, 40 bp, Artificial Sequence
  PCR primer for ORF amplification
aattacatgactcgagtcaaatcaaacccaagtttcgcgc

SEQ ID NO: 21978 - DNA, 40 bp, Artificial Sequence
  PCR primer for ORF amplification
aattacatgactcgagtcagtattcgaataaatcccagac

SEQ ID NO: 21979 - DNA, 40 bp, Artificial Sequence
  PCR primer for ORF amplification
aattacatgactcgagctagttggaattggaatttgaaca

SEQ ID NO: 21980 - DNA, 40 bp, Artificial Sequence
  PCR primer for ORF amplification
aattacatgactcgagttaatgagaatatagatatcttcc

SEQ ID NO: 21981 - DNA, 40 bp, Artificial Sequence
  PCR primer for ORF amplification
aattacatgactcgagctaaaaatcaatgcttttatagtc

SEQ ID NO: 21982 - DNA, 40 bp, Artificial Sequence
  PCR primer for ORF amplification
aattacatgactcgagtcaggctagcataactaagacctt

SEQ ID NO: 21983 - DNA, 40 bp, Artificial Sequence
  PCR primer for ORF amplification
aattacatgactcgagtcagacccttttgccaagtttgta

SEQ ID NO: 21984 - DNA, 40 bp, Artificial Sequence
  PCR primer for ORF amplification
aattacatgactcgagtcaagaagcaaatttccatgaact

SEQ ID NO: 21985 - DNA, 40 bp, Artificial Sequence
  PCR primer for ORF amplification
aattacatgactcgagttaccacagatagaaaaacatgaa

SEQ ID NO: 21986 - DNA, 40 bp, Artificial Sequence
  PCR primer for ORF amplification
aattacatgactcgagtcaatagtcgggcgcttctttggg

SEQ ID NO: 21987 - DNA, 40 bp, Artificial Sequence
  PCR primer for ORF amplification
aattacatgactcgagttaatttgagttgtctttccttgt

SEQ ID NO: 21988 - DNA, 40 bp, Artificial Sequence
  PCR primer for ORF amplification
aattacatgactcgagtcatttgctcaacaggttatcgaa

SEQ ID NO: 21989 - DNA, 40 bp, Artificial Sequence
  PCR primer for ORF amplification
aattacatgactcgagctaattgaattctggagggagaat

SEQ ID NO: 21990 - DNA, 40 bp, Artificial Sequence
  PCR primer for ORF amplification
aattacatgactcgagttactcgtcgctgtcgtcttctgt

SEQ ID NO: 21991 - DNA, 40 bp, Artificial Sequence
  PCR primer for ORF amplification
aattacatgactcgagctacttcctctttttacgttgatc

SEQ ID NO: 21992 - DNA, 40 bp, Artificial Sequence
  PCR primer for ORF amplification
aattacatgactcgagctaaccggtggttggtaagcctac

SEQ ID NO: 21993 - DNA, 40 bp, Artificial Sequence
  PCR primer for ORF amplification
aattacatgactcgagtcattcattaatgaccttgtctgc

SEQ ID NO: 21994 - DNA, 40 bp, Artificial Sequence
  PCR primer for ORF amplification
aattacatgactcgagctatttggtattgttcaaaatttt

SEQ ID NO: 21995 - DNA, 40 bp, Artificial Sequence
  PCR primer for ORF amplification
aattacatgactcgagctacctacgattatgaaattcaaa

SEQ ID NO: 21996 - DNA, 40 bp, Artificial Sequence
  PCR primer for ORF amplification
aattacatgactcgagttaaatgaaggtttcgtatggaac

SEQ ID NO: 21997 - DNA, 40 bp, Artificial Sequence
  PCR primer for ORF amplification
aattacatgactcgagttattgctgatcctgtaagcactc

SEQ ID NO: 21998 - DNA, 40 bp, Artificial Sequence
  PCR primer for ORF amplification
aattacatgactcgagtcattctgtcctaaacttaggggt

SEQ ID NO: 21999 - DNA, 40 bp, Artificial Sequence
  PCR primer for ORF amplification
aattacatgactcgagctagtcgtagcgttcgatgtagtc

SEQ ID NO: 22000 - DNA, 40 bp, Artificial Sequence
  PCR primer for ORF amplification
aattacatgactcgagttatctattttggccaaaatcaac

SEQ ID NO: 22001 - DNA, 40 bp, Artificial Sequence
  PCR primer for ORF amplification
aattacatgactcgagtcatttagctgctttcagtttgcg

SEQ ID NO: 22002 - DNA, 40 bp, Artificial Sequence
  PCR primer for ORF amplification
aattacatgactcgagtcattcatgacagtatctggaatt

SEQ ID NO: 22003 - DNA, 40 bp, Artificial Sequence
  PCR primer for ORF amplification
aattacatgactcgagtcactttagaatattcttgttttt

SEQ ID NO: 22004 - DNA, 40 bp, Artificial Sequence
  PCR primer for ORF amplification
aattacatgactcgagctatgatacaacaggaacattctg

SEQ ID NO: 22005 - DNA, 40 bp, Artificial Sequence
  PCR primer for ORF amplification
aattacatgactcgagtcaattgaagataaaagagtacca

SEQ ID NO: 22006 - DNA, 40 bp, Artificial Sequence
  PCR primer for ORF amplification
aattacatgactcgagtcagggaaagagttcctctaaaac

SEQ ID NO: 22007 - DNA, 40 bp, Artificial Sequence
  PCR primer for ORF amplification
aattacatgactcgagttaaccttgcgcctgatcaaaaca

SEQ ID NO: 22008 - DNA, 40 bp, Artificial Sequence
  PCR primer for ORF amplification
aattacatgactcgagttatataatattgagaatttcatt

SEQ ID NO: 22009 - DNA, 40 bp, Artificial Sequence
  PCR primer for ORF amplification
aattacatgactcgagttaattttcatctatatgtagctt

SEQ ID NO: 22010 - DNA, 40 bp, Artificial Sequence
  PCR primer for ORF amplification
aattacatgactcgagctaattcacgtgcaacagcaaccg

SEQ ID NO: 22011 - DNA, 40 bp, Artificial Sequence
  PCR primer for ORF amplification
aattacatgactcgagttaaacagagacatcgtccgggcg

SEQ ID NO: 22012 - DNA, 40 bp, Artificial Sequence
  PCR primer for ORF amplification
aattacatgactcgagttaaaatttgaaaacttggtcctt

SEQ ID NO: 22013 - DNA, 40 bp, Artificial Sequence
  PCR primer for ORF amplification
aattacatgactcgagtcatggattcttttcgaaaccctc

SEQ ID NO: 22014 - DNA, 40 bp, Artificial Sequence
  PCR primer for ORF amplification
aattacatgactcgagttaatgcatcttttttacagatga

SEQ ID NO: 22015 - DNA, 40 bp, Artificial Sequence
  PCR primer for ORF amplification
aattacatgactcgagctatatagaatatgaatcgccaat

SEQ ID NO: 22016 - DNA, 40 bp, Artificial Sequence
  PCR primer for ORF amplification
aattacatgactcgagctatgaagcttcgctatcctgctg

SEQ ID NO: 22017 - DNA, 40 bp, Artificial Sequence
  PCR primer for ORF amplification
aattacatgactcgagttattgtcttggcgacgaccatgg

SEQ ID NO: 22018 - DNA, 40 bp, Artificial Sequence
  PCR primer for ORF amplification
aattacatgactcgagctaatcttgggtcttttgagaacc

SEQ ID NO: 22019 - DNA, 40 bp, Artificial Sequence
  PCR primer for ORF amplification
aattacatgactcgagctaattacttaacgtttgacactc

SEQ ID NO: 22020 - DNA, 40 bp, Artificial Sequence
  PCR primer for ORF amplification
aattacatgactcgagctatacatcgtttaatgcgacaca

SEQ ID NO: 22021 - DNA, 40 bp, Artificial Sequence
  PCR primer for ORF amplification
aattacatgactcgagctaatatgtataaacatcaaattc

SEQ ID NO: 22022 - DNA, 40 bp, Artificial Sequence
  PCR primer for ORF amplification
aattacatgactcgagtcaatttttcattaaaaaatgctt

SEQ ID NO: 22023 - DNA, 40 bp, Artificial Sequence
  PCR primer for ORF amplification
aattacatgactcgagtcaaggcgtaggtagcgcttgcaa

SEQ ID NO: 22024 - DNA, 40 bp, Artificial Sequence
  PCR primer for ORF amplification
aattacatgactcgagttatacactcattttcatttgaat

SEQ ID NO: 22025 - DNA, 40 bp, Artificial Sequence
  PCR primer for ORF amplification
aattacatgactcgagttagaatttcaataggtgtggctt

SEQ ID NO: 22026 - DNA, 40 bp, Artificial Sequence
  PCR primer for ORF amplification
aattacatgactcgagctaaaaaaatgcattgatagcata

SEQ ID NO: 22027 - DNA, 40 bp, Artificial Sequence
  PCR primer for ORF amplification
aattacatgactcgagttattgcttgaaaaacgatgacca

SEQ ID NO: 22028 - DNA, 40 bp, Artificial Sequence
  PCR primer for ORF amplification
aattacatgactcgagtcaggaatcatccagtatgtgctg

SEQ ID NO: 22029 - DNA, 40 bp, Artificial Sequence
  PCR primer for ORF amplification
aattacatgactcgagttaatctctgttttcagcaatcca

SEQ ID NO: 22030 - DNA, 40 bp, Artificial Sequence
  PCR primer for ORF amplification
aattacatgactcgagttatgatgcctctgagcttgacat

SEQ ID NO: 22031 - DNA, 40 bp, Artificial Sequence
  PCR primer for ORF amplification
aattacatgactcgagttactcgtcgtctgactcatcctc

SEQ ID NO: 22032 - DNA, 40 bp, Artificial Sequence
  PCR primer for ORF amplification
aattacatgactcgagctacttcccgtgagctaacttcat

SEQ ID NO: 22033 - DNA, 40 bp, Artificial Sequence
  PCR primer for ORF amplification
aattacatgactcgagtcatatatataggcctgattgtgc

SEQ ID NO: 22034 - DNA, 40 bp, Artificial Sequence
  PCR primer for ORF amplification
aattacatgactcgagttagatctcgcgggcattttcaga

SEQ ID NO: 22035 - DNA, 40 bp, Artificial Sequence
  PCR primer for ORF amplification
aattacatgactcgagttatacgcaagggttttgtggagt

SEQ ID NO: 22036 - DNA, 40 bp, Artificial Sequence
  PCR primer for ORF amplification
aattacatgactcgagttacacaacaacaccggagttaga

SEQ ID NO: 22037 - DNA, 40 bp, Artificial Sequence
  PCR primer for ORF amplification
aattacatgactcgagttagttggtctggcttggaatttc

SEQ ID NO: 22038 - DNA, 40 bp, Artificial Sequence
  PCR primer for ORF amplification
aattacatgactcgagttaatcataccacatcttgattaa

SEQ ID NO: 22039 - DNA, 40 bp, Artificial Sequence
  PCR primer for ORF amplification
aattacatgactcgagttagacttcagccacagcagagga

SEQ ID NO: 22040 - DNA, 40 bp, Artificial Sequence
  PCR primer for ORF amplification
aattacatgactcgagctattcatacgtctcatccaagaa

SEQ ID NO: 22041 - DNA, 40 bp, Artificial Sequence
  PCR primer for ORF amplification
aattacatgactcgagtcaattcatatcagggttggatag

SEQ ID NO: 22042 - DNA, 40 bp, Artificial Sequence
  PCR primer for ORF amplification
aattacatgactcgagttacggtatatatatgtctgggtc

SEQ ID NO: 22043 - DNA, 40 bp, Artificial Sequence
  PCR primer for ORF amplification
aattacatgactcgagttatcttttattatcgaatgagac

SEQ ID NO: 22044 - DNA, 40 bp, Artificial Sequence
  PCR primer for ORF amplification
aattacatgactcgagtcattcattgtctctggagttctt

SEQ ID NO: 22045 - DNA, 40 bp, Artificial Sequence
  PCR primer for ORF amplification
aattacatgactcgagttaattcttgatcctgcctgctct

SEQ ID NO: 22046 - DNA, 40 bp, Artificial Sequence
  PCR primer for ORF amplification
aattacatgactcgagctaattatcctgcatccaagacat

SEQ ID NO: 22047 - DNA, 40 bp, Artificial Sequence
  PCR primer for ORF amplification
aattacatgactcgagttatttaattgccactgaattaac

SEQ ID NO: 22048 - DNA, 40 bp, Artificial Sequence
  PCR primer for ORF amplification
aattacatgactcgagttagtgagaccatttagaccctgt

SEQ ID NO: 22049 - DNA, 40 bp, Artificial Sequence
  PCR primer for ORF amplification
aattacatgactcgagttattgtgccacttcttgctcagc

SEQ ID NO: 22050 - DNA, 40 bp, Artificial Sequence
  PCR primer for ORF amplification
aattacatgactcgagtcaagaatcatgcaatgaattata

SEQ ID NO: 22051 - DNA, 40 bp, Artificial Sequence
  PCR primer for ORF amplification
aattacatgactcgagtcaatgaaataaatcgtctcttct

SEQ ID NO: 22052 - DNA, 40 bp, Artificial Sequence
  PCR primer for ORF amplification
aattacatgactcgagttaaaaaacaacctggttcctata

SEQ ID NO: 22053 - DNA, 40 bp, Artificial Sequence
  PCR primer for ORF amplification
aattacatgactcgagttacatgaatcttttgaccaactc

SEQ ID NO: 22054 - DNA, 40 bp, Artificial Sequence
  PCR primer for ORF amplification
aattacatgactcgagtcatttgaattttttaccgaacaa

SEQ ID NO: 22055 - DNA, 40 bp, Artificial Sequence
  PCR primer for ORF amplification
aattacatgactcgagtcaccggtaccaattatctagggt

SEQ ID NO: 22056 - DNA, 40 bp, Artificial Sequence
  PCR primer for ORF amplification
aattacatgactcgagttatattagaatatttccatgtgc

SEQ ID NO: 22057 - DNA, 40 bp, Artificial Sequence
  PCR primer for ORF amplification
aattacatgactcgagtcagtgtccgtacttcagatccct

SEQ ID NO: 22058 - DNA, 40 bp, Artificial Sequence
  PCR primer for ORF amplification
aattacatgactcgagtcaacccaataacctcatcgctaa

SEQ ID NO: 22059 - DNA, 40 bp, Artificial Sequence
  PCR primer for ORF amplification
aattacatgactcgagtcagcttgaatagtaaactttcct

SEQ ID NO: 22060 - DNA, 40 bp, Artificial Sequence
  PCR primer for ORF amplification
aattacatgactcgagttaaactttaatgccccaatggat

SEQ ID NO: 22061 - DNA, 40 bp, Artificial Sequence
  PCR primer for ORF amplification
aattacatgactcgagttaatcctctctaatagaaactat

SEQ ID NO: 22062 - DNA, 40 bp, Artificial Sequence
  PCR primer for ORF amplification
aattacatgactcgagttataagaaatagtccatttgaga

SEQ ID NO: 22063 - DNA, 40 bp, Artificial Sequence
  PCR primer for ORF amplification
aattacatgactcgagttaattcagtataaattttttatt

SEQ ID NO: 22064 - DNA, 40 bp, Artificial Sequence
  PCR primer for ORF amplification
aattacatgactcgagttatgcacttctcttcggatttat

SEQ ID NO: 22065 - DNA, 40 bp, Artificial Sequence
  PCR primer for ORF amplification
aattacatgactcgagtcacgatttgaagtaatttgacca

SEQ ID NO: 22066 - DNA, 40 bp, Artificial Sequence
  PCR primer for ORF amplification
aattacatgactcgagttattgttttacactcttatcttc

SEQ ID NO: 22067 - DNA, 40 bp, Artificial Sequence
  PCR primer for ORF amplification
aattacatgactcgagttagtcgaggctccgatgaaccgt

SEQ ID NO: 22068 - DNA, 40 bp, Artificial Sequence
  PCR primer for ORF amplification
aattacatgactcgagttaaataacgatgttatctattag

SEQ ID NO: 22069 - DNA, 40 bp, Artificial Sequence
  PCR primer for ORF amplification
aattacatgactcgagtcaccacttgtatacgccgcctgt

SEQ ID NO: 22070 - DNA, 40 bp, Artificial Sequence
  PCR primer for ORF amplification
aattacatgactcgagctagtcgcgtaccgtcactggccc

SEQ ID NO: 22071 - DNA, 40 bp, Artificial Sequence
  PCR primer for ORF amplification
aattacatgactcgagtcaacaaattatacaacaaccacc

SEQ ID NO: 22072 - DNA, 40 bp, Artificial Sequence
  PCR primer for ORF amplification
aattacatgactcgagctatttagacgcatttctcatcga

SEQ ID NO: 22073 - DNA, 40 bp, Artificial Sequence
  PCR primer for ORF amplification
aattacatgactcgagctaaccaggtggtagttgggaaat

SEQ ID NO: 22074 - DNA, 40 bp, Artificial Sequence
  PCR primer for ORF amplification
aattacatgactcgagctaagagaatttccatctgttacc

SEQ ID NO: 22075 - DNA, 40 bp, Artificial Sequence
  PCR primer for ORF amplification
aattacatgactcgagtcatagggcaaagaagttattgtc

SEQ ID NO: 22076 - DNA, 40 bp, Artificial Sequence
  PCR primer for ORF amplification
aattacatgactcgagttaaaagggatcctcatatggatc

SEQ ID NO: 22077 - DNA, 40 bp, Artificial Sequence
  PCR primer for ORF amplification
aattacatgactcgagctatctttgttgatgactgttttg

SEQ ID NO: 22078 - DNA, 40 bp, Artificial Sequence
  PCR primer for ORF amplification
aattacatgactcgagtcattgtctattgtatatttcatc

SEQ ID NO: 22079 - DNA, 40 bp, Artificial Sequence
  PCR primer for ORF amplification
aattacatgactcgagctaccttttaaataaatgaacggg

SEQ ID NO: 22080 - DNA, 40 bp, Artificial Sequence
  PCR primer for ORF amplification
aattacatgactcgagtcacttgaattttttgccaaacat

SEQ ID NO: 22081 - DNA, 40 bp, Artificial Sequence
  PCR primer for ORF amplification
aattacatgactcgagttagttagtcttcttttgagcatt

SEQ ID NO: 22082 - DNA, 40 bp, Artificial Sequence
  PCR primer for ORF amplification
aattacatgactcgagtcattcgttactggaagtgaaagg

SEQ ID NO: 22083 - DNA, 40 bp, Artificial Sequence
  PCR primer for ORF amplification
aattacatgactcgagctactttcttggttttggtggatt

SEQ ID NO: 22084 - DNA, 40 bp, Artificial Sequence
  PCR primer for ORF amplification
aattacatgactcgagttatttgccccttccatcgattct

SEQ ID NO: 22085 - DNA, 40 bp, Artificial Sequence
  PCR primer for ORF amplification
aattacatgactcgagttaaacgtaataccatttttgcac

SEQ ID NO: 22086 - DNA, 40 bp, Artificial Sequence
  PCR primer for ORF amplification
aattacatgactcgagttagctggtaacagtaaatttacc

SEQ ID NO: 22087 - DNA, 40 bp, Artificial Sequence
  PCR primer for ORF amplification
aattacatgactcgagtcattgttttttaccatacttgac

SEQ ID NO: 22088 - DNA, 40 bp, Artificial Sequence
  PCR primer for ORF amplification
aattacatgactcgagctattgggtagagtcccaatctct

SEQ ID NO: 22089 - DNA, 40 bp, Artificial Sequence
  PCR primer for ORF amplification
aattacatgactcgagttacacacttagcctcgaataacg

SEQ ID NO: 22090 - DNA, 40 bp, Artificial Sequence
  PCR primer for ORF amplification
aattacatgactcgagttaccaaccttccatggtatagtc

SEQ ID NO: 22091 - DNA, 40 bp, Artificial Sequence
  PCR primer for ORF amplification
aattacatgactcgagtcaaaatattataaacctgaacaa

SEQ ID NO: 22092 - DNA, 40 bp, Artificial Sequence
  PCR primer for ORF amplification
aattacatgactcgagtcaaaatacaaatggaatcaagaa

SEQ ID NO: 22093 - DNA, 40 bp, Artificial Sequence
  PCR primer for ORF amplification
aattacatgactcgagctaagatagagagacgagtgcatc

SEQ ID NO: 22094 - DNA, 40 bp, Artificial Sequence
  PCR primer for ORF amplification
aattacatgactcgagtcattcccagtcatcatcgtcgtc

SEQ ID NO: 22095 - DNA, 40 bp, Artificial Sequence
  PCR primer for ORF amplification
aattacatgactcgagtcaaactgatctagtgagtttccc

SEQ ID NO: 22096 - DNA, 40 bp, Artificial Sequence
  PCR primer for ORF amplification
aattacatgactcgagttaattgtttttgttgatcttctt

SEQ ID NO: 22097 - DNA, 40 bp, Artificial Sequence
  PCR primer for ORF amplification
aattacatgactcgagtcattggaaaaactctttggcttt

SEQ ID NO: 22098 - DNA, 40 bp, Artificial Sequence
  PCR primer for ORF amplification
aattacatgactcgagctagtaaatcttcttcttttcatc

SEQ ID NO: 22099 - DNA, 40 bp, Artificial Sequence
  PCR primer for ORF amplification
aattacatgactcgagttaaggattttttatgaaaccctc

SEQ ID NO: 22100 - DNA, 40 bp, Artificial Sequence
  PCR primer for ORF amplification
aattacatgactcgagttataattcccccattacggcagc

SEQ ID NO: 22101 - DNA, 40 bp, Artificial Sequence
  PCR primer for ORF amplification
aattacatgactcgagttaattcatcgatatgccacctct

SEQ ID NO: 22102 - DNA, 40 bp, Artificial Sequence
  PCR primer for ORF amplification
aattacatgactcgagttacaaacctttctttttgatatg

SEQ ID NO: 22103 - DNA, 40 bp, Artificial Sequence
  PCR primer for ORF amplification
aattacatgactcgagctagtccttgtgttcggctttaaa

SEQ ID NO: 22104 - DNA, 40 bp, Artificial Sequence
  PCR primer for ORF amplification
aattacatgactcgagttataagaaatagccggctctttg

SEQ ID NO: 22105 - DNA, 40 bp, Artificial Sequence
  PCR primer for ORF amplification
aattacatgactcgagctaaagcctatgcttaaggttctc

SEQ ID NO: 22106 - DNA, 40 bp, Artificial Sequence
  PCR primer for ORF amplification
aattacatgactcgagctaatgaccaccaccaccaatttc

SEQ ID NO: 22107 - DNA, 40 bp, Artificial Sequence
  PCR primer for ORF amplification
aattacatgactcgagtcatcccaaagaggaagcaccagt

SEQ ID NO: 22108 - DNA, 40 bp, Artificial Sequence
  PCR primer for ORF amplification
aattacatgactcgagttacttttcgttaattgaagagag

SEQ ID NO: 22109 - DNA, 40 bp, Artificial Sequence
  PCR primer for ORF amplification
aattacatgactcgagctataactcattattggttaaggt

SEQ ID NO: 22110 - DNA, 40 bp, Artificial Sequence
  PCR primer for ORF amplification
aattacatgactcgagttaggacaagaattcttttatgta

SEQ ID NO: 22111 - DNA, 40 bp, Artificial Sequence
  PCR primer for ORF amplification
aattacatgactcgagtcacaaccttgcgtaaatataatc

SEQ ID NO: 22112 - DNA, 40 bp, Artificial Sequence
  PCR primer for ORF amplification
aattacatgactcgagtcattggaaaattgggaaggatcc

SEQ ID NO: 22113 - DNA, 40 bp, Artificial Sequence
  PCR primer for ORF amplification
aattacatgactcgagttacttgaatacttcgaaaggaga

SEQ ID NO: 22114 - DNA, 40 bp, Artificial Sequence
  PCR primer for ORF amplification
aattacatgactcgagctaaatcctcgaattttccctata

SEQ ID NO: 22115 - DNA, 40 bp, Artificial Sequence
  PCR primer for ORF amplification
aattacatgactcgagttaatcgaataaaccgaaacccat

SEQ ID NO: 22116 - DNA, 40 bp, Artificial Sequence
  PCR primer for ORF amplification
aattacatgactcgagtcacgtgctcacgttctgctgtag

SEQ ID NO: 22117 - DNA, 40 bp, Artificial Sequence
  PCR primer for ORF amplification
aattacatgactcgagtcacttcgatccgcccaggaatcc

SEQ ID NO: 22118 - DNA, 40 bp, Artificial Sequence
  PCR primer for ORF amplification
aattacatgactcgagctaagacttgaaattaattaattc

SEQ ID NO: 22119 - DNA, 40 bp, Artificial Sequence
  PCR primer for ORF amplification
aattacatgactcgagttaaaagacgaagacttgatcgtc

SEQ ID NO: 22120 - DNA, 40 bp, Artificial Sequence
  PCR primer for ORF amplification
aattacatgactcgagttatactttttgagcagcgtagtt

SEQ ID NO: 22121 - DNA, 40 bp, Artificial Sequence
  PCR primer for ORF amplification
aattacatgactcgagttaaaaaacaaaaactttatcggt

SEQ ID NO: 22122 - DNA, 40 bp, Artificial Sequence
  PCR primer for ORF amplification
aattacatgactcgagttacaatttgaatttaaacctttt

SEQ ID NO: 22123 - DNA, 40 bp, Artificial Sequence
  PCR primer for ORF amplification
aattacatgactcgagttaaatcatcacaattcttggttc

SEQ ID NO: 22124 - DNA, 40 bp, Artificial Sequence
  PCR primer for ORF amplification
aattacatgactcgagtcaattcagtctctgaatagccat

SEQ ID NO: 22125 - DNA, 40 bp, Artificial Sequence
  PCR primer for ORF amplification
aattacatgactcgagtcaacttatacttcttttagagaa

SEQ ID NO: 22126 - DNA, 40 bp, Artificial Sequence
  PCR primer for ORF amplification
aattacatgactcgagttattcttcagagatgcagtacga

SEQ ID NO: 22127 - DNA, 40 bp, Artificial Sequence
  PCR primer for ORF amplification
aattacatgactcgagtcacttgataaatttctgaaagtt

SEQ ID NO: 22128 - DNA, 40 bp, Artificial Sequence
  PCR primer for ORF amplification
aattacatgactcgagttataagaaccaaattaaaaccgt

SEQ ID NO: 22129 - DNA, 40 bp, Artificial Sequence
  PCR primer for ORF amplification
aattacatgactcgagtcaattcaagtttttgttaagata

SEQ ID NO: 22130 - DNA, 40 bp, Artificial Sequence
  PCR primer for ORF amplification
aattacatgactcgagtcatgaaaagtcacagtccaagga

SEQ ID NO: 22131 - DNA, 40 bp, Artificial Sequence
  PCR primer for ORF amplification
aattacatgactcgagctatcctgttgttttcttatataa

SEQ ID NO: 22132 - DNA, 40 bp, Artificial Sequence
  PCR primer for ORF amplification
aattacatgactcgagttatggtttagcttcggtcgtggt

SEQ ID NO: 22133 - DNA, 40 bp, Artificial Sequence
  PCR primer for ORF amplification
aattacatgactcgagctatcgaattaaattgcctaaggg

SEQ ID NO: 22134 - DNA, 40 bp, Artificial Sequence
  PCR primer for ORF amplification
aattacatgactcgagttaaatgctgttcaacttcccacg

SEQ ID NO: 22135 - DNA, 40 bp, Artificial Sequence
  PCR primer for ORF amplification
aattacatgactcgagtcaggtatttcgaggagtactagt

SEQ ID NO: 22136 - DNA, 40 bp, Artificial Sequence
  PCR primer for ORF amplification
aattacatgactcgagttaatctatatcatgttgatcttg

SEQ ID NO: 22137 - DNA, 40 bp, Artificial Sequence
  PCR primer for ORF amplification
aattacatgactcgagctaatgtttggcaactggggtttc

SEQ ID NO: 22138 - DNA, 40 bp, Artificial Sequence
  PCR primer for ORF amplification
aattacatgactcgagttagttgcaattagctttgtgccc

SEQ ID NO: 22139 - DNA, 40 bp, Artificial Sequence
  PCR primer for ORF amplification
aattacatgactcgagtcataaaatcaaaccacagctttg

SEQ ID NO: 22140 - DNA, 40 bp, Artificial Sequence
  PCR primer for ORF amplification
aattacatgactcgagctaatacgtcattaggaaatgttt

SEQ ID NO: 22141 - DNA, 40 bp, Artificial Sequence
  PCR primer for ORF amplification
aattacatgactcgagtcaacccattaaccacattagaac

SEQ ID NO: 22142 - DNA, 40 bp, Artificial Sequence
  PCR primer for ORF amplification
aattacatgactcgagttagtacatccgcaaataatggat

SEQ ID NO: 22143 - DNA, 40 bp, Artificial Sequence
  PCR primer for ORF amplification
aattacatgactcgagttaaaatttcaacatgtgtggctt

SEQ ID NO: 22144 - DNA, 40 bp, Artificial Sequence
  PCR primer for ORF amplification
aattacatgactcgagtcacgctaccgcttcttgagactg

SEQ ID NO: 22145 - DNA, 40 bp, Artificial Sequence
  PCR primer for ORF amplification
aattacatgactcgagttaaatagacaaaccttggtggaa

SEQ ID NO: 22146 - DNA, 40 bp, Artificial Sequence
  PCR primer for ORF amplification
aattacatgactcgagttagtagaaggttgatggtctctt

SEQ ID NO: 22147 - DNA, 40 bp, Artificial Sequence
  PCR primer for ORF amplification
aattacatgactcgagctaaagggttattctataaccagg

SEQ ID NO: 22148 - DNA, 40 bp, Artificial Sequence
  PCR primer for ORF amplification
aattacatgactcgagttattgttcattcttagtgacttt

SEQ ID NO: 22149 - DNA, 40 bp, Artificial Sequence
  PCR primer for ORF amplification
aattacatgactcgagttaaccatttacgtcgtaaatgtc

SEQ ID NO: 22150 - DNA, 40 bp, Artificial Sequence
  PCR primer for ORF amplification
aattacatgactcgagttaaacccatctccataaacagca

SEQ ID NO: 22151 - DNA, 40 bp, Artificial Sequence
  PCR primer for ORF amplification
aattacatgactcgagtcaagggtggatatgagaatgcat

SEQ ID NO: 22152 - DNA, 40 bp, Artificial Sequence
  PCR primer for ORF amplification
aattacatgactcgagttatagtaaattggtgagaacatt

SEQ ID NO: 22153 - DNA, 40 bp, Artificial Sequence
  PCR primer for ORF amplification
aattacatgactcgagttaaactatcctaaaagcttcttg

SEQ ID NO: 22154 - DNA, 40 bp, Artificial Sequence
  PCR primer for ORF amplification
aattacatgactcgagtcagttcagattatttattttgtg

SEQ ID NO: 22155 - DNA, 40 bp, Artificial Sequence
  PCR primer for ORF amplification
aattacatgactcgagtcaagcactgttgttaaaatgtct

SEQ ID NO: 22156 - DNA, 40 bp, Artificial Sequence
  PCR primer for ORF amplification
aattacatgactcgagtcacataaatccattatcatacac

SEQ ID NO: 22157 - DNA, 40 bp, Artificial Sequence
  PCR primer for ORF amplification
aattacatgactcgagttaccagctttgatatttcttaat

SEQ ID NO: 22158 - DNA, 40 bp, Artificial Sequence
  PCR primer for ORF amplification
aattacatgactcgagttacttctcctttttaacttcaat

SEQ ID NO: 22159 - DNA, 40 bp, Artificial Sequence
  PCR primer for ORF amplification
aattacatgactcgagctaattttggtttggcttgtatgc

SEQ ID NO: 22160 - DNA, 40 bp, Artificial Sequence
  PCR primer for ORF amplification
aattacatgactcgagctagattatttctctaccattcag

SEQ ID NO: 22161 - DNA, 40 bp, Artificial Sequence
  PCR primer for ORF amplification
aattacatgactcgagtcaaaatgcagcagaaaaatcgat

SEQ ID NO: 22162 - DNA, 40 bp, Artificial Sequence
  PCR primer for ORF amplification
aattacatgactcgagtcatcgttggtaaggataaatcca

SEQ ID NO: 22163 - DNA, 40 bp, Artificial Sequence
  PCR primer for ORF amplification
aattacatgactcgagctacatttttgttacctgcatgat

SEQ ID NO: 22164 - DNA, 40 bp, Artificial Sequence
  PCR primer for ORF amplification
aattacatgactcgagttatggcatttgattgacgttcct

SEQ ID NO: 22165 - DNA, 40 bp, Artificial Sequence
  PCR primer for ORF amplification
aattacatgactcgagctatgtagtgtttaagactttgtt

SEQ ID NO: 22166 - DNA, 40 bp, Artificial Sequence
  PCR primer for ORF amplification
aattacatgactcgagtcatattttaatggtttttggctt

SEQ ID NO: 22167 - DNA, 40 bp, Artificial Sequence
  PCR primer for ORF amplification
aattacatgactcgagttaaaatacagttgaaagagttgt

SEQ ID NO: 22168 - DNA, 40 bp, Artificial Sequence
  PCR primer for ORF amplification
aattacatgactcgagtcaaattgtccattcatcgaaata

SEQ ID NO: 22169 - DNA, 40 bp, Artificial Sequence
  PCR primer for ORF amplification
aattacatgactcgagttagttattcttttttgtttcatc

SEQ ID NO: 22170 - DNA, 40 bp, Artificial Sequence
  PCR primer for ORF amplification
aattacatgactcgagttatactatgctaagaaaactctt

SEQ ID NO: 22171 - DNA, 40 bp, Artificial Sequence
  PCR primer for ORF amplification
aattacatgactcgagctaaaagcccatttccttcatagc

SEQ ID NO: 22172 - DNA, 40 bp, Artificial Sequence
  PCR primer for ORF amplification
aattacatgactcgagttattcgctctttgaagcgagatc

SEQ ID NO: 22173 - DNA, 40 bp, Artificial Sequence
  PCR primer for ORF amplification
aattacatgactcgagttaagcgtcttcctttagcaaagc

SEQ ID NO: 22174 - DNA, 40 bp, Artificial Sequence
  PCR primer for ORF amplification
aattacatgactcgagctaggagacaatcccgttctccat

SEQ ID NO: 22175 - DNA, 40 bp, Artificial Sequence
  PCR primer for ORF amplification
aattacatgactcgagctatgtttgcgtttcaccagacaa

SEQ ID NO: 22176 - DNA, 40 bp, Artificial Sequence
  PCR primer for ORF amplification
aattacatgactcgagttactcatcctgttctttcccctc

SEQ ID NO: 22177 - DNA, 40 bp, Artificial Sequence
  PCR primer for ORF amplification
aattacatgactcgagctaccaagcattatcataccctcc

SEQ ID NO: 22178 - DNA, 40 bp, Artificial Sequence
  PCR primer for ORF amplification
aattacatgactcgagtcatgaaaaatggataccaacctg

SEQ ID NO: 22179 - DNA, 40 bp, Artificial Sequence
  PCR primer for ORF amplification
aattacatgactcgagttacaagttggttgtattattatt

SEQ ID NO: 22180 - DNA, 40 bp, Artificial Sequence
  PCR primer for ORF amplification
aattacatgactcgagttaaacaggcgcatgtgtaaataa

SEQ ID NO: 22181 - DNA, 40 bp, Artificial Sequence
  PCR primer for ORF amplification
aattacatgactcgagttatttgaacttcttaccaaacaa

SEQ ID NO: 22182 - DNA, 40 bp, Artificial Sequence
  PCR primer for ORF amplification
aattacatgactcgagttaattttccatggactgtgatag

SEQ ID NO: 22183 - DNA, 40 bp, Artificial Sequence
  PCR primer for ORF amplification
aattacatgactcgagttacttgtgtcttaatgaaaccgt

SEQ ID NO: 22184 - DNA, 40 bp, Artificial Sequence
  PCR primer for ORF amplification
aattacatgactcgagctacaattcgtcgtgcttgtttcc

SEQ ID NO: 22185 - DNA, 40 bp, Artificial Sequence
  PCR primer for ORF amplification
aattacatgactcgagttaaagagtgctcaataattgatc

SEQ ID NO: 22186 - DNA, 40 bp, Artificial Sequence
  PCR primer for ORF amplification
aattacatgactcgagtcagttagacacggagtgaaggat

SEQ ID NO: 22187 - DNA, 40 bp, Artificial Sequence
  PCR primer for ORF amplification
aattacatgactcgagctaatcgcagcgagcccttttagg

SEQ ID NO: 22188 - DNA, 40 bp, Artificial Sequence
  PCR primer for ORF amplification
aattacatgactcgagttacaaaaaatctattaatttatc

SEQ ID NO: 22189 - DNA, 40 bp, Artificial Sequence
  PCR primer for ORF amplification
aattacatgactcgagttagttaaagggcgaatcagtagc

SEQ ID NO: 22190 - DNA, 40 bp, Artificial Sequence
  PCR primer for ORF amplification
aattacatgactcgagttaagataaataacttgaaaagtc

SEQ ID NO: 22191 - DNA, 40 bp, Artificial Sequence
  PCR primer for ORF amplification
aattacatgactcgagctattctagggaagttaagtattt

SEQ ID NO: 22192 - DNA, 40 bp, Artificial Sequence
  PCR primer for ORF amplification
aattacatgactcgagtcatgcagttgcttgctccacgga

SEQ ID NO: 22193 - DNA, 40 bp, Artificial Sequence
  PCR primer for ORF amplification
aattacatgactcgagttaagcgatcaattcaacaacacc

SEQ ID NO: 22194 - DNA, 40 bp, Artificial Sequence
  PCR primer for ORF amplification
aattacatgactcgagtcagttggccttcttgccgtcatt

SEQ ID NO: 22195 - DNA, 40 bp, Artificial Sequence
  PCR primer for ORF amplification
aattacatgactcgagttaaattttgtttttctcttgaga

SEQ ID NO: 22196 - DNA, 40 bp, Artificial Sequence
  PCR primer for ORF amplification
aattacatgactcgagttatgaattactaaacacgtccag

SEQ ID NO: 22197 - DNA, 40 bp, Artificial Sequence
  PCR primer for ORF amplification
aattacatgactcgagttataagggataattcttaaataa

SEQ ID NO: 22198 - DNA, 40 bp, Artificial Sequence
  PCR primer for ORF amplification
aattacatgactcgagttaaaatgtacaaaataagtcttc

SEQ ID NO: 22199 - DNA, 40 bp, Artificial Sequence
  PCR primer for ORF amplification
aattacatgactcgagttaattcgatagtaggcggtcaaa

SEQ ID NO: 22200 - DNA, 40 bp, Artificial Sequence
  PCR primer for ORF amplification
aattacatgactcgagctatttttctttagacagttctac

SEQ ID NO: 22201 - DNA, 40 bp, Artificial Sequence
  PCR primer for ORF amplification
aattacatgactcgagttattcttcagacttcttagactt

SEQ ID NO: 22202 - DNA, 40 bp, Artificial Sequence
  PCR primer for ORF amplification
aattacatgactcgagtcatgtcgttaacatgttatcgcg

SEQ ID NO: 22203 - DNA, 40 bp, Artificial Sequence
  PCR primer for ORF amplification
aattacatgactcgagctaggagcggttcccaccatatct

SEQ ID NO: 22204 - DNA, 40 bp, Artificial Sequence
  PCR primer for ORF amplification
aattacatgactcgagctatttcttcttttcagcttcagc

SEQ ID NO: 22205 - DNA, 40 bp, Artificial Sequence
  PCR primer for ORF amplification
aattacatgactcgagctactcagtcaaattctcatcatc

SEQ ID NO: 22206 - DNA, 40 bp, Artificial Sequence
  PCR primer for ORF amplification
aattacatgactcgagtcatgatgactgaacattgatctg

SEQ ID NO: 22207 - DNA, 40 bp, Artificial Sequence
  PCR primer for ORF amplification
aattacatgactcgagttagtatctaaatggttgagagta

SEQ ID NO: 22208 - DNA, 40 bp, Artificial Sequence
  PCR primer for ORF amplification
aattacatgactcgagtcaatagttgtattcgtttggttt

SEQ ID NO: 22209 - DNA, 40 bp, Artificial Sequence
  PCR primer for ORF amplification
aattacatgactcgagttataacaataaataagttcctga

SEQ ID NO: 22210 - DNA, 40 bp, Artificial Sequence
  PCR primer for ORF amplification
aattacatgactcgagttatgcttgattttgactttggtt

SEQ ID NO: 22211 - DNA, 40 bp, Artificial Sequence
  PCR primer for ORF amplification
aattacatgactcgagttaaagctcctcggatataacaca

SEQ ID NO: 22212 - DNA, 40 bp, Artificial Sequence
  PCR primer for ORF amplification
aattacatgactcgagtcataacgtgttgaatgcttggat

SEQ ID NO: 22213 - DNA, 40 bp, Artificial Sequence
  PCR primer for ORF amplification
aattacatgactcgagttagaggagtgtgatcaatttgtc

SEQ ID NO: 22214 - DNA, 40 bp, Artificial Sequence
  PCR primer for ORF amplification
aattacatgactcgagtcaaagaaaatgaatggttcgaag

SEQ ID NO: 22215 - DNA, 40 bp, Artificial Sequence
  PCR primer for ORF amplification
aattacatgactcgagctactgtggttgagctttgttagc

SEQ ID NO: 22216 - DNA, 40 bp, Artificial Sequence
  PCR primer for ORF amplification
aattacatgactcgagctattccttttcataaaccacttt

SEQ ID NO: 22217 - DNA, 40 bp, Artificial Sequence
  PCR primer for ORF amplification
aattacatgactcgagtcagttgctacctagaaggatata

SEQ ID NO: 22218 - DNA, 40 bp, Artificial Sequence
  PCR primer for ORF amplification
aattacatgactcgagttagtggtccaaagccttgatgtt

SEQ ID NO: 22219 - DNA, 40 bp, Artificial Sequence
  PCR primer for ORF amplification
aattacatgactcgagttaacttataatacaacagccacc

SEQ ID NO: 22220 - DNA, 40 bp, Artificial Sequence
  PCR primer for ORF amplification
aattacatgactcgagtcatgaagtgatgaagaaatcatt

SEQ ID NO: 22221 - DNA, 40 bp, Artificial Sequence
  PCR primer for ORF amplification
aattacatgactcgagtcaacgttgaatggcgttgctaga

SEQ ID NO: 22222 - DNA, 40 bp, Artificial Sequence
  PCR primer for ORF amplification
aattacatgactcgagtcagttaccaatgagcttatttat

SEQ ID NO: 22223 - DNA, 40 bp, Artificial Sequence
  PCR primer for ORF amplification
aattacatgactcgagttaacccagtaacttaacaaagaa

SEQ ID NO: 22224 - DNA, 40 bp, Artificial Sequence
  PCR primer for ORF amplification
aattacatgactcgagtcatctcctaaaggtatccaaaaa

SEQ ID NO: 22225 - DNA, 40 bp, Artificial Sequence
  PCR primer for ORF amplification
aattacatgactcgagctactttaatggctttggctttgg

SEQ ID NO: 22226 - DNA, 40 bp, Artificial Sequence
  PCR primer for ORF amplification
aattacatgactcgagttaattcaacttggctaataaaga

SEQ ID NO: 22227 - DNA, 40 bp, Artificial Sequence
  PCR primer for ORF amplification
aattacatgactcgagctacaaggctttggatacttggtt

SEQ ID NO: 22228 - DNA, 40 bp, Artificial Sequence
  PCR primer for ORF amplification
aattacatgactcgagtcatttcttcaagttatgccattc

SEQ ID NO: 22229 - DNA, 40 bp, Artificial Sequence
  PCR primer for ORF amplification
aattacatgactcgagttatatggacattccctttttttg

SEQ ID NO: 22230 - DNA, 40 bp, Artificial Sequence
  PCR primer for ORF amplification
aattacatgactcgagctatgcatgtcttgtagaactatt

SEQ ID NO: 22231 - DNA, 40 bp, Artificial Sequence
  PCR primer for ORF amplification
aattacatgactcgagttaaaatctcaacttagagaagaa

SEQ ID NO: 22232 - DNA, 40 bp, Artificial Sequence
  PCR primer for ORF amplification
aattacatgactcgagtcaggctttattatttagtttatg

SEQ ID NO: 22233 - DNA, 40 bp, Artificial Sequence
  PCR primer for ORF amplification
aattacatgactcgagttaaattgcagatgctggtctaag

SEQ ID NO: 22234 - DNA, 40 bp, Artificial Sequence
  PCR primer for ORF amplification
aattacatgactcgagctaatgagtttcacttggaatttc

SEQ ID NO: 22235 - DNA, 40 bp, Artificial Sequence
  PCR primer for ORF amplification
aattacatgactcgagttaggagtatttatctacagctga

SEQ ID NO: 22236 - DNA, 40 bp, Artificial Sequence
  PCR primer for ORF amplification
aattacatgactcgagtcaaataaaatctttacaatcatc

SEQ ID NO: 22237 - DNA, 40 bp, Artificial Sequence
  PCR primer for ORF amplification
aattacatgactcgagctatagacttggttgtaattcgtt

SEQ ID NO: 22238 - DNA, 40 bp, Artificial Sequence
  PCR primer for ORF amplification
aattacatgactcgagttaattatggcctaaaactctcga

SEQ ID NO: 22239 - DNA, 40 bp, Artificial Sequence; identical to SEQ ID NO: 21855
  PCR primer for ORF amplification

SEQ ID NO: 22240 - DNA, 40 bp, Artificial Sequence
  PCR primer for ORF amplification
aattacatgactcgagctaaatggtaaccgtagcataaat

SEQ ID NO: 22241 - DNA, 40 bp, Artificial Sequence
  PCR primer for ORF amplification
aattacatgactcgagttattgattcggttgttgattgat

SEQ ID NO: 22242 - DNA, 40 bp, Artificial Sequence
  PCR primer for ORF amplification
aattacatgactcgagctaccaagtcatcctttgcaatgc

SEQ ID NO: 22243 - DNA, 40 bp, Artificial Sequence
  PCR primer for ORF amplification
aattacatgactcgagttaatagtgatactctgttggttt

SEQ ID NO: 22244 - DNA, 40 bp, Artificial Sequence
  PCR primer for ORF amplification
aattacatgactcgagtcaacagtcaattaaatctatagc

SEQ ID NO: 22245 - DNA, 40 bp, Artificial Sequence
  PCR primer for ORF amplification
aattacatgactcgagttattgcttaaaagcagcaatcgc

SEQ ID NO: 22246 - DNA, 40 bp, Artificial Sequence; identical to SEQ ID NO: 20373
  PCR primer for ORF amplification

SEQ ID NO: 22247 - DNA, 40 bp, Artificial Sequence
  PCR primer for ORF amplification
aattacatgactcgagctatttgtatggatactttttgaa

SEQ ID NO: 22248 - DNA, 40 bp, Artificial Sequence
  PCR primer for ORF amplification
aattacatgactcgagctaattataaataattttgccctg

SEQ ID NO: 22249 - DNA, 40 bp, Artificial Sequence
  PCR primer for ORF amplification
aattacatgactcgagctaattagcagttggagcatattc

SEQ ID NO: 22250 - DNA, 40 bp, Artificial Sequence
  PCR primer for ORF amplification
aattacatgactcgagttaaaatccttttcttgccaagtc

SEQ ID NO: 22251 - DNA, 40 bp, Artificial Sequence
  PCR primer for ORF amplification
aattacatgactcgagttattgttgactaacagggaagat

SEQ ID NO: 22252 - DNA, 40 bp, Artificial Sequence
  PCR primer for ORF amplification
aattacatgactcgagctatactggagcatgggtgaacaa

SEQ ID NO: 22253 - DNA, 40 bp, Artificial Sequence
  PCR primer for ORF amplification
aattacatgactcgagctaaatcgttgggccatcttcctt

SEQ ID NO: 22254 - DNA, 40 bp, Artificial Sequence
  PCR primer for ORF amplification
aattacatgactcgagttaagagcattgtacttgaattaa

SEQ ID NO: 22255 - DNA, 40 bp, Artificial Sequence
  PCR primer for ORF amplification
aattacatgactcgagtcaccaatttcttacagaatcaca

SEQ ID NO: 22256 - DNA, 40 bp, Artificial Sequence
  PCR primer for ORF amplification
aattacatgactcgagctaatcactatcactcgattcacc

SEQ ID NO: 22257 - DNA, 40 bp, Artificial Sequence
  PCR primer for ORF amplification
aattacatgactcgagttaggcaatcaaaccatgaggaac

SEQ ID NO: 22258 - DNA, 40 bp, Artificial Sequence
  PCR primer for ORF amplification
aattacatgactcgagttaagcgtcgtcttcgtcattcat

SEQ ID NO: 22259 - DNA, 40 bp, Artificial Sequence
  PCR primer for ORF amplification
aattacatgactcgagctaagcagcaaagtgtttcaaaat

SEQ ID NO: 22260 - DNA, 40 bp, Artificial Sequence
  PCR primer for ORF amplification
aattacatgactcgagttaaaatttagcaaattgcttgtt

SEQ ID NO: 22261 - DNA, 40 bp, Artificial Sequence
  PCR primer for ORF amplification
aattacatgactcgagtcatttcgaattttgattttgatt

SEQ ID NO: 22262 - DNA, 40 bp, Artificial Sequence
  PCR primer for ORF amplification
aattacatgactcgagttatttaggaacggatttaactat

SEQ ID NO: 22263 - DNA, 40 bp, Artificial Sequence
  PCR primer for ORF amplification
aattacatgactcgagctactcatcatagccaccgccaaa

SEQ ID NO: 22264 - DNA, 40 bp, Artificial Sequence
  PCR primer for ORF amplification
aattacatgactcgagctaaatacctctgttaaaatagac

SEQ ID NO: 22265 - DNA, 40 bp, Artificial Sequence
  PCR primer for ORF amplification
aattacatgactcgagttagtcagaccttagtctgaaagg

SEQ ID NO: 22266 - DNA, 40 bp, Artificial Sequence
  PCR primer for ORF amplification
aattacatgactcgagtcatttgattctgtctaaattaat

SEQ ID NO: 22267 - DNA, 40 bp, Artificial Sequence
  PCR primer for ORF amplification
aattacatgactcgagttatatgtatttacaggctaaatt

SEQ ID NO: 22268 - DNA, 40 bp, Artificial Sequence
  PCR primer for ORF amplification
aattacatgactcgagctaacacctttttttcctgagcca

SEQ ID NO: 22269 - DNA, 40 bp, Artificial Sequence
  PCR primer for ORF amplification
aattacatgactcgagttatttcttcaaaccgcttctcat

SEQ ID NO: 22270 - DNA, 40 bp, Artificial Sequence
  PCR primer for ORF amplification
aattacatgactcgagtcaggcaaaagtggggaatttacc

SEQ ID NO: 22271 - DNA, 40 bp, Artificial Sequence
  PCR primer for ORF amplification
aattacatgactcgagtcatatgccatacttcttgaacag

SEQ ID NO: 22272 - DNA, 40 bp, Artificial Sequence; identical to SEQ ID NO: 21732
  PCR primer for ORF amplification

SEQ ID NO: 22273 - DNA, 40 bp, Artificial Sequence
  PCR primer for ORF amplification
aattacatgactcgagctacttagcaaatcctatggtaac

SEQ ID NO: 22274 - DNA, 40 bp, Artificial Sequence
  PCR primer for ORF amplification
aattacatgactcgagctatacatcccccacagcatctcg

SEQ ID NO: 22275 - DNA, 40 bp, Artificial Sequence
  PCR primer for ORF amplification
aattacatgactcgagttaagtggttggatcaacagaagt

SEQ ID NO: 22276 - DNA, 40 bp, Artificial Sequence
  PCR primer for ORF amplification
aattacatgactcgagtcatactctatgggaataatcttt

SEQ ID NO: 22277 - DNA, 40 bp, Artificial Sequence
  PCR primer for ORF amplification
aattacatgactcgagttatatattttcggcctttaattt

SEQ ID NO: 22278 - DNA, 40 bp, Artificial Sequence
  PCR primer for ORF amplification
aattacatgactcgagttatttaacccactctcttggttt

SEQ ID NO: 22279 - DNA, 40 bp, Artificial Sequence
  PCR primer for ORF amplification
aattacatgactcgagttaaagtccagaacatcccactac

SEQ ID NO: 22280 - DNA, 40 bp, Artificial Sequence
  PCR primer for ORF amplification
aattacatgactcgagctatgtatcttgcaggtattccat

SEQ ID NO: 22281 - DNA, 40 bp, Artificial Sequence
  PCR primer for ORF amplification
aattacatgactcgagtcaccactgagccttcataaggat

SEQ ID NO: 22282 - DNA, 40 bp, Artificial Sequence
  PCR primer for ORF amplification
aattacatgactcgagttataatttttgcatagcagcaat

SEQ ID NO: 22283 - DNA, 40 bp, Artificial Sequence
  PCR primer for ORF amplification
aattacatgactcgagttattcaaaatccagcgtctcctc

SEQ ID NO: 22284 - DNA, 40 bp, Artificial Sequence
  PCR primer for ORF amplification
aattacatgactcgagtcacggattctttttcaaaatatt

SEQ ID NO: 22285 - DNA, 40 bp, Artificial Sequence
  PCR primer for ORF amplification
aattacatgactcgagtcaagtggaagccagcttgcgttg

SEQ ID NO: 22286 - DNA, 40 bp, Artificial Sequence
  PCR primer for ORF amplification
aattacatgactcgagttaagctaatggcataacgttgtc

SEQ ID NO: 22287 - DNA, 40 bp, Artificial Sequence
  PCR primer for ORF amplification
aattacatgactcgagtcattcatcgtacacgtaaaaatc

SEQ ID NO: 22288 - DNA, 40 bp, Artificial Sequence
  PCR primer for ORF amplification
aattacatgactcgagctactcttcccccagaaatctcat

SEQ ID NO: 22289 - DNA, 40 bp, Artificial Sequence; identical to SEQ ID NO: 20692
  PCR primer for ORF amplification

SEQ ID NO: 22290 - DNA, 40 bp, Artificial Sequence
  PCR primer for ORF amplification
aattacatgactcgagttactgaacgaagttcttcagggt

SEQ ID NO: 22291 - DNA, 40 bp, Artificial Sequence
  PCR primer for ORF amplification
aattacatgactcgagtcaattccttttttttggaggagg

SEQ ID NO: 22292 - DNA, 40 bp, Artificial Sequence
  PCR primer for ORF amplification
aattacatgactcgagtcatttaaatttggcaaattgatc

SEQ ID NO: 22293 - DNA, 40 bp, Artificial Sequence
  PCR primer for ORF amplification
aattacatgactcgagtcattcattcaaagtagcttcctc

SEQ ID NO: 22294 - DNA, 40 bp, Artificial Sequence
  PCR primer for ORF amplification
aattacatgactcgagtcacagtttttttttgcagtcgtc

SEQ ID NO: 22295 - DNA, 40 bp, Artificial Sequence
  PCR primer for ORF amplification
aattacatgactcgagctacgctgctttttctagagacca

SEQ ID NO: 22296 - DNA, 40 bp, Artificial Sequence
  PCR primer for ORF amplification
aattacatgactcgagtcaaatagaatttaacagatccaa

SEQ ID NO: 22297 - DNA, 40 bp, Artificial Sequence
  PCR primer for ORF amplification
aattacatgactcgagttacaccttgaaacccttagatct

SEQ ID NO: 22298 - DNA, 40 bp, Artificial Sequence
  PCR primer for ORF amplification
aattacatgactcgagttatatatcgaaaccacggtctct

SEQ ID NO: 22299 - DNA, 40 bp, Artificial Sequence
  PCR primer for ORF amplification
aattacatgactcgagctagttgaccaaagcggaggcagt

SEQ ID NO: 22300 - DNA, 40 bp, Artificial Sequence
  PCR primer for ORF amplification
aattacatgactcgagtcataacaaatcatcttcttgttg

SEQ ID NO: 22301 - DNA, 40 bp, Artificial Sequence
  PCR primer for ORF amplification
aattacatgactcgagttaaagtattacacactttgactt

SEQ ID NO: 22302 - DNA, 40 bp, Artificial Sequence
  PCR primer for ORF amplification
aattacatgactcgagtcaatatatccttccctctttcat

SEQ ID NO: 22303 - DNA, 40 bp, Artificial Sequence
  PCR primer for ORF amplification
aattacatgactcgagttaagccttggcaacgtgttcaac

SEQ ID NO: 22304 - DNA, 40 bp, Artificial Sequence
  PCR primer for ORF amplification
aattacatgactcgagctaagcagtatcttcgacagcttg

SEQ ID NO: 22305 - DNA, 40 bp, Artificial Sequence
  PCR primer for ORF amplification
aattacatgactcgagttaaaaaacaattgggtaccctgg

SEQ ID NO: 22306 - DNA, 40 bp, Artificial Sequence
  PCR primer for ORF amplification
aattacatgactcgagctactgcattaataacaatgagtc

SEQ ID NO: 22307 - DNA, 40 bp, Artificial Sequence
  PCR primer for ORF amplification
aattacatgactcgagtcagtagaaagtggaaggtctctt

SEQ ID NO: 22308 - DNA, 40 bp, Artificial Sequence
  PCR primer for ORF amplification
aattacatgactcgagttaagccttggcaacatattcgat

SEQ ID NO: 22309 - DNA, 40 bp, Artificial Sequence
  PCR primer for ORF amplification
aattacatgactcgagttaaaaaaatacagcatcaagatc

SEQ ID NO: 22310 - DNA, 40 bp, Artificial Sequence
  PCR primer for ORF amplification
aattacatgactcgagctatgttcttcttttcctcaatgg

SEQ ID NO: 22311 - DNA, 40 bp, Artificial Sequence
  PCR primer for ORF amplification
aattacatgactcgagttattcttcgtcttcggcttcttc

SEQ ID NO: 22312 - DNA, 40 bp, Artificial Sequence
  PCR primer for ORF amplification
aattacatgactcgagtcagttacgtatttttattgaaga

SEQ ID NO: 22313 - DNA, 40 bp, Artificial Sequence
  PCR primer for ORF amplification
aattacatgactcgagctagagcacgatccacgtggtggc

SEQ ID NO: 22314 - DNA, 40 bp, Artificial Sequence
  PCR primer for ORF amplification
aattacatgactcgagttagcgtatgcccttcttacggcg

SEQ ID NO: 22315 - DNA, 40 bp, Artificial Sequence
  PCR primer for ORF amplification
aattacatgactcgagctacaataaggtttcacccaatgc

SEQ ID NO: 22316 - DNA, 40 bp, Artificial Sequence
  PCR primer for ORF amplification
aattacatgactcgagtcaagacctggaagagaagcctag

SEQ ID NO: 22317 - DNA, 40 bp, Artificial Sequence
  PCR primer for ORF amplification
aattacatgactcgagttattttctgcgtaaagcgtcaaa

SEQ ID NO: 22318 - DNA, 40 bp, Artificial Sequence
  PCR primer for ORF amplification
aattacatgactcgagttatttcttcttttcagcttcagc

SEQ ID NO: 22319 - DNA, 40 bp, Artificial Sequence
  PCR primer for ORF amplification
aattacatgactcgagttatgcatctttctgaacatcttt

SEQ ID NO: 22320 - DNA, 40 bp, Artificial Sequence
  PCR primer for ORF amplification
aattacatgactcgagtcacattttttcttcaaccagttt

SEQ ID NO: 22321 - DNA, 40 bp, Artificial Sequence
  PCR primer for ORF amplification
aattacatgactcgagctattgtggtatttcaagaactag

SEQ ID NO: 22322 - DNA, 40 bp, Artificial Sequence
  PCR primer for ORF amplification
aattacatgactcgagtcaatcaaagatttttgcaagcag

SEQ ID NO: 22323 - DNA, 40 bp, Artificial Sequence
  PCR primer for ORF amplification
aattacatgactcgagctaacatttcttattatctctata

SEQ ID NO: 22324 - DNA, 40 bp, Artificial Sequence
  PCR primer for ORF amplification
aattacatgactcgagttataaagtttgtagaacagcctc

SEQ ID NO: 22325 - DNA, 40 bp, Artificial Sequence
  PCR primer for ORF amplification
aattacatgactcgagttatttgtgataatatctctcatt

SEQ ID NO: 22326 - DNA, 40 bp, Artificial Sequence
  PCR primer for ORF amplification
aattacatgactcgagctatgtagttaggtctccctcaca

SEQ ID NO: 22327 - DNA, 40 bp, Artificial Sequence
  PCR primer for ORF amplification
aattacatgactcgagctatttactagcaacaaagttgac

SEQ ID NO: 22328 - DNA, 40 bp, Artificial Sequence
  PCR primer for ORF amplification
aattacatgactcgagttattgaaaaaaagtagttaaata

SEQ ID NO: 22329 - DNA, 40 bp, Artificial Sequence
  PCR primer for ORF amplification
aattacatgactcgagttagtttgtatatgacagcctact

SEQ ID NO: 22330 - DNA, 40 bp, Artificial Sequence
  PCR primer for ORF amplification
aattacatgactcgagttatatattggcccaaaagggatc

SEQ ID NO: 22331 - DNA, 40 bp, Artificial Sequence
  PCR primer for ORF amplification
aattacatgactcgagtcacaattcggataagtggtctat

SEQ ID NO: 22332 - DNA, 40 bp, Artificial Sequence
  PCR primer for ORF amplification
aattacatgactcgagctattggttcacggaaagactgtt

SEQ ID NO: 22333 - DNA, 40 bp, Artificial Sequence
  PCR primer for ORF amplification
aattacatgactcgagttattgtgctttttgtactggact

SEQ ID NO: 22334 - DNA, 40 bp, Artificial Sequence; identical to SEQ ID NO: 22297
  PCR primer for ORF amplification

SEQ ID NO: 22335 - DNA, 40 bp, Artificial Sequence
  PCR primer for ORF amplification
aattacatgactcgagttatatcatttctggatgaggaat

SEQ ID NO: 22336 - DNA, 40 bp, Artificial Sequence
  PCR primer for ORF amplification
aattacatgactcgagtcattgggtaattggacagttttt

SEQ ID NO: 22337 - DNA, 40 bp, Artificial Sequence
  PCR primer for ORF amplification
aattacatgactcgagttaagcggtaactttcttttcaat

SEQ ID NO: 22338 - DNA, 40 bp, Artificial Sequence
  PCR primer for ORF amplification
aattacatgactcgagtcaatgaggtaggaaacgacctaa

SEQ ID NO: 22339 - DNA, 40 bp, Artificial Sequence
  PCR primer for ORF amplification
aattacatgactcgagtcatgctggagtcgtggctcgttt

SEQ ID NO: 22340 - DNA, 40 bp, Artificial Sequence
  PCR primer for ORF amplification
aattacatgactcgagctaatttgcatcgataatttctac

SEQ ID NO: 22341 - DNA, 40 bp, Artificial Sequence
  PCR primer for ORF amplification
aattacatgactcgagttaaataacgtatacgccctctgt

SEQ ID NO: 22342 - DNA, 40 bp, Artificial Sequence
  PCR primer for ORF amplification
aattacatgactcgagttagtctgaatcagaatctgtgtc

SEQ ID NO: 22343 - DNA, 40 bp, Artificial Sequence
  PCR primer for ORF amplification
aattacatgactcgagttacatgaggttcatgttcatgtt

SEQ ID NO: 22344 - DNA, 40 bp, Artificial Sequence
  PCR primer for ORF amplification
aattacatgactcgagctatattaaatctgtgagattggc

SEQ ID NO: 22345 - DNA, 40 bp, Artificial Sequence
  PCR primer for ORF amplification
aattacatgactcgagttaatagaaaacaaattcagcaga

SEQ ID NO: 22346 - DNA, 40 bp, Artificial Sequence
  PCR primer for ORF amplification
aattacatgactcgagttaccaatagtttggaaataagta

SEQ ID NO: 22347 - DNA, 40 bp, Artificial Sequence
  PCR primer for ORF amplification
aattacatgactcgagctattgccgcaggaccagaatttc

SEQ ID NO: 22348 - DNA, 40 bp, Artificial Sequence
  PCR primer for ORF amplification
aattacatgactcgagttagacctcaaaagacaattcagg

SEQ ID NO: 22349 - DNA, 40 bp, Artificial Sequence
  PCR primer for ORF amplification
aattacatgactcgagttacatgataattggtttagaact

SEQ ID NO: 22350 - DNA, 40 bp, Artificial Sequence
  PCR primer for ORF amplification
aattacatgactcgagttagagggtaataccaaaattgtt

SEQ ID NO: 22351 - DNA, 40 bp, Artificial Sequence
  PCR primer for ORF amplification
aattacatgactcgagctataatacgtatagagtgaggag

SEQ ID NO: 22352 - DNA, 40 bp, Artificial Sequence
  PCR primer for ORF amplification
aattacatgactcgagtcatttacgtaaaggttgggcttg

SEQ ID NO: 22353 - DNA, 40 bp, Artificial Sequence
  PCR primer for ORF amplification
aattacatgactcgagttaaccgaaaagtttggcgaacac

SEQ ID NO: 22354 - DNA, 40 bp, Artificial Sequence
  PCR primer for ORF amplification
aattacatgactcgagttataagaataacatagcaacacc

SEQ ID NO: 22355 - DNA, 40 bp, Artificial Sequence
  PCR primer for ORF amplification
aattacatgactcgagctaggccaaagacatcttagccag

SEQ ID NO: 22356 - DNA, 40 bp, Artificial Sequence
  PCR primer for ORF amplification
aattacatgactcgagtcaccgccaaataggtctatcact

SEQ ID NO: 22357 - DNA, 40 bp, Artificial Sequence
  PCR primer for ORF amplification
aattacatgactcgagttataggagcaggttgggtatact

SEQ ID NO: 22358 - DNA, 40 bp, Artificial Sequence
  PCR primer for ORF amplification
aattacatgactcgagtcaattggagaatgaactcgctag

SEQ ID NO: 22359 - DNA, 40 bp, Artificial Sequence
  PCR primer for ORF amplification
aattacatgactcgagttattgtactagatgtggtaaatc

SEQ ID NO: 22360 - DNA, 40 bp, Artificial Sequence
  PCR primer for ORF amplification
aattacatgactcgagtcagcctcttatatatgtcgcatc

SEQ ID NO: 22361 - DNA, 40 bp, Artificial Sequence
  PCR primer for ORF amplification
aattacatgactcgagtcatggtttcgtcaccttcttttt

SEQ ID NO: 22362 - DNA, 40 bp, Artificial Sequence
  PCR primer for ORF amplification
aattacatgactcgagctagtcatctatcagcaaatattc

SEQ ID NO: 22363 - DNA, 40 bp, Artificial Sequence
  PCR primer for ORF amplification
aattacatgactcgagttatttcaagtccttgaaattacc

SEQ ID NO: 22364 - DNA, 40 bp, Artificial Sequence
  PCR primer for ORF amplification
aattacatgactcgagttatcctatagtaacataacctga

SEQ ID NO: 22365 - DNA, 40 bp, Artificial Sequence
  PCR primer for ORF amplification
aattacatgactcgagttaatttttcttgttctttcgttg

SEQ ID NO: 22366 - DNA, 40 bp, Artificial Sequence
  PCR primer for ORF amplification
aattacatgactcgagttaagctgttgtttgttggggaag

SEQ ID NO: 22367 - DNA, 40 bp, Artificial Sequence
  PCR primer for ORF amplification
aattacatgactcgagttattgtttcgtgatcttgtagat

SEQ ID NO: 22368 - DNA, 40 bp, Artificial Sequence
  PCR primer for ORF amplification
aattacatgactcgagctaatcctcatcagaggagaggta

SEQ ID NO: 22369 - DNA, 40 bp, Artificial Sequence
  PCR primer for ORF amplification
aattacatgactcgagttagcctgcaaaggaacttgctag

SEQ ID NO: 22370 - DNA, 40 bp, Artificial Sequence
  PCR primer for ORF amplification
aattacatgactcgagttattcaaacttcgttttgaaaaa

SEQ ID NO: 22371 - DNA, 40 bp, Artificial Sequence
  PCR primer for ORF amplification
aattacatgactcgagctacgcagattttgccttcggtat

SEQ ID NO: 22372 - DNA, 40 bp, Artificial Sequence
  PCR primer for ORF amplification
aattacatgactcgagctatttttcctctttttcggtgga

SEQ ID NO: 22373 - DNA, 40 bp, Artificial Sequence
  PCR primer for ORF amplification
aattacatgactcgagttatgaagcgtggtggtagtactc

SEQ ID NO: 22374 - DNA, 40 bp, Artificial Sequence
  PCR primer for ORF amplification
aattacatgactcgagttaagctggaagagccaatctctt

SEQ ID NO: 22375 - DNA, 40 bp, Artificial Sequence
  PCR primer for ORF amplification
aattacatgactcgagttacatgaaacttaaacacgatac

SEQ ID NO: 22376 - DNA, 40 bp, Artificial Sequence
  PCR primer for ORF amplification
aattacatgactcgagttaattgactaaaacccaaataac

SEQ ID NO: 22377 - DNA, 40 bp, Artificial Sequence
  PCR primer for ORF amplification
aattacatgactcgagctatttagagtaagatattttttc

SEQ ID NO: 22378 - DNA, 40 bp, Artificial Sequence
  PCR primer for ORF amplification
aattacatgactcgagttatccaatcgttgacattttgtc

SEQ ID NO: 22379 - DNA, 40 bp, Artificial Sequence
  PCR primer for ORF amplification
aattacatgactcgagttaccaaagcgagcggcactccag

SEQ ID NO: 22380 - DNA, 40 bp, Artificial Sequence
  PCR primer for ORF amplification
aattacatgactcgagctagccaccccatgaaaatcccaa

SEQ ID NO: 22381 - DNA, 40 bp, Artificial Sequence
  PCR primer for ORF amplification
aattacatgactcgagttatattttcttctttggttgtaa

SEQ ID NO: 22382 - DNA, 40 bp, Artificial Sequence
  PCR primer for ORF amplification
aattacatgactcgagttatacgttggctttaacagtttc

SEQ ID NO: 22383 - DNA, 40 bp, Artificial Sequence
  PCR primer for ORF amplification
aattacatgactcgagtcacagctcagattccagagtgtc

SEQ ID NO: 22384 - DNA, 40 bp, Artificial Sequence
  PCR primer for ORF amplification
aattacatgactcgagtcagatgttttcagaaccggaggt

SEQ ID NO: 22385 - DNA, 40 bp, Artificial Sequence
  PCR primer for ORF amplification
aattacatgactcgagttattctatcaagtctttttgacc

SEQ ID NO: 22386 - DNA, 40 bp, Artificial Sequence
  PCR primer for ORF amplification
aattacatgactcgagttattccttaccgtcgagcagttg

SEQ ID NO: 22387 - DNA, 40 bp, Artificial Sequence
  PCR primer for ORF amplification
aattacatgactcgagctatgggatggagtcttcgacctg

SEQ ID NO: 22388 - DNA, 40 bp, Artificial Sequence
  PCR primer for ORF amplification
aattacatgactcgagtcacacatcgtcctcaatactatt

SEQ ID NO: 22389 - DNA, 40 bp, Artificial Sequence
  PCR primer for ORF amplification
aattacatgactcgagttaacagttgagcaaatcgatagc

SEQ ID NO: 22390 - DNA, 40 bp, Artificial Sequence
  PCR primer for ORF amplification
aattacatgactcgagtcagttctcatagtcaaatattat

SEQ ID NO: 22391 - DNA, 40 bp, Artificial Sequence
  PCR primer for ORF amplification
aattacatgactcgagttattgtgagtcggaggggctgtt

SEQ ID NO: 22392 - DNA, 40 bp, Artificial Sequence
  PCR primer for ORF amplification
aattacatgactcgagtcaacttgcccaacgctgaaacat

SEQ ID NO: 22393 - DNA, 40 bp, Artificial Sequence
  PCR primer for ORF amplification
aattacatgactcgagctacaccgcaaaacgatatcgagt

SEQ ID NO: 22394 - DNA, 40 bp, Artificial Sequence
  PCR primer for ORF amplification
aattacatgactcgagtcaaaattccattattgggccaga

SEQ ID NO: 22395 - DNA, 40 bp, Artificial Sequence
  PCR primer for ORF amplification
aattacatgactcgagtcaaccagagtgctctgtttgata

SEQ ID NO: 22396 - DNA, 40 bp, Artificial Sequence
  PCR primer for ORF amplification
aattacatgactcgagttaattcaaggtggggaatggtaa

SEQ ID NO: 22397 - DNA, 40 bp, Artificial Sequence
  PCR primer for ORF amplification
aattacatgactcgagttattgttgtttgcaaccgtcggt

SEQ ID NO: 22398 - DNA, 40 bp, Artificial Sequence
  PCR primer for ORF amplification
aattacatgactcgagttactcttgggcacttaggtaccg

SEQ ID NO: 22399 - DNA, 40 bp, Artificial Sequence
  PCR primer for ORF amplification
aattacatgactcgagttaatcctcgtgccgctccacaaa

SEQ ID NO: 22400 - DNA, 40 bp, Artificial Sequence
  PCR primer for ORF amplification
aattacatgactcgagtcaagggtttaccatacgctcttc

SEQ ID NO: 22401 - DNA, 40 bp, Artificial Sequence
  PCR primer for ORF amplification
aattacatgactcgagttagttttcttcatctaaccagtc

SEQ ID NO: 22402 - DNA, 40 bp, Artificial Sequence
  PCR primer for ORF amplification
aattacatgactcgagctagtagacaatctttctaccggt

SEQ ID NO: 22403 - DNA, 40 bp, Artificial Sequence
  PCR primer for ORF amplification
aattacatgactcgagtcacttaatatccttaatgcttcc

SEQ ID NO: 22404 - DNA, 40 bp, Artificial Sequence
  PCR primer for ORF amplification
aattacatgactcgagttagttttttattctcacctttcc

SEQ ID NO: 22405 - DNA, 40 bp, Artificial Sequence
  PCR primer for ORF amplification
aattacatgactcgagttaacatctttgcctctggggttt

SEQ ID NO: 22406 - DNA, 40 bp, Artificial Sequence
  PCR primer for ORF amplification
aattacatgactcgagctaaatatcgaatttgtactgagt

SEQ ID NO: 22407 - DNA, 40 bp, Artificial Sequence
  PCR primer for ORF amplification
aattacatgactcgagttatattctgccctcaaattttaa

SEQ ID NO: 22408 - DNA, 40 bp, Artificial Sequence
  PCR primer for ORF amplification
aattacatgactcgagctaatgacgaattacacttctata

SEQ ID NO: 22409 - DNA, 40 bp, Artificial Sequence
  PCR primer for ORF amplification
aattacatgactcgagtcatttacttttctttatcgcccc

SEQ ID NO: 22410 - DNA, 40 bp, Artificial Sequence
  PCR primer for ORF amplification
aattacatgactcgagctacctatccctcaactccatcac

SEQ ID NO: 22411 - DNA, 40 bp, Artificial Sequence
  PCR primer for ORF amplification
aattacatgactcgagttattcatctcctgtaaccgaaac

SEQ ID NO: 22412 - DNA, 40 bp, Artificial Sequence
  PCR primer for ORF amplification
aattacatgactcgagtcagtacccccaaactcttattct

SEQ ID NO: 22413 - DNA, 40 bp, Artificial Sequence
  PCR primer for ORF amplification
aattacatgactcgagtcatctgaaggggggccttgtatt

SEQ ID NO: 22414 - DNA, 40 bp, Artificial Sequence
  PCR primer for ORF amplification
aattacatgactcgagtcaatggtatttatagccgcattg

SEQ ID NO: 22415 - DNA, 40 bp, Artificial Sequence
  PCR primer for ORF amplification
aattacatgactcgagtcatagcttggaagagtctaggat

SEQ ID NO: 22416 - DNA, 40 bp, Artificial Sequence
  PCR primer for ORF amplification
aattacatgactcgagttaaaatgaattggcatggtctaa

SEQ ID NO: 22417 - DNA, 40 bp, Artificial Sequence
  PCR primer for ORF amplification
aattacatgactcgagtcaaacatcgagaagacctttcga

SEQ ID NO: 22418 - DNA, 40 bp, Artificial Sequence
  PCR primer for ORF amplification
aattacatgactcgagtcaatttcccttgattatattcaa

SEQ ID NO: 22419 - DNA, 40 bp, Artificial Sequence
  PCR primer for ORF amplification
aattacatgactcgagttaaaaagtttcctcgtcgatgat

SEQ ID NO: 22420 - DNA, 40 bp, Artificial Sequence
  PCR primer for ORF amplification
aattacatgactcgagtcatccaggatccttgaaagattt

SEQ ID NO: 22421 - DNA, 40 bp, Artificial Sequence
  PCR primer for ORF amplification
aattacatgactcgagttatttcttctgtcttttagcaga

SEQ ID NO: 22422 - DNA, 40 bp, Artificial Sequence
  PCR primer for ORF amplification
aattacatgactcgagctagcctaccacgtaccatcggtc

SEQ ID NO: 22423 - DNA, 40 bp, Artificial Sequence
  PCR primer for ORF amplification
aattacatgactcgagttatcttcttttccccaaggtacc

SEQ ID NO: 22424 - DNA, 40 bp, Artificial Sequence
  PCR primer for ORF amplification
aattacatgactcgagttatatatatatatatagtgtgcg

SEQ ID NO: 22425 - DNA, 40 bp, Artificial Sequence
  PCR primer for ORF amplification
aattacatgactcgagtcataatctgttctgcttcttcaa

SEQ ID NO: 22426 - DNA, 40 bp, Artificial Sequence
  PCR primer for ORF amplification
aattacatgactcgagttactcagagtcggtggctacatc

SEQ ID NO: 22427 - DNA, 40 bp, Artificial Sequence
  PCR primer for ORF amplification
aattacatgactcgagttaatactttaaattgtccaagtt

SEQ ID NO: 22428 - DNA, 40 bp, Artificial Sequence
  PCR primer for ORF amplification
aattacatgactcgagttatttatatttaccaagtttttc

SEQ ID NO: 22429 - DNA, 40 bp, Artificial Sequence
  PCR primer for ORF amplification
aattacatgactcgagttaagctttcctggaagagacctt

SEQ ID NO: 22430 - DNA, 40 bp, Artificial Sequence
  PCR primer for ORF amplification
aattacatgactcgagttatattgccagcgtcgatgttga

SEQ ID NO: 22431 - DNA, 40 bp, Artificial Sequence
  PCR primer for ORF amplification
aattacatgactcgagttatatatataccatttggcccag

SEQ ID NO: 22432 - DNA, 40 bp, Artificial Sequence
  PCR primer for ORF amplification
aattacatgactcgagttatttcttttcaacgcccggtaa

SEQ ID NO: 22433 - DNA, 40 bp, Artificial Sequence
  PCR primer for ORF amplification
aattacatgactcgagctatgcgagcgtggcggagttggc

SEQ ID NO: 22434 - DNA, 40 bp, Artificial Sequence
  PCR primer for ORF amplification
aattacatgactcgagttagaagtcatcatcaaagttaat

SEQ ID NO: 22435 - DNA, 40 bp, Artificial Sequence
  PCR primer for ORF amplification
aattacatgactcgagtcaataaacggaaatataattgtt

SEQ ID NO: 22436 - DNA, 40 bp, Artificial Sequence
  PCR primer for ORF amplification
aattacatgactcgagttaacatctagcatatatctgcaa

SEQ ID NO: 22437 - DNA, 40 bp, Artificial Sequence
  PCR primer for ORF amplification
aattacatgactcgagtcagttcttaagaggtatcttatt

SEQ ID NO: 22438 - DNA, 40 bp, Artificial Sequence
  PCR primer for ORF amplification
aattacatgactcgagtcataatagcatatccattcttga

SEQ ID NO: 22439 - DNA, 40 bp, Artificial Sequence
  PCR primer for ORF amplification
aattacatgactcgagttacgccatttcgtatctgtcacc

SEQ ID NO: 22440 - DNA, 40 bp, Artificial Sequence
  PCR primer for ORF amplification
aattacatgactcgagttacattgagaaaaaacttttata

SEQ ID NO: 22441 - DNA, 40 bp, Artificial Sequence
  PCR primer for ORF amplification
aattacatgactcgagttattgcgtggacccataattcac

SEQ ID NO: 22442 - DNA, 40 bp, Artificial Sequence
  PCR primer for ORF amplification
aattacatgactcgagtcaatgctcatccatgagcgccat

SEQ ID NO: 22443 - DNA, 40 bp, Artificial Sequence
  PCR primer for ORF amplification
aattacatgactcgagctagcgacgggatttctttttgcc

SEQ ID NO: 22444 - DNA, 40 bp, Artificial Sequence
  PCR primer for ORF amplification
aattacatgactcgagctatctgaacatggatccctgccc

SEQ ID NO: 22445 - DNA, 40 bp, Artificial Sequence
  PCR primer for ORF amplification
aattacatgactcgagttaacctacataatctaggaacaa

SEQ ID NO: 22446 - DNA, 40 bp, Artificial Sequence
  PCR primer for ORF amplification
aattacatgactcgagtcactcgctgatgcccttgcgctt

SEQ ID NO: 22447 - DNA, 40 bp, Artificial Sequence
  PCR primer for ORF amplification
aattacatgactcgagttagagtcttccaccgggggtgac

SEQ ID NO: 22448 - DNA, 40 bp, Artificial Sequence
  PCR primer for ORF amplification
aattacatgactcgagttattgttctaaaacctttgccca

SEQ ID NO: 22449 - DNA, 40 bp, Artificial Sequence
  PCR primer for ORF amplification
aattacatgactcgagctattgcttgttctcattgtctgg

SEQ ID NO: 22450 - DNA, 40 bp, Artificial Sequence
  PCR primer for ORF amplification
aattacatgactcgagttaaaaccacctaccagcagcctg

SEQ ID NO: 22451 - DNA, 40 bp, Artificial Sequence
  PCR primer for ORF amplification
aattacatgactcgagttataaaccttgttgagctcttct

SEQ ID NO: 22452 - DNA, 40 bp, Artificial Sequence
  PCR primer for ORF amplification
aattacatgactcgagttaaatgggggttctagtttcaac

SEQ ID NO: 22453 - DNA, 40 bp, Artificial Sequence
  PCR primer for ORF amplification
aattacatgactcgagtcagccttctgtttgttctcttct

SEQ ID NO: 22454 - DNA, 40 bp, Artificial Sequence
  PCR primer for ORF amplification
aattacatgactcgagttaattagcttcttgcatgtgctc

SEQ ID NO: 22455 - DNA, 40 bp, Artificial Sequence
  PCR primer for ORF amplification
aattacatgactcgagttacctttttcttctgtgttgagg

SEQ ID NO: 22456 - DNA, 40 bp, Artificial Sequence
  PCR primer for ORF amplification
aattacatgactcgagtcatacaaactcgtcaacatttaa

SEQ ID NO: 22457 - DNA, 40 bp, Artificial Sequence
  PCR primer for ORF amplification
aattacatgactcgagttaggcttcattttgaacttctaa

SEQ ID NO: 22458 - DNA, 40 bp, Artificial Sequence
  PCR primer for ORF amplification
aattacatgactcgagctattcctttttaacctgtcttgc

SEQ ID NO: 22459 - DNA, 40 bp, Artificial Sequence
  PCR primer for ORF amplification
aattacatgactcgagctacctaacaaaatccattccttg

SEQ ID NO: 22460 - DNA, 40 bp, Artificial Sequence
  PCR primer for ORF amplification
aattacatgactcgagctaaaactcaaaaagtggcatgtc

SEQ ID NO: 22461 - DNA, 40 bp, Artificial Sequence
  PCR primer for ORF amplification
aattacatgactcgagttagattagtgatgtatagctaat

SEQ ID NO: 22462 - DNA, 40 bp, Artificial Sequence
  PCR primer for ORF amplification
aattacatgactcgagctaatgcgaatatttagtgactac

SEQ ID NO: 22463 - DNA, 40 bp, Artificial Sequence
  PCR primer for ORF amplification
aattacatgactcgagttagtaaccgaaagaagccaattg

SEQ ID NO: 22464 - DNA, 40 bp, Artificial Sequence
  PCR primer for ORF amplification
aattacatgactcgagttagcttttactttgaacttctag

SEQ ID NO: 22465 - DNA, 40 bp, Artificial Sequence
  PCR primer for ORF amplification
aattacatgactcgagttaatgcattaaataagaaccttc

SEQ ID NO: 22466 - DNA, 40 bp, Artificial Sequence
  PCR primer for ORF amplification
aattacatgactcgagctactgtgacttgccaatatggtc

SEQ ID NO: 22467 - DNA, 40 bp, Artificial Sequence
  PCR primer for ORF amplification
aattacatgactcgagttatcgtctagatgctcctttctt

SEQ ID NO: 22468 - DNA, 40 bp, Artificial Sequence
  PCR primer for ORF amplification
aattacatgactcgagttacaagtcatctgaaatgctgtc

SEQ ID NO: 22469 - DNA, 40 bp, Artificial Sequence
  PCR primer for ORF amplification
aattacatgactcgagttatttagaagtgtcaacaacgta

SEQ ID NO: 22470 - DNA, 40 bp, Artificial Sequence; identical to SEQ ID NO: 22469
  PCR primer for ORF amplification

SEQ ID NO: 22471 - DNA, 40 bp, Artificial Sequence
  PCR primer for ORF amplification
aattacatgactcgagttatttctctttctttacttcatt

SEQ ID NO: 22472 - DNA, 40 bp, Artificial Sequence
  PCR primer for ORF amplification
aattacatgactcgagtcagaacttggctcgaatgtctcg

SEQ ID NO: 22473 - DNA, 40 bp, Artificial Sequence
  PCR primer for ORF amplification
aattacatgactcgagttattgttgggcagtaattactga

SEQ ID NO: 22474 - DNA, 40 bp, Artificial Sequence
  PCR primer for ORF amplification
aattacatgactcgagtcaattgatttctgcttgtaatgc

SEQ ID NO: 22475 - DNA, 40 bp, Artificial Sequence
  PCR primer for ORF amplification
aattacatgactcgagttacaaaccttcgtccatccaggc

SEQ ID NO: 22476 - DNA, 40 bp, Artificial Sequence
  PCR primer for ORF amplification
aattacatgactcgagtcatggctgctcaattttaacgta

SEQ ID NO: 22477 - DNA, 40 bp, Artificial Sequence
  PCR primer for ORF amplification
aattacatgactcgagttaaaattcaacgttggaaggagg

SEQ ID NO: 22478 - DNA, 40 bp, Artificial Sequence
  PCR primer for ORF amplification
aattacatgactcgagctactcgtccgggaggcagcaatc

SEQ ID NO: 22479 - DNA, 40 bp, Artificial Sequence
  PCR primer for ORF amplification
aattacatgactcgagttatttgaatggtgccgataacct

SEQ ID NO: 22480 - DNA, 40 bp, Artificial Sequence
  PCR primer for ORF amplification
aattacatgactcgagctacttacgtttaaaaaatccatc

SEQ ID NO: 22481 - DNA, 40 bp, Artificial Sequence
  PCR primer for ORF amplification
aattacatgactcgagtcaaactaatggcttagattcatt

SEQ ID NO: 22482 - DNA, 40 bp, Artificial Sequence
  PCR primer for ORF amplification
aattacatgactcgagttattttgcctttcttttgaaaaa

SEQ ID NO: 22483 - DNA, 40 bp, Artificial Sequence
  PCR primer for ORF amplification
aattacatgactcgagtcaaatgaccatatcaacaggata

SEQ ID NO: 22484 - DNA, 40 bp, Artificial Sequence
  PCR primer for ORF amplification
aattacatgactcgagttataatacggcaccaaagccgaa

SEQ ID NO: 22485 - DNA, 40 bp, Artificial Sequence
  PCR primer for ORF amplification
aattacatgactcgagttatttaaaaccgttcacaatctt

SEQ ID NO: 22486 - DNA, 40 bp, Artificial Sequence
  PCR primer for ORF amplification
aattacatgactcgagttacaaaccttgttgagctcttct

SEQ ID NO: 22487 - DNA, 40 bp, Artificial Sequence
  PCR primer for ORF amplification
aattacatgactcgagtcaagcctcatgtggattatcgct

SEQ ID NO: 22488 - DNA, 40 bp, Artificial Sequence
  PCR primer for ORF amplification
aattacatgactcgagtcatgtgggaggaggatgttttgg

SEQ ID NO: 22489 - DNA, 40 bp, Artificial Sequence
  PCR primer for ORF amplification
aattacatgactcgagctatctattccttttcctactatc

SEQ ID NO: 22490 - DNA, 40 bp, Artificial Sequence
  PCR primer for ORF amplification
aattacatgactcgagttacttatatgtacttaactgttt

SEQ ID NO: 22491 - DNA, 40 bp, Artificial Sequence
  PCR primer for ORF amplification
aattacatgactcgagttaaagccgtgctttgtccagcaa

SEQ ID NO: 22492 - DNA, 40 bp, Artificial Sequence
  PCR primer for ORF amplification
aattacatgactcgagtcatttagaagtctcaacaacata

SEQ ID NO: 22493 - DNA, 40 bp, Artificial Sequence
  PCR primer for ORF amplification
aattacatgactcgagttacacggtactgctttccgattt

SEQ ID NO: 22494 - DNA, 40 bp, Artificial Sequence
  PCR primer for ORF amplification
aattacatgactcgagttaacaattcagaatctcatctgt

SEQ ID NO: 22495 - DNA, 40 bp, Artificial Sequence
  PCR primer for ORF amplification
aattacatgactcgagtcatgcgtacttttctaacgtttt

SEQ ID NO: 22496 - DNA, 40 bp, Artificial Sequence
  PCR primer for ORF amplification
aattacatgactcgagttatatgtatttatgtttgtattt

SEQ ID NO: 22497 - DNA, 40 bp, Artificial Sequence
  PCR primer for ORF amplification
aattacatgactcgagctatttgcttctcttgtaaacttt

SEQ ID NO: 22498 - DNA, 40 bp, Artificial Sequence
  PCR primer for ORF amplification
aattacatgactcgagttaaaaattttcatctatagcacg

SEQ ID NO: 22499 - DNA, 40 bp, Artificial Sequence
  PCR primer for ORF amplification
aattacatgactcgagttagaaatcgtcccatttgtcctc

SEQ ID NO: 22500 - DNA, 40 bp, Artificial Sequence
  PCR primer for ORF amplification
aattacatgactcgagttaatcctccaaatcatctaattc

SEQ ID NO: 22501 - DNA, 40 bp, Artificial Sequence
  PCR primer for ORF amplification
aattacatgactcgagttaaaagtaacccccataatctag

SEQ ID NO: 22502 - DNA, 40 bp, Artificial Sequence
  PCR primer for ORF amplification
aattacatgactcgagtcatacgactacttgaatagattc

SEQ ID NO: 22503 - DNA, 40 bp, Artificial Sequence
  PCR primer for ORF amplification
aattacatgactcgagctaactaaatatttcgttccaaat

SEQ ID NO: 22504 - DNA, 40 bp, Artificial Sequence
  PCR primer for ORF amplification
aattacatgactcgagttagtttttgaaagaattgagatc

SEQ ID NO: 22505 - DNA, 40 bp, Artificial Sequence
  PCR primer for ORF amplification
aattacatgactcgagtcaacccaaattggtattgaaccc

SEQ ID NO: 22506 - DNA, 40 bp, Artificial Sequence
  PCR primer for ORF amplification
aattacatgactcgagctagtcgttgcggatatggacgat

SEQ ID NO: 22507 - DNA, 40 bp, Artificial Sequence
  PCR primer for ORF amplification
aattacatgactcgagttacaaacctcttcttaaaatttc

SEQ ID NO: 22508 - DNA, 40 bp, Artificial Sequence
  PCR primer for ORF amplification
aattacatgactcgagttaaaatgatattttgccattttt

SEQ ID NO: 22509 - DNA, 40 bp, Artificial Sequence
  PCR primer for ORF amplification
aattacatgactcgagttagtcattgttgtaagtgttctg

SEQ ID NO: 22510 - DNA, 40 bp, Artificial Sequence
  PCR primer for ORF amplification
aattacatgactcgagttagagttgggatattttaaccaa

SEQ ID NO: 22511 - DNA, 40 bp, Artificial Sequence
  PCR primer for ORF amplification
aattacatgactcgagttaagccttcaaagaagaagctct

SEQ ID NO: 22512 - DNA, 40 bp, Artificial Sequence
  PCR primer for ORF amplification
aattacatgactcgagtcatgggaaaatgctttccagagc

SEQ ID NO: 22513 - DNA, 40 bp, Artificial Sequence
  PCR primer for ORF amplification
aattacatgactcgagtcattcaccacgcaatgccttgat

SEQ ID NO: 22514 - DNA, 40 bp, Artificial Sequence
  PCR primer for ORF amplification
aattacatgactcgagtcaattgctttttgttataacttg

SEQ ID NO: 22515 - DNA, 40 bp, Artificial Sequence
  PCR primer for ORF amplification
aattacatgactcgagctattccttatcttctaactcata

SEQ ID NO: 22516 - DNA, 40 bp, Artificial Sequence
  PCR primer for ORF amplification
aattacatgactcgagtcaaattttgttatgatcaccgaa

SEQ ID NO: 22517 - DNA, 40 bp, Artificial Sequence
  PCR primer for ORF amplification
aattacatgactcgagctaattataaaatgcatcatagaa

SEQ ID NO: 22518 - DNA, 40 bp, Artificial Sequence
  PCR primer for ORF amplification
aattacatgactcgagctaaagtttagccttctttttaga

SEQ ID NO: 22519 - DNA, 40 bp, Artificial Sequence
  PCR primer for ORF amplification
aattacatgactcgagttaatctagacagcacataacttt

SEQ ID NO: 22520 - DNA, 40 bp, Artificial Sequence
  PCR primer for ORF amplification
aattacatgactcgagttatggcctttggtaatagagacc

SEQ ID NO: 22521 - DNA, 40 bp, Artificial Sequence
  PCR primer for ORF amplification
aattacatgactcgagctatttaggccttagactttctat

SEQ ID NO: 22522 - DNA, 40 bp, Artificial Sequence
  PCR primer for ORF amplification
aattacatgactcgagctagaatttcataaaaatatctag

SEQ ID NO: 22523 - DNA, 40 bp, Artificial Sequence
  PCR primer for ORF amplification
aattacatgactcgagctaagttttggcagtgacggtgac

SEQ ID NO: 22524 - DNA, 40 bp, Artificial Sequence
  PCR primer for ORF amplification
aattacatgactcgagctaaaacaattcattgaattttat

SEQ ID NO: 22525 - DNA, 40 bp, Artificial Sequence
  PCR primer for ORF amplification
aattacatgactcgagtcattccgggccctcaatgatcgt

SEQ ID NO: 22526 - DNA, 40 bp, Artificial Sequence
  PCR primer for ORF amplification
aattacatgactcgagtcacttatgctgctccaggagatg

SEQ ID NO: 22527 - DNA, 40 bp, Artificial Sequence
  PCR primer for ORF amplification
aattacatgactcgagtcatttcatcgaaaaggcttccgg

SEQ ID NO: 22528 - DNA, 40 bp, Artificial Sequence
  PCR primer for ORF amplification
aattacatgactcgagtcataatctagaaatgtcaggctt

SEQ ID NO: 22529 - DNA, 40 bp, Artificial Sequence
  PCR primer for ORF amplification
aattacatgactcgagttagaactgaattatttcacattg

SEQ ID NO: 22530 - DNA, 40 bp, Artificial Sequence
  PCR primer for ORF amplification
aattacatgactcgagctactcgtccacaagagtggcagt

SEQ ID NO: 22531 - DNA, 40 bp, Artificial Sequence
  PCR primer for ORF amplification
aattacatgactcgagttacatttcattcattttttttct

SEQ ID NO: 22532 - DNA, 40 bp, Artificial Sequence
  PCR primer for ORF amplification
aattacatgactcgagtcattcaggaccaaagataatagt

SEQ ID NO: 22533 - DNA, 40 bp, Artificial Sequence
  PCR primer for ORF amplification
aattacatgactcgagttaaatgccaaaattccatttcat

SEQ ID NO: 22534 - DNA, 40 bp, Artificial Sequence
  PCR primer for ORF amplification
aattacatgactcgagtcatttcaaaggttcattacttag

SEQ ID NO: 22535 - DNA, 40 bp, Artificial Sequence
  PCR primer for ORF amplification
aattacatgactcgagttagtacaattgtctattacccca

SEQ ID NO: 22536 - DNA, 40 bp, Artificial Sequence
  PCR primer for ORF amplification
aattacatgactcgagttagccgccgaacctgcataatga

SEQ ID NO: 22537 - DNA, 40 bp, Artificial Sequence
  PCR primer for ORF amplification
aattacatgactcgagttaggcgtttcttgactgaatgac

SEQ ID NO: 22538 - DNA, 40 bp, Artificial Sequence
  PCR primer for ORF amplification
aattacatgactcgagttacacgggcggcacgactttact

SEQ ID NO: 22539 - DNA, 40 bp, Artificial Sequence
  PCR primer for ORF amplification
aattacatgactcgagtcattgctgttcgacgctagcacc

SEQ ID NO: 22540 - DNA, 40 bp, Artificial Sequence
  PCR primer for ORF amplification
aattacatgactcgagctacagtctcctttgagctctatc

SEQ ID NO: 22541 - DNA, 40 bp, Artificial Sequence
  PCR primer for ORF amplification
aattacatgactcgagttattctttagcggctttttgtga

SEQ ID NO: 22542 - DNA, 40 bp, Artificial Sequence
  PCR primer for ORF amplification
aattacatgactcgagtcatgctatatgtgcgacagcggt

SEQ ID NO: 22543 - DNA, 40 bp, Artificial Sequence
  PCR primer for ORF amplification
aattacatgactcgagttaagcgtcttccttcaataaagc

SEQ ID NO: 22544 - DNA, 40 bp, Artificial Sequence
  PCR primer for ORF amplification
aattacatgactcgagctagtggagaggttgtcgctttgt

SEQ ID NO: 22545 - DNA, 40 bp, Artificial Sequence
  PCR primer for ORF amplification
aattacatgactcgagtcacgttcgaagatgtttggaaag

SEQ ID NO: 22546 - DNA, 40 bp, Artificial Sequence
  PCR primer for ORF amplification
aattacatgactcgagctaatcaaaaggtattggtttatg

SEQ ID NO: 22547 - DNA, 40 bp, Artificial Sequence
  PCR primer for ORF amplification
aattacatgactcgagctaaagtctttgagcaatcttgat

SEQ ID NO: 22548 - DNA, 40 bp, Artificial Sequence
  PCR primer for ORF amplification
aattacatgactcgagttatattttctgtattttttcaaa

SEQ ID NO: 22549 - DNA, 40 bp, Artificial Sequence
  PCR primer for ORF amplification
aattacatgactcgagttataaagtgttagtggtacggaa

SEQ ID NO: 22550 - DNA, 40 bp, Artificial Sequence
  PCR primer for ORF amplification
aattacatgactcgagttagttgccgttacctctcatttt

SEQ ID NO: 22551 - DNA, 40 bp, Artificial Sequence
  PCR primer for ORF amplification
aattacatgactcgagtcaaaagctgagtttctcaagagc

SEQ ID NO: 22552 - DNA, 40 bp, Artificial Sequence
  PCR primer for ORF amplification
aattacatgactcgagtcaagggtcctttgattctgactc

SEQ ID NO: 22553 - DNA, 40 bp, Artificial Sequence
  PCR primer for ORF amplification
aattacatgactcgagtcaatctttgttctcctctgccgc

SEQ ID NO: 22554 - DNA, 40 bp, Artificial Sequence
  PCR primer for ORF amplification
aattacatgactcgagttaagaataggttttactaaactt

SEQ ID NO: 22555 - DNA, 40 bp, Artificial Sequence
  PCR primer for ORF amplification
aattacatgactcgagttacatggtagataatttgttgat

SEQ ID NO: 22556 - DNA, 40 bp, Artificial Sequence
  PCR primer for ORF amplification
aattacatgactcgagttacataacaacgcactcactttt

SEQ ID NO: 22557 - DNA, 40 bp, Artificial Sequence
  PCR primer for ORF amplification
aattacatgactcgagctaagtttcattctcactatcact

SEQ ID NO: 22558 - DNA, 40 bp, Artificial Sequence
  PCR primer for ORF amplification
aattacatgactcgagtcaataacggccatttctttggct

SEQ ID NO: 22559 - DNA, 40 bp, Artificial Sequence
  PCR primer for ORF amplification
aattacatgactcgagttatcgttcatcgtgtatttcgaa

SEQ ID NO: 22560 - DNA, 40 bp, Artificial Sequence
  PCR primer for ORF amplification
aattacatgactcgagtcaagcactttttaaattcacaat

SEQ ID NO: 22561 - DNA, 40 bp, Artificial Sequence
  PCR primer for ORF amplification
aattacatgactcgagctagtctgaaaattctttgtcgta

SEQ ID NO: 22562 - DNA, 40 bp, Artificial Sequence
  PCR primer for ORF amplification
aattacatgactcgagtcacataataatagcttcctttgg

SEQ ID NO: 22563 - DNA, 40 bp, Artificial Sequence
  PCR primer for ORF amplification
aattacatgactcgagctataaaccttgttcctctaaagt

SEQ ID NO: 22564 - DNA, 40 bp, Artificial Sequence
  PCR primer for ORF amplification
aattacatgactcgagttagaacaaataactttcaattct

SEQ ID NO: 22565 - DNA, 40 bp, Artificial Sequence
  PCR primer for ORF amplification
aattacatgactcgagttaacagcttgcaccagatccaga

SEQ ID NO: 22566 - DNA, 40 bp, Artificial Sequence
  PCR primer for ORF amplification
aattacatgactcgagttactgttgtaattcagaaattgg

SEQ ID NO: 22567 - DNA, 40 bp, Artificial Sequence
  PCR primer for ORF amplification
aattacatgactcgagctatttatggaatttcttatcata

SEQ ID NO: 22568 - DNA, 40 bp, Artificial Sequence
  PCR primer for ORF amplification
aattacatgactcgagttagtcaatttcgattacttccgg

SEQ ID NO: 22569 - DNA, 40 bp, Artificial Sequence
  PCR primer for ORF amplification
aattacatgactcgagttaaccaccgtagacgccagaaaa

SEQ ID NO: 22570 - DNA, 40 bp, Artificial Sequence
  PCR primer for ORF amplification
aattacatgactcgagttaatcgtgtttcaaagtttcggt

SEQ ID NO: 22571 - DNA, 40 bp, Artificial Sequence
  PCR primer for ORF amplification
aattacatgactcgagctagtcatgcttcaaggtttcggc

SEQ ID NO: 22572 - DNA, 40 bp, Artificial Sequence
  PCR primer for ORF amplification
aattacatgactcgagtcaagcaaactcaaaagaacaatc

SEQ ID NO: 22573 - DNA, 40 bp, Artificial Sequence
  PCR primer for ORF amplification
aattacatgactcgagctatgtaaaaatatgttccctata

SEQ ID NO: 22574 - DNA, 40 bp, Artificial Sequence
  PCR primer for ORF amplification
aattacatgactcgagttatttgcttgcaaacttaatata

SEQ ID NO: 22575 - DNA, 40 bp, Artificial Sequence
  PCR primer for ORF amplification
aattacatgactcgagttacttcgaaccaattctgtggca

SEQ ID NO: 22576 - DNA, 40 bp, Artificial Sequence
  PCR primer for ORF amplification
aattacatgactcgagttaatcaagaggttgagatgacaa

SEQ ID NO: 22577 - DNA, 40 bp, Artificial Sequence
  PCR primer for ORF amplification
aattacatgactcgagtcatcgattattgggagtgggagt

SEQ ID NO: 22578 - DNA, 40 bp, Artificial Sequence
  PCR primer for ORF amplification
aattacatgactcgagtcatcgtgttagacttttgtaaag

SEQ ID NO: 22579 - DNA, 40 bp, Artificial Sequence; identical to SEQ ID NO: 20618
  PCR primer for ORF amplification

SEQ ID NO: 22580 - DNA, 40 bp, Artificial Sequence
  PCR primer for ORF amplification
aattacatgactcgagttacaaatacttttcaaaatgttt

SEQ ID NO: 22581 - DNA, 40 bp, Artificial Sequence
  PCR primer for ORF amplification
aattacatgactcgagtcatttggataaccattttagcaa

SEQ ID NO: 22582 - DNA, 40 bp, Artificial Sequence
  PCR primer for ORF amplification
aattacatgactcgagtcactggttacgggagcgtagtga

SEQ ID NO: 22583 - DNA, 40 bp, Artificial Sequence
  PCR primer for ORF amplification
aattacatgactcgagctatttaccatcctccccacgctg

SEQ ID NO: 22584 - DNA, 40 bp, Artificial Sequence
  PCR primer for ORF amplification
aattacatgactcgagctactctctggagacaagttttcg

SEQ ID NO: 22585 - DNA, 40 bp, Artificial Sequence
  PCR primer for ORF amplification
aattacatgactcgagttatatctttgcgcctttgagaaa

SEQ ID NO: 22586 - DNA, 40 bp, Artificial Sequence
  PCR primer for ORF amplification
aattacatgactcgagtcacagtattttgaattctgttag

SEQ ID NO: 22587 - DNA, 40 bp, Artificial Sequence
  PCR primer for ORF amplification
aattacatgactcgagctagcagcagacatcccggtcaac

SEQ ID NO: 22588 - DNA, 40 bp, Artificial Sequence
  PCR primer for ORF amplification
aattacatgactcgagctatattgttaacttgttagcgcg

SEQ ID NO: 22589 - DNA, 40 bp, Artificial Sequence
  PCR primer for ORF amplification
aattacatgactcgagtcaagtgtctaaatcttgtaaaag

SEQ ID NO: 22590 - DNA, 40 bp, Artificial Sequence
  PCR primer for ORF amplification
aattacatgactcgagtcaagatacttgctgggatggctt

SEQ ID NO: 22591 - DNA, 40 bp, Artificial Sequence
  PCR primer for ORF amplification
aattacatgactcgagttattcttcatcggcctcatcagc

SEQ ID NO: 22592 - DNA, 40 bp, Artificial Sequence
  PCR primer for ORF amplification
aattacatgactcgagttatctatttactttctcggattc

SEQ ID NO: 22593 - DNA, 40 bp, Artificial Sequence
  PCR primer for ORF amplification
aattacatgactcgagttaacgaggttcccatctcaccga

SEQ ID NO: 22594 - DNA, 40 bp, Artificial Sequence
  PCR primer for ORF amplification
aattacatgactcgagttaagcaaggattttcttaacttc

SEQ ID NO: 22595 - DNA, 40 bp, Artificial Sequence
  PCR primer for ORF amplification
aattacatgactcgagctagtcacttgaatcggtaatacc

SEQ ID NO: 22596 - DNA, 40 bp, Artificial Sequence
  PCR primer for ORF amplification
aattacatgactcgagctagtagaagacaaagttagcaga

SEQ ID NO: 22597 - DNA, 40 bp, Artificial Sequence
  PCR primer for ORF amplification
aattacatgactcgagtcatatgttcccattaggcagttc

SEQ ID NO: 22598 - DNA, 40 bp, Artificial Sequence
  PCR primer for ORF amplification
aattacatgactcgagttatttcgtagctagcttagtttt

SEQ ID NO: 22599 - DNA, 40 bp, Artificial Sequence
  PCR primer for ORF amplification
aattacatgactcgagtcagttgttcttcttggtatttgg

SEQ ID NO: 22600 - DNA, 40 bp, Artificial Sequence
  PCR primer for ORF amplification
aattacatgactcgagttaaaaaccgtatttcgccaaaac

SEQ ID NO: 22601 - DNA, 40 bp, Artificial Sequence
  PCR primer for ORF amplification
aattacatgactcgagttaaatcaagtttcttgctagtaa

SEQ ID NO: 22602 - DNA, 40 bp, Artificial Sequence
  PCR primer for ORF amplification
aattacatgactcgagctacgtaaaacttaattcttgtct

SEQ ID NO: 22603 - DNA, 40 bp, Artificial Sequence
  PCR primer for ORF amplification
aattacatgactcgagtcactcctcattgttaaccttggt

SEQ ID NO: 22604 - DNA, 40 bp, Artificial Sequence
  PCR primer for ORF amplification
aattacatgactcgagtcatttcatcttaacaaccacttt

SEQ ID NO: 22605 - DNA, 40 bp, Artificial Sequence
  PCR primer for ORF amplification
aattacatgactcgagtcaccttttctttttctctttaac

SEQ ID NO: 22606 - DNA, 40 bp, Artificial Sequence
  PCR primer for ORF amplification
aattacatgactcgagttagttcttgacataaagacggta

SEQ ID NO: 22607 - DNA, 40 bp, Artificial Sequence
  PCR primer for ORF amplification
aattacatgactcgagtcaattagcaacgtcctcctttga

SEQ ID NO: 22608 - DNA, 40 bp, Artificial Sequence
  PCR primer for ORF amplification
aattacatgactcgagtcatgcggggggatgcatttcatg

SEQ ID NO: 22609 - DNA, 40 bp, Artificial Sequence
  PCR primer for ORF amplification
aattacatgactcgagttacagtctttgtagataatgaat

SEQ ID NO: 22610 - DNA, 40 bp, Artificial Sequence
  PCR primer for ORF amplification
aattacatgactcgagtcactgatgcaatttgtttccaaa

SEQ ID NO: 22611 - DNA, 40 bp, Artificial Sequence
  PCR primer for ORF amplification
aattacatgactcgagtcacttcaaaagctgggccaactt

SEQ ID NO: 22612 - DNA, 40 bp, Artificial Sequence
  PCR primer for ORF amplification
aattacatgactcgagttatgaaagtttatacacattatc

SEQ ID NO: 22613 - DNA, 40 bp, Artificial Sequence
  PCR primer for ORF amplification
aattacatgactcgagtcatgcagtgaggaaatccatgga

SEQ ID NO: 22614 - DNA, 40 bp, Artificial Sequence
  PCR primer for ORF amplification
aattacatgactcgagctatcctctattcatggtatttcc

SEQ ID NO: 22615 - DNA, 40 bp, Artificial Sequence
  PCR primer for ORF amplification
aattacatgactcgagttatgataattcattttttgctct

SEQ ID NO: 22616 - DNA, 40 bp, Artificial Sequence
  PCR primer for ORF amplification
aattacatgactcgagtcatggaggtcggatatcaggctt

SEQ ID NO: 22617 - DNA, 40 bp, Artificial Sequence
  PCR primer for ORF amplification
aattacatgactcgagttattcaattgacaagacttcttt

SEQ ID NO: 22618 - DNA, 40 bp, Artificial Sequence
  PCR primer for ORF amplification
aattacatgactcgagttattcgatattgttataatgaag

SEQ ID NO: 22619 - DNA, 40 bp, Artificial Sequence
  PCR primer for ORF amplification
aattacatgactcgagctataaccgcttattttcccaaaa

SEQ ID NO: 22620 - DNA, 40 bp, Artificial Sequence
  PCR primer for ORF amplification
aattacatgactcgagtcattcttgtctctcaaccactga

SEQ ID NO: 22621 - DNA, 40 bp, Artificial Sequence
  PCR primer for ORF amplification
aattacatgactcgagctagaatacttgattggggttccc

SEQ ID NO: 22622 - DNA, 40 bp, Artificial Sequence
  PCR primer for ORF amplification
aattacatgactcgagctacgtacttgttttcttagtaga

SEQ ID NO: 22623 - DNA, 40 bp, Artificial Sequence
  PCR primer for ORF amplification
aattacatgactcgagttattctttcttagtcttcctctt

SEQ ID NO: 22624 - DNA, 40 bp, Artificial Sequence
  PCR primer for ORF amplification
aattacatgactcgagctaggtgataagataaaagttaaa

SEQ ID NO: 22625 - DNA, 40 bp, Artificial Sequence
  PCR primer for ORF amplification
aattacatgactcgagttaacgatgcatttcttctggacc

SEQ ID NO: 22626 - DNA, 40 bp, Artificial Sequence
  PCR primer for ORF amplification
aattacatgactcgagctatgcaatctttttgcttgtgtt

SEQ ID NO: 22627 - DNA, 40 bp, Artificial Sequence
  PCR primer for ORF amplification
aattacatgactcgagtcaccttctaactctgctaaaaac

SEQ ID NO: 22628 - DNA, 40 bp, Artificial Sequence; identical to SEQ ID NO: 22511
  PCR primer for ORF amplification

SEQ ID NO: 22629 - DNA, 40 bp, Artificial Sequence
  PCR primer for ORF amplification
aattacatgactcgagttatggcttttctaattcttgcaa

SEQ ID NO: 22630 - DNA, 40 bp, Artificial Sequence
  PCR primer for ORF amplification
aattacatgactcgagtcattccttctttctttcaccctt

SEQ ID NO: 22631 - DNA, 40 bp, Artificial Sequence
  PCR primer for ORF amplification
aattacatgactcgagttagtccgttggaaatgcgttact

SEQ ID NO: 22632 - DNA, 40 bp, Artificial Sequence
  PCR primer for ORF amplification
aattacatgactcgagctagtttaatacggcaactagttt

SEQ ID NO: 22633 - DNA, 40 bp, Artificial Sequence
  PCR primer for ORF amplification
aattacatgactcgagtcatttcggagaaactaggctagt

SEQ ID NO: 22634 - DNA, 40 bp, Artificial Sequence
  PCR primer for ORF amplification
aattacatgactcgagtcaactccaaacgctcatgtcagt

SEQ ID NO: 22635 - DNA, 40 bp, Artificial Sequence
  PCR primer for ORF amplification
aattacatgactcgagctacaagaagtaatcaacatgtct

SEQ ID NO: 22636 - DNA, 40 bp, Artificial Sequence
  PCR primer for ORF amplification
aattacatgactcgagctaatcttgacctcgttgctgcct

SEQ ID NO: 22637 - DNA, 40 bp, Artificial Sequence
  PCR primer for ORF amplification
aattacatgactcgagctattccatggtcttcattagttc

SEQ ID NO: 22638 - DNA, 40 bp, Artificial Sequence
  PCR primer for ORF amplification
aattacatgactcgagctatttcgcgaataaagaaactac

SEQ ID NO: 22639 - DNA, 40 bp, Artificial Sequence
  PCR primer for ORF amplification
aattacatgactcgagtcatttttttatttttttcttgcc

SEQ ID NO: 22640 - DNA, 40 bp, Artificial Sequence
  PCR primer for ORF amplification
aattacatgactcgagttacaattcgtccaaatatggcaa

SEQ ID NO: 22641 - DNA, 40 bp, Artificial Sequence
  PCR primer for ORF amplification
aattacatgactcgagtcatcttcgaagataaggggtatt

SEQ ID NO: 22642 - DNA, 40 bp, Artificial Sequence
  PCR primer for ORF amplification
aattacatgactcgagtcataaaaagtaatctggcgtctt

SEQ ID NO: 22643 - DNA, 40 bp, Artificial Sequence
  PCR primer for ORF amplification
aattacatgactcgagtcacctggcgtacatgtccgggaa

SEQ ID NO: 22644 - DNA, 40 bp, Artificial Sequence
  PCR primer for ORF amplification
aattacatgactcgagttatagaaacaaagtgtggccttc

SEQ ID NO: 22645 - DNA, 40 bp, Artificial Sequence
  PCR primer for ORF amplification
aattacatgactcgagttattttccatcttgaattaggca

SEQ ID NO: 22646 - DNA, 40 bp, Artificial Sequence
  PCR primer for ORF amplification
aattacatgactcgagtcactttttcaagatggtaacaac

SEQ ID NO: 22647 - DNA, 40 bp, Artificial Sequence
  PCR primer for ORF amplification
aattacatgactcgagttacttctccatcaagtctggaga

SEQ ID NO: 22648 - DNA, 40 bp, Artificial Sequence
  PCR primer for ORF amplification
aattacatgactcgagttataatctcttgatgactgcttc

SEQ ID NO: 22649 - DNA, 40 bp, Artificial Sequence
  PCR primer for ORF amplification
aattacatgactcgagttattccttgttttctgtgttttt

SEQ ID NO: 22650 - DNA, 40 bp, Artificial Sequence
  PCR primer for ORF amplification
aattacatgactcgagctataataatgaggtaacatgctg

SEQ ID NO: 22651 - DNA, 40 bp, Artificial Sequence
  PCR primer for ORF amplification
aattacatgactcgagttacttagacttcggatatagctt

SEQ ID NO: 22652 - DNA, 40 bp, Artificial Sequence
  PCR primer for ORF amplification
aattacatgactcgagttaggcatccaagataggtccttt

SEQ ID NO: 22653 - DNA, 40 bp, Artificial Sequence
  PCR primer for ORF amplification
aattacatgactcgagttacaacatgaattcaccgatacc

SEQ ID NO: 22654 - DNA, 40 bp, Artificial Sequence
  PCR primer for ORF amplification
aattacatgactcgagctatttcttgttaacttctcttct

SEQ ID NO: 22655 - DNA, 40 bp, Artificial Sequence
  PCR primer for ORF amplification
aattacatgactcgagctagattagaggcgtggccaggcg

SEQ ID NO: 22656 - DNA, 40 bp, Artificial Sequence
  PCR primer for ORF amplification
aattacatgactcgagttatgaagattctctttcaaattc

SEQ ID NO: 22657 - DNA, 40 bp, Artificial Sequence
  PCR primer for ORF amplification
aattacatgactcgagttataaaggacgaatatctggctt

SEQ ID NO: 22658 - DNA, 40 bp, Artificial Sequence
  PCR primer for ORF amplification
aattacatgactcgagctattttttcaaggcctttcttct

SEQ ID NO: 22659 - DNA, 40 bp, Artificial Sequence
  PCR primer for ORF amplification
aattacatgactcgagtcaggagaacatcttcgaaagaga

SEQ ID NO: 22660 - DNA, 40 bp, Artificial Sequence
  PCR primer for ORF amplification
aattacatgactcgagctacaagtcaatgcaaggctggtc

SEQ ID NO: 22661 - DNA, 40 bp, Artificial Sequence
  PCR primer for ORF amplification
aattacatgactcgagtcaaagcttgctcaaaaaagcccg

SEQ ID NO: 22662 - DNA, 40 bp, Artificial Sequence
  PCR primer for ORF amplification
aattacatgactcgagctataatctcgacaaaacgtcgtc

SEQ ID NO: 22663 - DNA, 40 bp, Artificial Sequence
  PCR primer for ORF amplification
aattacatgactcgagttaccattcaacgttgtctgcatt

SEQ ID NO: 22664 - DNA, 40 bp, Artificial Sequence
  PCR primer for ORF amplification
aattacatgactcgagttatttttcaatttgttcccttat

SEQ ID NO: 22665 - DNA, 40 bp, Artificial Sequence
  PCR primer for ORF amplification
aattacatgactcgagttatgcttgtaccaaaggctgatc

SEQ ID NO: 22666 - DNA, 40 bp, Artificial Sequence
  PCR primer for ORF amplification
aattacatgactcgagttaaataatttctctcaaaaagct

SEQ ID NO: 22667 - DNA, 40 bp, Artificial Sequence
  PCR primer for ORF amplification
aattacatgactcgagttaatcagaggatgactgtttttg

SEQ ID NO: 22668 - DNA, 40 bp, Artificial Sequence
  PCR primer for ORF amplification
aattacatgactcgagctacaagaatccaaacagtctcaa

SEQ ID NO: 22669 - DNA, 40 bp, Artificial Sequence
  PCR primer for ORF amplification
aattacatgactcgagttatttgctatttctctgtagagc

SEQ ID NO: 22670 - DNA, 40 bp, Artificial Sequence
  PCR primer for ORF amplification
aattacatgactcgagctacccatccacctttcgctcctt

SEQ ID NO: 22671 - DNA, 40 bp, Artificial Sequence
  PCR primer for ORF amplification
aattacatgactcgagttaaattaccatagtgctaatatt

SEQ ID NO: 22672 - DNA, 40 bp, Artificial Sequence
  PCR primer for ORF amplification
aattacatgactcgagctaatggacagattgcaattctga

SEQ ID NO: 22673 - DNA, 40 bp, Artificial Sequence
  PCR primer for ORF amplification
aattacatgactcgagctaagtaactaagtcctctagttc

SEQ ID NO: 22674 - DNA, 40 bp, Artificial Sequence
  PCR primer for ORF amplification
aattacatgactcgagctacaatcttgaagatcttttaac

SEQ ID NO: 22675 - DNA, 40 bp, Artificial Sequence
  PCR primer for ORF amplification
aattacatgactcgagctagaccaattcataagtatcata

SEQ ID NO: 22676 - DNA, 40 bp, Artificial Sequence
  PCR primer for ORF amplification
aattacatgactcgagttatgcaaacataaccccgtattg

SEQ ID NO: 22677 - DNA, 40 bp, Artificial Sequence
  PCR primer for ORF amplification
aattacatgactcgagttaaacatcgccgttcagtagtga

SEQ ID NO: 22678 - DNA, 40 bp, Artificial Sequence
  PCR primer for ORF amplification
aattacatgactcgagtcatgaggtttcttcgtttaatgt

SEQ ID NO: 22679 - DNA, 40 bp, Artificial Sequence
  PCR primer for ORF amplification
aattacatgactcgagttaccaagcggaccatgacccgag

SEQ ID NO: 22680 - DNA, 40 bp, Artificial Sequence
  PCR primer for ORF amplification
aattacatgactcgagttagtaagcaggatcactatcgtc

SEQ ID NO: 22681 - DNA, 40 bp, Artificial Sequence
  PCR primer for ORF amplification
aattacatgactcgagttatggtaacggctcatagttaca

SEQ ID NO: 22682 - DNA, 40 bp, Artificial Sequence
  PCR primer for ORF amplification
aattacatgactcgagtcaatattttgtcttcactgttcc

SEQ ID NO: 22683 - DNA, 40 bp, Artificial Sequence
  PCR primer for ORF amplification
aattacatgactcgagttaaccttgagatttatttatcga

SEQ ID NO: 22684 - DNA, 40 bp, Artificial Sequence
  PCR primer for ORF amplification
aattacatgactcgagttagtcaactctcacgacaacaac

SEQ ID NO: 22685 - DNA, 40 bp, Artificial Sequence
  PCR primer for ORF amplification
aattacatgactcgagctaacaaatcgggttagtcaatcc

SEQ ID NO: 22686 - DNA, 40 bp, Artificial Sequence
  PCR primer for ORF amplification
aattacatgactcgagctaacaaatcgggttggtcaatcc

SEQ ID NO: 22687 - DNA, 40 bp, Artificial Sequence
  PCR primer for ORF amplification
aattacatgactcgagctacaatttggaattatcaatcac

SEQ ID NO: 22688 - DNA, 40 bp, Artificial Sequence
  PCR primer for ORF amplification
aattacatgactcgagtcaattttctaccgtagggttggg

SEQ ID NO: 22689 - DNA, 40 bp, Artificial Sequence
  PCR primer for ORF amplification
aattacatgactcgagtcaagatctgtcgtacttaaatgc

SEQ ID NO: 22690 - DNA, 40 bp, Artificial Sequence
  PCR primer for ORF amplification
aattacatgactcgagtcatttaccaacattcactttaca

SEQ ID NO: 22691 - DNA, 40 bp, Artificial Sequence
  PCR primer for ORF amplification
aattacatgactcgagtcaacctaagccgttccatacaaa

SEQ ID NO: 22692 - DNA, 40 bp, Artificial Sequence
  PCR primer for ORF amplification
aattacatgactcgagctaatccagagatggcacaatcaa

SEQ ID NO: 22693 - DNA, 40 bp, Artificial Sequence
  PCR primer for ORF amplification
aattacatgactcgagttattcagcaactttcgtaggttt

SEQ ID NO: 22694 - DNA, 40 bp, Artificial Sequence
  PCR primer for ORF amplification
aattacatgactcgagttatttactagtatcgacgacgta

SEQ ID NO: 22695 - DNA, 40 bp, Artificial Sequence
  PCR primer for ORF amplification
aattacatgactcgagtcacataatactaagctgaaacaa

SEQ ID NO: 22696 - DNA, 40 bp, Artificial Sequence
  PCR primer for ORF amplification
aattacatgactcgagtcaggttaagtcggtaaattttgc

SEQ ID NO: 22697 - DNA, 40 bp, Artificial Sequence
  PCR primer for ORF amplification
aattacatgactcgagttaattggtatgttggttttgatt

SEQ ID NO: 22698 - DNA, 40 bp, Artificial Sequence
  PCR primer for ORF amplification
aattacatgactcgagtcaaacagcgcttgtatgttcatt

SEQ ID NO: 22699 - DNA, 40 bp, Artificial Sequence
  PCR primer for ORF amplification
aattacatgactcgagtcagttcaaatcagtaacaaccct

SEQ ID NO: 22700 - DNA, 40 bp, Artificial Sequence
  PCR primer for ORF amplification
aattacatgactcgagctaattgtcaaaagctatcctggc

SEQ ID NO: 22701 - DNA, 40 bp, Artificial Sequence
  PCR primer for ORF amplification
aattacatgactcgagttaagcccacttaccgatcaaagc

SEQ ID NO: 22702 - DNA, 40 bp, Artificial Sequence
  PCR primer for ORF amplification
aattacatgactcgagctagtttaatacggcaacgagttt

SEQ ID NO: 22703 - DNA, 40 bp, Artificial Sequence
  PCR primer for ORF amplification
aattacatgactcgagttaacttttagccttcttgacagc

SEQ ID NO: 22704 - DNA, 40 bp, Artificial Sequence
  PCR primer for ORF amplification
aattacatgactcgagttaatgaaccacggatctggagaa

SEQ ID NO: 22705 - DNA, 40 bp, Artificial Sequence
  PCR primer for ORF amplification
aattacatgactcgagttaacggacttgagcattagcaat

SEQ ID NO: 22706 - DNA, 40 bp, Artificial Sequence
  PCR primer for ORF amplification
aattacatgactcgagttatttcaagacggcaaccaactt

SEQ ID NO: 22707 - DNA, 40 bp, Artificial Sequence
  PCR primer for ORF amplification
aattacatgactcgagttatttcttctgtccataagctct

SEQ ID NO: 22708 - DNA, 40 bp, Artificial Sequence
  PCR primer for ORF amplification
aattacatgactcgagctaatctatttttgcttctttgat

SEQ ID NO: 22709 - DNA, 40 bp, Artificial Sequence
  PCR primer for ORF amplification
aattacatgactcgagttaggttgttcttttacgttcctt

SEQ ID NO: 22710 - DNA, 40 bp, Artificial Sequence
  PCR primer for ORF amplification
aattacatgactcgagtcaaaaacagcaccttttactaaa

SEQ ID NO: 22711 - DNA, 40 bp, Artificial Sequence
  PCR primer for ORF amplification
aattacatgactcgagttaataatttcgtggtgataattc

SEQ ID NO: 22712 - DNA, 40 bp, Artificial Sequence
  PCR primer for ORF amplification
aattacatgactcgagttagcttctattaatttttttctg

SEQ ID NO: 22713 - DNA, 40 bp, Artificial Sequence
  PCR primer for ORF amplification
aattacatgactcgagctacaactcatctttgagcatatt

SEQ ID NO: 22714 - DNA, 40 bp, Artificial Sequence
  PCR primer for ORF amplification
aattacatgactcgagctacgatagtagccttataacaat

SEQ ID NO: 22715 - DNA, 40 bp, Artificial Sequence
  PCR primer for ORF amplification
aattacatgactcgagttaagatgatgcagatctcgatgc

SEQ ID NO: 22716 - DNA, 40 bp, Artificial Sequence
  PCR primer for ORF amplification
aattacatgactcgagttataagaaataatccggtgtctt

SEQ ID NO: 22717 - DNA, 40 bp, Artificial Sequence
  PCR primer for ORF amplification
aattacatgactcgagctatcggatagctttatttgtttc

SEQ ID NO: 22718 - DNA, 40 bp, Artificial Sequence
  PCR primer for ORF amplification
aattacatgactcgagtcatggcggattaatgtgagctat

SEQ ID NO: 22719 - DNA, 40 bp, Artificial Sequence
  PCR primer for ORF amplification
aattacatgactcgagctagtctctatttcttccgggaac

SEQ ID NO: 22720 - DNA, 40 bp, Artificial Sequence
  PCR primer for ORF amplification
aattacatgactcgagctattttttgaataaaggttccat

SEQ ID NO: 22721 - DNA, 40 bp, Artificial Sequence
  PCR primer for ORF amplification
aattacatgactcgagtcaatcagcttcgtctggattgac

SEQ ID NO: 22722 - DNA, 40 bp, Artificial Sequence
  PCR primer for ORF amplification
aattacatgactcgagctattccatatcaacatccactcc

SEQ ID NO: 22723 - DNA, 40 bp, Artificial Sequence
  PCR primer for ORF amplification
aattacatgactcgagtcaggctgcatcctgcaattcttt

SEQ ID NO: 22724 - DNA, 40 bp, Artificial Sequence
  PCR primer for ORF amplification
aattacatgactcgagctacactaagagcacctcactgcg

SEQ ID NO: 22725 - DNA, 40 bp, Artificial Sequence
  PCR primer for ORF amplification
aattacatgactcgagctatttccgtggctcatagatata

SEQ ID NO: 22726 - DNA, 40 bp, Artificial Sequence
  PCR primer for ORF amplification
aattacatgactcgagttacgctaaggactcctcactgca

SEQ ID NO: 22727 - DNA, 40 bp, Artificial Sequence
  PCR primer for ORF amplification
aattacatgactcgagtcagtcctttctccagtcaccatt

SEQ ID NO: 22728 - DNA, 40 bp, Artificial Sequence
  PCR primer for ORF amplification
aattacatgactcgagctaccgggtcctgtacaatgttat

SEQ ID NO: 22729 - DNA, 40 bp, Artificial Sequence
  PCR primer for ORF amplification
aattacatgactcgagtcagaagcccattattttatgaat

SEQ ID NO: 22730 - DNA, 40 bp, Artificial Sequence
  PCR primer for ORF amplification
aattacatgactcgagtcaaactacacgggagaaatgctc

SEQ ID NO: 22731 - DNA, 40 bp, Artificial Sequence
  PCR primer for ORF amplification
aattacatgactcgagctaggcgccatagttatccgattt

SEQ ID NO: 22732 - DNA, 40 bp, Artificial Sequence
  PCR primer for ORF amplification
aattacatgactcgagtcaacgtttttgtttacaccagtc

SEQ ID NO: 22733 - DNA, 40 bp, Artificial Sequence
  PCR primer for ORF amplification
aattacatgactcgagctattttttcttgtgtctttctgt

SEQ ID NO: 22734 - DNA, 40 bp, Artificial Sequence
  PCR primer for ORF amplification
aattacatgactcgagttaccattctaaaacaaccatttt

SEQ ID NO: 22735 - DNA, 40 bp, Artificial Sequence
  PCR primer for ORF amplification
aattacatgactcgagttagaaatcttgaaagtattcagc

SEQ ID NO: 22736 - DNA, 40 bp, Artificial Sequence
  PCR primer for ORF amplification
aattacatgactcgagttacacatcattgcaagctgattg

SEQ ID NO: 22737 - DNA, 40 bp, Artificial Sequence
  PCR primer for ORF amplification
aattacatgactcgagtcaggtatcaggctttgggaatgc

SEQ ID NO: 22738 - DNA, 40 bp, Artificial Sequence
  PCR primer for ORF amplification
aattacatgactcgagctacctgctcgtgaccacggtctt

SEQ ID NO: 22739 - DNA, 40 bp, Artificial Sequence
  PCR primer for ORF amplification
aattacatgactcgagctacaaggagctcacactatctat

SEQ ID NO: 22740 - DNA, 40 bp, Artificial Sequence
  PCR primer for ORF amplification
aattacatgactcgagtcatactggacgtagcgcggctgc

SEQ ID NO: 22741 - DNA, 40 bp, Artificial Sequence; identical to SEQ ID NO: 22726
  PCR primer for ORF amplification

SEQ ID NO: 22742 - DNA, 40 bp, Artificial Sequence; identical to SEQ ID NO: 22726
  PCR primer for ORF amplification

SEQ ID NO: 22743 - DNA, 40 bp, Artificial Sequence
  PCR primer for ORF amplification
aattacatgactcgagctactttaggggcttctcattgcg

SEQ ID NO: 22744 - DNA, 40 bp, Artificial Sequence
  PCR primer for ORF amplification
aattacatgactcgagtcacccaccatagacgccagtgaa

SEQ ID NO: 22745 - DNA, 40 bp, Artificial Sequence
  PCR primer for ORF amplification
aattacatgactcgagttacttatttctagtaaagttggc

SEQ ID NO: 22746 - DNA, 40 bp, Artificial Sequence
  PCR primer for ORF amplification
aattacatgactcgagtcagttaccacccctcaacctcaa

SEQ ID NO: 22747 - DNA, 40 bp, Artificial Sequence
  PCR primer for ORF amplification
aattacatgactcgagttaccttttaagacgcaataaatc

SEQ ID NO: 22748 - DNA, 40 bp, Artificial Sequence
  PCR primer for ORF amplification
aattacatgactcgagtcacataattacacagtttttttt

SEQ ID NO: 22749 - DNA, 40 bp, Artificial Sequence
  PCR primer for ORF amplification
aattacatgactcgagctacgactgctcctctttgttatc

SEQ ID NO: 22750 - DNA, 40 bp, Artificial Sequence
  PCR primer for ORF amplification
aattacatgactcgagtcacgccttatttttatccaaatg

SEQ ID NO: 22751 - DNA, 40 bp, Artificial Sequence
  PCR primer for ORF amplification
aattacatgactcgagtcaatcatccttaccctttggttt

SEQ ID NO: 22752 - DNA, 40 bp, Artificial Sequence
  PCR primer for ORF amplification
aattacatgactcgagttatacgctattatcagccaaagt

SEQ ID NO: 22753 - DNA, 40 bp, Artificial Sequence
  PCR primer for ORF amplification
aattacatgactcgagttaaccatataaatcttttaagtg

SEQ ID NO: 22754 - DNA, 40 bp, Artificial Sequence
  PCR primer for ORF amplification
aattacatgactcgagttacgagctgttatttcccagtga

SEQ ID NO: 22755 - DNA, 40 bp, Artificial Sequence
  PCR primer for ORF amplification
aattacatgactcgagttacttcatttcaccgtgattgtt

SEQ ID NO: 22756 - DNA, 40 bp, Artificial Sequence
  PCR primer for ORF amplification
aattacatgactcgagttatatgaggttcaatggtaagtg

SEQ ID NO: 22757 - DNA, 40 bp, Artificial Sequence
  PCR primer for ORF amplification
aattacatgactcgagttaaactcttttgggaccgttgaa

SEQ ID NO: 22758 - DNA, 40 bp, Artificial Sequence
  PCR primer for ORF amplification
aattacatgactcgagtcacttcaaagtctctggaatatg

SEQ ID NO: 22759 - DNA, 40 bp, Artificial Sequence
  PCR primer for ORF amplification
aattacatgactcgagttagaacttcaaagtcttaggctt

SEQ ID NO: 22760 - DNA, 40 bp, Artificial Sequence
  PCR primer for ORF amplification
aattacatgactcgagtcatcttcttccctttgtgacttt

SEQ ID NO: 22761 - DNA, 40 bp, Artificial Sequence
  PCR primer for ORF amplification
aattacatgactcgagttaatattcataggctttcttgat

SEQ ID NO: 22762 - DNA, 40 bp, Artificial Sequence
  PCR primer for ORF amplification
aattacatgactcgagtcatttcttcattaaagactcttc

SEQ ID NO: 22763 - DNA, 40 bp, Artificial Sequence; identical to SEQ ID NO: 22762
  PCR primer for ORF amplification

SEQ ID NO: 22764 - DNA, 40 bp, Artificial Sequence
  PCR primer for ORF amplification
aattacatgactcgagttaagtttgcaggggctcgagctg

SEQ ID NO: 22765 - DNA, 40 bp, Artificial Sequence
  PCR primer for ORF amplification
aattacatgactcgagttattgagttgcttcttgggaagt

SEQ ID NO: 22766 - DNA, 40 bp, Artificial Sequence
  PCR primer for ORF amplification
aattacatgactcgagttataaactgaaaagaccagtttt

SEQ ID NO: 22767 - DNA, 40 bp, Artificial Sequence
  PCR primer for ORF amplification
aattacatgactcgagttacgtggcactatccgagtgtct

SEQ ID NO: 22768 - DNA, 40 bp, Artificial Sequence
  PCR primer for ORF amplification
aattacatgactcgagctacctatctaaaatacccttagt

SEQ ID NO: 22769 - DNA, 40 bp, Artificial Sequence
  PCR primer for ORF amplification
aattacatgactcgagtcatatactcgctagaagttttag

SEQ ID NO: 22770 - DNA, 40 bp, Artificial Sequence
  PCR primer for ORF amplification
aattacatgactcgagtcatagctcatcatgtgagacgat

SEQ ID NO: 22771 - DNA, 40 bp, Artificial Sequence
  PCR primer for ORF amplification
aattacatgactcgagttatttttccgtggatcgaagaat

SEQ ID NO: 22772 - DNA, 40 bp, Artificial Sequence
  PCR primer for ORF amplification
aattacatgactcgagttacaggatttttaatagtaaata

SEQ ID NO: 22773 - DNA, 40 bp, Artificial Sequence
  PCR primer for ORF amplification
aattacatgactcgagttacattaggttcgaataaacacg

SEQ ID NO: 22774 - DNA, 40 bp, Artificial Sequence
  PCR primer for ORF amplification
aattacatgactcgagttatatatctgtgggaaggggtac

SEQ ID NO: 22775 - DNA, 40 bp, Artificial Sequence
  PCR primer for ORF amplification
aattacatgactcgagttaaattgtataaatgacgatctt

SEQ ID NO: 22776 - DNA, 40 bp, Artificial Sequence
  PCR primer for ORF amplification
aattacatgactcgagttaaaattccaatttctttggttt

SEQ ID NO: 22777 - DNA, 40 bp, Artificial Sequence
  PCR primer for ORF amplification
aattacatgactcgagctatagatggctcgatgaggtctt

SEQ ID NO: 22778 - DNA, 40 bp, Artificial Sequence
  PCR primer for ORF amplification
aattacatgactcgagttattcatatttcattttggacaa

SEQ ID NO: 22779 - DNA, 40 bp, Artificial Sequence
  PCR primer for ORF amplification
aattacatgactcgagtcaatgccttctaggcttcttctt

SEQ ID NO: 22780 - DNA, 40 bp, Artificial Sequence
  PCR primer for ORF amplification
aattacatgactcgagctattgtcctgttgaaaaaatatt

SEQ ID NO: 22781 - DNA, 40 bp, Artificial Sequence
  PCR primer for ORF amplification
aattacatgactcgagtcactttttcctctgaagagctag

SEQ ID NO: 22782 - DNA, 40 bp, Artificial Sequence
  PCR primer for ORF amplification
aattacatgactcgagtcacacagatcttctttctaaggc

SEQ ID NO: 22783 - DNA, 40 bp, Artificial Sequence
  PCR primer for ORF amplification
aattacatgactcgagttagtttctaatatacttcgcgat

SEQ ID NO: 22784 - DNA, 40 bp, Artificial Sequence
  PCR primer for ORF amplification
aattacatgactcgagttattcgtttgttagctcgcttat

SEQ ID NO: 22785 - DNA, 40 bp, Artificial Sequence
  PCR primer for ORF amplification
aattacatgactcgagttatttggatgatttagaagatga

SEQ ID NO: 22786 - DNA, 40 bp, Artificial Sequence
  PCR primer for ORF amplification
aattacatgactcgagttattcattggccagcttatataa

SEQ ID NO: 22787 - DNA, 40 bp, Artificial Sequence
  PCR primer for ORF amplification
aattacatgactcgagtcaaccacggaaagcgttcggatc

SEQ ID NO: 22788 - DNA, 40 bp, Artificial Sequence
  PCR primer for ORF amplification
aattacatgactcgagtcacgataacggtgaggtgattcg

SEQ ID NO: 22789 - DNA, 40 bp, Artificial Sequence
  PCR primer for ORF amplification
aattacatgactcgagctagcttctcctcatcgattttag

SEQ ID NO: 22790 - DNA, 40 bp, Artificial Sequence
  PCR primer for ORF amplification
aattacatgactcgagctactcctcaccatcgtcttcatc

SEQ ID NO: 22791 - DNA, 40 bp, Artificial Sequence
  PCR primer for ORF amplification
aattacatgactcgagttattcattggatagaatacccca

SEQ ID NO: 22792 - DNA, 40 bp, Artificial Sequence
  PCR primer for ORF amplification
aattacatgactcgagttaatcacgccaggctgcgtatac

SEQ ID NO: 22793 - DNA, 40 bp, Artificial Sequence
  PCR primer for ORF amplification
aattacatgactcgagctagtgtgtacgcgtttcatcatc

SEQ ID NO: 22794 - DNA, 40 bp, Artificial Sequence
  PCR primer for ORF amplification
aattacatgactcgagctattttatttcatcagacttcaa

SEQ ID NO: 22795 - DNA, 40 bp, Artificial Sequence
  PCR primer for ORF amplification
aattacatgactcgagtcagtatttgtaggtttttatttc

SEQ ID NO: 22796 - DNA, 40 bp, Artificial Sequence
  PCR primer for ORF amplification
aattacatgactcgagctacttcttggtatcatcacgatg

SEQ ID NO: 22797 - DNA, 40 bp, Artificial Sequence
  PCR primer for ORF amplification
aattacatgactcgagctatttaattctctgtcttgggcc

SEQ ID NO: 22798 - DNA, 40 bp, Artificial Sequence
  PCR primer for ORF amplification
aattacatgactcgagttaaatgccgaatactctactata

SEQ ID NO: 22799 - DNA, 40 bp, Artificial Sequence
  PCR primer for ORF amplification
aattacatgactcgagttagtcagaatattcttcctctat

SEQ ID NO: 22800 - DNA, 40 bp, Artificial Sequence
  PCR primer for ORF amplification
aattacatgactcgagttacagtttttgtttagtcgtttt

SEQ ID NO: 22801 - DNA, 40 bp, Artificial Sequence
  PCR primer for ORF amplification
aattacatgactcgagtcatacaacctggaagatacaaaa

SEQ ID NO: 22802 - DNA, 40 bp, Artificial Sequence
  PCR primer for ORF amplification
aattacatgactcgagctaaactatccatgtttgcaagga

SEQ ID NO: 22803 - DNA, 40 bp, Artificial Sequence
  PCR primer for ORF amplification
aattacatgactcgagttatttcaaagattttctccactc

SEQ ID NO: 22804 - DNA, 40 bp, Artificial Sequence
  PCR primer for ORF amplification
aattacatgactcgagtcaattcttaacttttttgattgg

SEQ ID NO: 22805 - DNA, 40 bp, Artificial Sequence
  PCR primer for ORF amplification
aattacatgactcgagttacaagtccttcttcaaagtacc

SEQ ID NO: 22806 - DNA, 40 bp, Artificial Sequence
  PCR primer for ORF amplification
aattacatgactcgagtcacaattgaggaagagcttgcaa

SEQ ID NO: 22807 - DNA, 40 bp, Artificial Sequence
  PCR primer for ORF amplification
aattacatgactcgagttaatcttgggtcttttgagaacc

SEQ ID NO: 22808 - DNA, 40 bp, Artificial Sequence
  PCR primer for ORF amplification
aattacatgactcgagctataaagacgaggaggacaaatc

SEQ ID NO: 22809 - DNA, 40 bp, Artificial Sequence
  PCR primer for ORF amplification
aattacatgactcgagttaatctctgatcttggcataacc

SEQ ID NO: 22810 - DNA, 40 bp, Artificial Sequence
  PCR primer for ORF amplification
aattacatgactcgagttaatcacttgatagaatacccca

SEQ ID NO: 22811 - DNA, 40 bp, Artificial Sequence
  PCR primer for ORF amplification
aattacatgactcgagctagtatggtttgaaacgactttt

SEQ ID NO: 22812 - DNA, 40 bp, Artificial Sequence
  PCR primer for ORF amplification
aattacatgactcgagtcacaggtaatgataatctagtgc

SEQ ID NO: 22813 - DNA, 40 bp, Artificial Sequence
  PCR primer for ORF amplification
aattacatgactcgagttacatatatttccttgaatgctt

SEQ ID NO: 22814 - DNA, 40 bp, Artificial Sequence
  PCR primer for ORF amplification
aattacatgactcgagctaaacaacaacagtgccaggatc

SEQ ID NO: 22815 - DNA, 40 bp, Artificial Sequence
  PCR primer for ORF amplification
aattacatgactcgagttatatcaatgacgatgccatgaa

SEQ ID NO: 22816 - DNA, 40 bp, Artificial Sequence
  PCR primer for ORF amplification
aattacatgactcgagtcaagtcaatatgtaatcaacact

SEQ ID NO: 22817 - DNA, 40 bp, Artificial Sequence
  PCR primer for ORF amplification
aattacatgactcgagttatctggccacagtatgtttttt

SEQ ID NO: 22818 - DNA, 40 bp, Artificial Sequence
  PCR primer for ORF amplification
aattacatgactcgagctataaaatttccctcaatgttgt

SEQ ID NO: 22819 - DNA, 40 bp, Artificial Sequence
  PCR primer for ORF amplification
aattacatgactcgagctaatcttcatgtagatctaattc

SEQ ID NO: 22820 - DNA, 40 bp, Artificial Sequence
  PCR primer for ORF amplification
aattacatgactcgagctaattttgtttactggttttctt

SEQ ID NO: 22821 - DNA, 40 bp, Artificial Sequence
  PCR primer for ORF amplification
aattacatgactcgagtcattttacttcttcaacagagga

SEQ ID NO: 22822 - DNA, 40 bp, Artificial Sequence
  PCR primer for ORF amplification
aattacatgactcgagtcagcagacacagcatccaacatg

SEQ ID NO: 22823 - DNA, 40 bp, Artificial Sequence
  PCR primer for ORF amplification
aattacatgactcgagttatcttcttttataaatacaggg

SEQ ID NO: 22824 - DNA, 40 bp, Artificial Sequence
  PCR primer for ORF amplification
aattacatgactcgagttataaattgattatatacatcac

SEQ ID NO: 22825 - DNA, 40 bp, Artificial Sequence
  PCR primer for ORF amplification
aattacatgactcgagtcatttgtttatcagtgtaacaag

SEQ ID NO: 22826 - DNA, 40 bp, Artificial Sequence
  PCR primer for ORF amplification
aattacatgactcgagctatttcatggagaccaatttaac

SEQ ID NO: 22827 - DNA, 40 bp, Artificial Sequence
  PCR primer for ORF amplification
aattacatgactcgagttatgcgtgttgcaatttttgctt

SEQ ID NO: 22828 - DNA, 40 bp, Artificial Sequence
  PCR primer for ORF amplification
aattacatgactcgagtcatgttttttgctttttctcaac

SEQ ID NO: 22829 - DNA, 40 bp, Artificial Sequence
  PCR primer for ORF amplification
aattacatgactcgagttactgcagaagttggtctctgta

SEQ ID NO: 22830 - DNA, 40 bp, Artificial Sequence
  PCR primer for ORF amplification
aattacatgactcgagttaggagaaaaactttgatatatt

SEQ ID NO: 22831 - DNA, 40 bp, Artificial Sequence
  PCR primer for ORF amplification
aattacatgactcgagtcaagtagattcgtgattgccaaa

SEQ ID NO: 22832 - DNA, 40 bp, Artificial Sequence
  PCR primer for ORF amplification
aattacatgactcgagtcaacggtatcctcttgaaataag

SEQ ID NO: 22833 - DNA, 40 bp, Artificial Sequence
  PCR primer for ORF amplification
aattacatgactcgagtcaaccgatatggttttgccaacc

SEQ ID NO: 22834 - DNA, 40 bp, Artificial Sequence
  PCR primer for ORF amplification
aattacatgactcgagtcataaaatttctctcaatggaat

SEQ ID NO: 22835 - DNA, 40 bp, Artificial Sequence
  PCR primer for ORF amplification
aattacatgactcgagttacactaggcccctttctctttc

SEQ ID NO: 22836 - DNA, 40 bp, Artificial Sequence
  PCR primer for ORF amplification
aattacatgactcgagtcagttgtttgctgctggcacctc

SEQ ID NO: 22837 - DNA, 40 bp, Artificial Sequence
  PCR primer for ORF amplification
aattacatgactcgagctagtcctttttcgagctccagaa

SEQ ID NO: 22838 - DNA, 40 bp, Artificial Sequence
  PCR primer for ORF amplification
aattacatgactcgagttagatatttattacttcttctaa

SEQ ID NO: 22839 - DNA, 40 bp, Artificial Sequence
  PCR primer for ORF amplification
aattacatgactcgagttatgggaagaaaaatctcgtgta

SEQ ID NO: 22840 - DNA, 40 bp, Artificial Sequence
  PCR primer for ORF amplification
aattacatgactcgagttatctacgtagtctatctcttga

SEQ ID NO: 22841 - DNA, 40 bp, Artificial Sequence
  PCR primer for ORF amplification
aattacatgactcgagttagttcaagtcggcaacagtttt

SEQ ID NO: 22842 - DNA, 40 bp, Artificial Sequence
  PCR primer for ORF amplification
aattacatgactcgagttataatcttgcatctttgcctct

SEQ ID NO: 22843 - DNA, 40 bp, Artificial Sequence
  PCR primer for ORF amplification
aattacatgactcgagctaaacccagatggattggccacg

SEQ ID NO: 22844 - DNA, 40 bp, Artificial Sequence
  PCR primer for ORF amplification
aattacatgactcgagttatttactgaagtaagaaggagc

SEQ ID NO: 22845 - DNA, 40 bp, Artificial Sequence
  PCR primer for ORF amplification
aattacatgactcgagttagttggtggcttgtttcaaggc

SEQ ID NO: 22846 - DNA, 40 bp, Artificial Sequence
  PCR primer for ORF amplification
aattacatgactcgagctaggccacttcgacaatttcatc

SEQ ID NO: 22847 - DNA, 40 bp, Artificial Sequence
  PCR primer for ORF amplification
aattacatgactcgagtcaatcttttgaagagcaaagtga

SEQ ID NO: 22848 - DNA, 40 bp, Artificial Sequence
  PCR primer for ORF amplification
aattacatgactcgagttatgtgaacttcgaagtactttg

SEQ ID NO: 22849 - DNA, 40 bp, Artificial Sequence
  PCR primer for ORF amplification
aattacatgactcgagtcatttttcgttatttctggccaa

SEQ ID NO: 22850 - DNA, 40 bp, Artificial Sequence
  PCR primer for ORF amplification
aattacatgactcgagtcaattcttaccagcaccagctct

SEQ ID NO: 22851 - DNA, 40 bp, Artificial Sequence
  PCR primer for ORF amplification
aattacatgactcgagttaaatttgtgttaccttcaattt

SEQ ID NO: 22852 - DNA, 40 bp, Artificial Sequence
  PCR primer for ORF amplification
aattacatgactcgagttatatgttaaatcttgttgacaa

SEQ ID NO: 22853 - DNA, 40 bp, Artificial Sequence
  PCR primer for ORF amplification
aattacatgactcgagttacaatttggtttcctctagttt

SEQ ID NO: 22854 - DNA, 40 bp, Artificial Sequence
  PCR primer for ORF amplification
aattacatgactcgagttactttttggagagtagtgcagt

SEQ ID NO: 22855 - DNA, 40 bp, Artificial Sequence
  PCR primer for ORF amplification
aattacatgactcgagttactttgacaggaacgagactaa

SEQ ID NO: 22856 - DNA, 40 bp, Artificial Sequence
  PCR primer for ORF amplification
aattacatgactcgagttagttcaacaaggtagcaatgtc

SEQ ID NO: 22857 - DNA, 40 bp, Artificial Sequence
  PCR primer for ORF amplification
aattacatgactcgagttagttcaacaaagtagcgatgtc

SEQ ID NO: 22858 - DNA, 40 bp, Artificial Sequence
  PCR primer for ORF amplification
aattacatgactcgagttaccaatgtttaggttccatgcc

SEQ ID NO: 22859 - DNA, 40 bp, Artificial Sequence
  PCR primer for ORF amplification
aattacatgactcgagttatctatcatgtacttttcgagt

SEQ ID NO: 22860 - DNA, 40 bp, Artificial Sequence
  PCR primer for ORF amplification
aattacatgactcgagtcactctttgctatccaagacctg

SEQ ID NO: 22861 - DNA, 40 bp, Artificial Sequence
  PCR primer for ORF amplification
aattacatgactcgagtcaatggttctcttcctctatgtg

SEQ ID NO: 22862 - DNA, 40 bp, Artificial Sequence
  PCR primer for ORF amplification
aattacatgactcgagttatattttaggttttttggcatc

SEQ ID NO: 22863 - DNA, 40 bp, Artificial Sequence
  PCR primer for ORF amplification
aattacatgactcgagttaagcgtttttctcagcaaattc

SEQ ID NO: 22864 - DNA, 40 bp, Artificial Sequence
  PCR primer for ORF amplification
aattacatgactcgagttacttgtcgcccgcttcgttttt

SEQ ID NO: 22865 - DNA, 40 bp, Artificial Sequence
  PCR primer for ORF amplification
aattacatgactcgagttattggttttctggtctcaactt

SEQ ID NO: 22866 - DNA, 40 bp, Artificial Sequence
  PCR primer for ORF amplification
aattacatgactcgagtcacttgaatattgtcgcgaaaga

SEQ ID NO: 22867 - DNA, 40 bp, Artificial Sequence
  PCR primer for ORF amplification
aattacatgactcgagtcaatgattttttttcatcacaaa

SEQ ID NO: 22868 - DNA, 40 bp, Artificial Sequence
  PCR primer for ORF amplification
aattacatgactcgagttattcctttggtagaccagtctt

SEQ ID NO: 22869 - DNA, 40 bp, Artificial Sequence
  PCR primer for ORF amplification
aattacatgactcgagtcatattttcttctgcaatttcat

SEQ ID NO: 22870 - DNA, 40 bp, Artificial Sequence
  PCR primer for ORF amplification
aattacatgactcgagttattgtgtgtagaaataaccttg

SEQ ID NO: 22871 - DNA, 40 bp, Artificial Sequence
  PCR primer for ORF amplification
aattacatgactcgagtcaagtactatttaaaatcttgcc

SEQ ID NO: 22872 - DNA, 40 bp, Artificial Sequence
  PCR primer for ORF amplification
aattacatgactcgagtcagttgagcacatacttaccatc

SEQ ID NO: 22873 - DNA, 40 bp, Artificial Sequence
  PCR primer for ORF amplification
aattacatgactcgagttatttctgctccacctttggagt

SEQ ID NO: 22874 - DNA, 40 bp, Artificial Sequence
  PCR primer for ORF amplification
aattacatgactcgagttaattgttgccgttattattaga

SEQ ID NO: 22875 - DNA, 40 bp, Artificial Sequence
  PCR primer for ORF amplification
aattacatgactcgagtcaaatcaaaaccacttgcgtaaa

SEQ ID NO: 22876 - DNA, 40 bp, Artificial Sequence
  PCR primer for ORF amplification
aattacatgactcgagtcaaaaaataaaacaataaagttt

SEQ ID NO: 22877 - DNA, 40 bp, Artificial Sequence
  PCR primer for ORF amplification
aattacatgactcgagtcacaagaaatccatgttcagacc

SEQ ID NO: 22878 - DNA, 40 bp, Artificial Sequence
  PCR primer for ORF amplification
aattacatgactcgagctatatcgtcacatccaacacgct

SEQ ID NO: 22879 - DNA, 40 bp, Artificial Sequence
  PCR primer for ORF amplification
aattacatgactcgagtcaccatcttttcccgatcacttt

SEQ ID NO: 22880 - DNA, 40 bp, Artificial Sequence
  PCR primer for ORF amplification
aattacatgactcgagtcaagcaaatccgttgctttcaat

SEQ ID NO: 22881 - DNA, 40 bp, Artificial Sequence
  PCR primer for ORF amplification
aattacatgactcgagttatttaccgccagcttctctaaa

SEQ ID NO: 22882 - DNA, 40 bp, Artificial Sequence
  PCR primer for ORF amplification
aattacatgactcgagttagaagtcccggaaaagatcagc

SEQ ID NO: 22883 - DNA, 40 bp, Artificial Sequence
  PCR primer for ORF amplification
aattacatgactcgagtcactcttccaggtttgagtacgc

SEQ ID NO: 22884 - DNA, 40 bp, Artificial Sequence
  PCR primer for ORF amplification
aattacatgactcgagtcaaagtaggtcatccaaagcatc

SEQ ID NO: 22885 - DNA, 40 bp, Artificial Sequence
  PCR primer for ORF amplification
aattacatgactcgagttaaataaagtttaatttaacttt

SEQ ID NO: 22886 - DNA, 40 bp, Artificial Sequence
  PCR primer for ORF amplification
aattacatgactcgagtcatttgtattcaaaaattctggc

SEQ ID NO: 22887 - DNA, 40 bp, Artificial Sequence
  PCR primer for ORF amplification
aattacatgactcgagtcagtcggcatgatcgctgaatag

SEQ ID NO: 22888 - DNA, 40 bp, Artificial Sequence
  PCR primer for ORF amplification
aattacatgactcgagttaaaattctttcattaaatccat

SEQ ID NO: 22889 - DNA, 40 bp, Artificial Sequence
  PCR primer for ORF amplification
aattacatgactcgagctagtgtttgcacttaaaataatt

SEQ ID NO: 22890 - DNA, 40 bp, Artificial Sequence
  PCR primer for ORF amplification
aattacatgactcgagtcatatcttttcaatgacaataga

SEQ ID NO: 22891 - DNA, 40 bp, Artificial Sequence
  PCR primer for ORF amplification
aattacatgactcgagttaaatgtcaatttcttcagtttc

SEQ ID NO: 22892 - DNA, 40 bp, Artificial Sequence
  PCR primer for ORF amplification
aattacatgactcgagtcagattagtagcttcctaatacc

SEQ ID NO: 22893 - DNA, 40 bp, Artificial Sequence
  PCR primer for ORF amplification
aattacatgactcgagttagtcctctactttaacagaaat

SEQ ID NO: 22894 - DNA, 40 bp, Artificial Sequence
  PCR primer for ORF amplification
aattacatgactcgagttaaaagtcttcgttgaaggtgaa

SEQ ID NO: 22895 - DNA, 40 bp, Artificial Sequence
  PCR primer for ORF amplification
aattacatgactcgagctaaacttgcacggttgacatctt

SEQ ID NO: 22896 - DNA, 40 bp, Artificial Sequence
  PCR primer for ORF amplification
aattacatgactcgagttatgataattctgcaaaatttgc

SEQ ID NO: 22897 - DNA, 40 bp, Artificial Sequence
  PCR primer for ORF amplification
aattacatgactcgagttatcttgaatcaggtgaagttga

SEQ ID NO: 22898 - DNA, 40 bp, Artificial Sequence
  PCR primer for ORF amplification
aattacatgactcgagttaaaaccaacagaatttggtatt

SEQ ID NO: 22899 - DNA, 40 bp, Artificial Sequence
  PCR primer for ORF amplification
aattacatgactcgagctaaacgacatcttccatttctat

SEQ ID NO: 22900 - DNA, 40 bp, Artificial Sequence
  PCR primer for ORF amplification
aattacatgactcgagtcagttcttgttccaacctaaatc

SEQ ID NO: 22901 - DNA, 40 bp, Artificial Sequence
  PCR primer for ORF amplification
aattacatgactcgagttaatttttgtcccaaccgagttt

SEQ ID NO: 22902 - DNA, 40 bp, Artificial Sequence
  PCR primer for ORF amplification
aattacatgactcgagttatgattcattggtggggttcga

SEQ ID NO: 22903 - DNA, 40 bp, Artificial Sequence
  PCR primer for ORF amplification
aattacatgactcgagttacttcacatcatccgttctggt

SEQ ID NO: 22904 - DNA, 40 bp, Artificial Sequence
  PCR primer for ORF amplification
aattacatgactcgagttactgcttgtagtaatgtgtggg

SEQ ID NO: 22905 - DNA, 40 bp, Artificial Sequence
  PCR primer for ORF amplification
aattacatgactcgagctactcgtcttcttctctggggtc

SEQ ID NO: 22906 - DNA, 40 bp, Artificial Sequence
  PCR primer for ORF amplification
aattacatgactcgagttatgtattttgcacggttttgtg

SEQ ID NO: 22907 - DNA, 40 bp, Artificial Sequence
  PCR primer for ORF amplification
aattacatgactcgagttaaaaaaatataggaatatcctt

SEQ ID NO: 22908 - DNA, 40 bp, Artificial Sequence
  PCR primer for ORF amplification
aattacatgactcgagttagcttattatatccttgttcac

SEQ ID NO: 22909 - DNA, 40 bp, Artificial Sequence
  PCR primer for ORF amplification
aattacatgactcgagtcattctttgtttccaagaacttg

SEQ ID NO: 22910 - DNA, 40 bp, Artificial Sequence
  PCR primer for ORF amplification
aattacatgactcgagttaagccctctttacacctagtga

SEQ ID NO: 22911 - DNA, 40 bp, Artificial Sequence
  PCR primer for ORF amplification
aattacatgactcgagttacaggaaaactaacttttcact

SEQ ID NO: 22912 - DNA, 40 bp, Artificial Sequence
  PCR primer for ORF amplification
aattacatgactcgagtcacatacctaaagccactccttc

SEQ ID NO: 22913 - DNA, 40 bp, Artificial Sequence
  PCR primer for ORF amplification
aattacatgactcgagttaatcgtgcgtatccagtcgcca

SEQ ID NO: 22914 - DNA, 40 bp, Artificial Sequence
  PCR primer for ORF amplification
aattacatgactcgagtcacgtggagtgtagcaccgccaa

SEQ ID NO: 22915 - DNA, 40 bp, Artificial Sequence
  PCR primer for ORF amplification
aattacatgactcgagtcaaaaataattaccgcaattgtg

SEQ ID NO: 22916 - DNA, 40 bp, Artificial Sequence
  PCR primer for ORF amplification
aattacatgactcgagttagtctaagaatggtgaagtgat

SEQ ID NO: 22917 - DNA, 40 bp, Artificial Sequence
  PCR primer for ORF amplification
aattacatgactcgagtcattttttgttattaatgaagtt

SEQ ID NO: 22918 - DNA, 40 bp, Artificial Sequence
  PCR primer for ORF amplification
aattacatgactcgagctactcaggacgtattttcgcttt

SEQ ID NO: 22919 - DNA, 40 bp, Artificial Sequence
  PCR primer for ORF amplification
aattacatgactcgagttacacctgttcgatttttctttt

SEQ ID NO: 22920 - DNA, 40 bp, Artificial Sequence
  PCR primer for ORF amplification
aattacatgactcgagtcacttatttagagaaatagatac

SEQ ID NO: 22921 - DNA, 40 bp, Artificial Sequence
  PCR primer for ORF amplification
aattacatgactcgagtcagttgttctttttgttggaaac

SEQ ID NO: 22922 - DNA, 40 bp, Artificial Sequence
  PCR primer for ORF amplification
aattacatgactcgagttaaggtttggattcctcattcaa

SEQ ID NO: 22923 - DNA, 40 bp, Artificial Sequence
  PCR primer for ORF amplification
aattacatgactcgagttaattagattttttcaaatcatt

SEQ ID NO: 22924 - DNA, 40 bp, Artificial Sequence
  PCR primer for ORF amplification
aattacatgactcgagttagtcaaacttcactttcttacc

SEQ ID NO: 22925 - DNA, 40 bp, Artificial Sequence
  PCR primer for ORF amplification
aattacatgactcgagttaccactcgacgttgtcagcatt

SEQ ID NO: 22926 - DNA, 40 bp, Artificial Sequence
  PCR primer for ORF amplification
aattacatgactcgagctaccttaagtttgtccaagtgaa

SEQ ID NO: 22927 - DNA, 40 bp, Artificial Sequence
  PCR primer for ORF amplification
aattacatgactcgagtcaaagagagtcggctttaacgtg

SEQ ID NO: 22928 - DNA, 40 bp, Artificial Sequence
  PCR primer for ORF amplification
aattacatgactcgagctatgaatagttagagtaccacag

SEQ ID NO: 22929 - DNA, 40 bp, Artificial Sequence
  PCR primer for ORF amplification
aattacatgactcgagttatttttcccacttgttttgact

SEQ ID NO: 22930 - DNA, 40 bp, Artificial Sequence
  PCR primer for ORF amplification
aattacatgactcgagttattttccgtcaattttcaatct

SEQ ID NO: 22931 - DNA, 40 bp, Artificial Sequence
  PCR primer for ORF amplification
aattacatgactcgagttaactattgtccaattgtgccca

SEQ ID NO: 22932 - DNA, 40 bp, Artificial Sequence
  PCR primer for ORF amplification
aattacatgactcgagttaatttctattgttccatatata

SEQ ID NO: 22933 - DNA, 40 bp, Artificial Sequence
  PCR primer for ORF amplification
aattacatgactcgagttactgaaatcttgttctttgctt

SEQ ID NO: 22934 - DNA, 40 bp, Artificial Sequence
  PCR primer for ORF amplification
aattacatgactcgagttagtccttgctatccacgttgtc

SEQ ID NO: 22935 - DNA, 40 bp, Artificial Sequence
  PCR primer for ORF amplification
aattacatgactcgagttaaattcctggtggaagcttgta

SEQ ID NO: 22936 - DNA, 40 bp, Artificial Sequence
  PCR primer for ORF amplification
aattacatgactcgagctatttcttaattttcccaccggc

SEQ ID NO: 22937 - DNA, 40 bp, Artificial Sequence
  PCR primer for ORF amplification
aattacatgactcgagtcacttgaacagcttggcgacaga

SEQ ID NO: 22938 - DNA, 40 bp, Artificial Sequence
  PCR primer for ORF amplification
aattacatgactcgagtcaagtcatgaatttagagataaa

SEQ ID NO: 22939 - DNA, 40 bp, Artificial Sequence
  PCR primer for ORF amplification
aattacatgactcgagtcactgggcccactggtggaagtc

SEQ ID NO: 22940 - DNA, 40 bp, Artificial Sequence
  PCR primer for ORF amplification
aattacatgactcgagtcagtagcggttctggttgccgtt

SEQ ID NO: 22941 - DNA, 40 bp, Artificial Sequence
  PCR primer for ORF amplification
aattacatgactcgagctatagcgttaccgcctgtgcctg

SEQ ID NO: 22942 - DNA, 40 bp, Artificial Sequence
  PCR primer for ORF amplification
aattacatgactcgagctattcgtcgtcttcttcatcatc

SEQ ID NO: 22943 - DNA, 40 bp, Artificial Sequence
  PCR primer for ORF amplification
aattacatgactcgagtcaaattgctttggccaaaccaac

SEQ ID NO: 22944 - DNA, 40 bp, Artificial Sequence
  PCR primer for ORF amplification
aattacatgactcgagttagttatgagtgaatttttcggc

SEQ ID NO: 22945 - DNA, 40 bp, Artificial Sequence
  PCR primer for ORF amplification
aattacatgactcgagttacatcagtaatcctgccggtcc

SEQ ID NO: 22946 - DNA, 40 bp, Artificial Sequence
  PCR primer for ORF amplification
aattacatgactcgagctagtgtatatcttcttcggtctt

SEQ ID NO: 22947 - DNA, 40 bp, Artificial Sequence
  PCR primer for ORF amplification
aattacatgactcgagttaatcttggaatttgtatgaacc

SEQ ID NO: 22948 - DNA, 40 bp, Artificial Sequence
  PCR primer for ORF amplification
aattacatgactcgagttattcatcgtcactgtctcctag

SEQ ID NO: 22949 - DNA, 40 bp, Artificial Sequence
  PCR primer for ORF amplification
aattacatgactcgagttaaccttcactatcataaattat

SEQ ID NO: 22950 - DNA, 40 bp, Artificial Sequence
  PCR primer for ORF amplification
aattacatgactcgagtcattttaaatgggatttttttac

SEQ ID NO: 22951 - DNA, 40 bp, Artificial Sequence
  PCR primer for ORF amplification
aattacatgactcgagtcatagctggtccgttctccaacc

SEQ ID NO: 22952 - DNA, 40 bp, Artificial Sequence
  PCR primer for ORF amplification
aattacatgactcgagctacacgggaggcgcctgtttgcg

SEQ ID NO: 22953 - DNA, 40 bp, Artificial Sequence
  PCR primer for ORF amplification
aattacatgactcgagctaatcatcttttctactcttgtt

SEQ ID NO: 22954 - DNA, 40 bp, Artificial Sequence
  PCR primer for ORF amplification
aattacatgactcgagttaaaaggggtcgctactaagtat

SEQ ID NO: 22955 - DNA, 40 bp, Artificial Sequence
  PCR primer for ORF amplification
aattacatgactcgagtcaattgataaatgtactttcaat

SEQ ID NO: 22956 - DNA, 40 bp, Artificial Sequence
  PCR primer for ORF amplification
aattacatgactcgagctatttgatttcagtttcagctaa

SEQ ID NO: 22957 - DNA, 40 bp, Artificial Sequence
  PCR primer for ORF amplification
aattacatgactcgagttaatgttgttgcataaaattttc

SEQ ID NO: 22958 - DNA, 40 bp, Artificial Sequence
  PCR primer for ORF amplification
aattacatgactcgagtcagtgctttttactagttttcaa

SEQ ID NO: 22959 - DNA, 40 bp, Artificial Sequence
  PCR primer for ORF amplification
aattacatgactcgagttattccatcctacaccaaggtct

SEQ ID NO: 22960 - DNA, 40 bp, Artificial Sequence
  PCR primer for ORF amplification
aattacatgactcgagtcaaaaggaaagtaaatcgatttc

SEQ ID NO: 22961 - DNA, 40 bp, Artificial Sequence
  PCR primer for ORF amplification
aattacatgactcgagtcacgttctcgattcccactgaac

SEQ ID NO: 22962 - DNA, 40 bp, Artificial Sequence
  PCR primer for ORF amplification
aattacatgactcgagtcaaacttttagagaaccattgta

SEQ ID NO: 22963 - DNA, 40 bp, Artificial Sequence
  PCR primer for ORF amplification
aattacatgactcgagtcagaaatctaaagaagccggttc

SEQ ID NO: 22964 - DNA, 40 bp, Artificial Sequence
  PCR primer for ORF amplification
aattacatgactcgagttaatttgcaagcttacttaacaa

SEQ ID NO: 22965 - DNA, 40 bp, Artificial Sequence
  PCR primer for ORF amplification
aattacatgactcgagctacaggagctgtctaaccagagc

SEQ ID NO: 22966 - DNA, 40 bp, Artificial Sequence
  PCR primer for ORF amplification
aattacatgactcgagttatgctatatttaagagggaaaa

SEQ ID NO: 22967 - DNA, 40 bp, Artificial Sequence
  PCR primer for ORF amplification
aattacatgactcgagtcattgagatgcacattgaacacc

SEQ ID NO: 22968 - DNA, 40 bp, Artificial Sequence
  PCR primer for ORF amplification
aattacatgactcgagttagctgagccttggaggtggtct

SEQ ID NO: 22969 - DNA, 40 bp, Artificial Sequence
  PCR primer for ORF amplification
aattacatgactcgagttatgtgtaactgtcaatattctc

SEQ ID NO: 22970 - DNA, 40 bp, Artificial Sequence
  PCR primer for ORF amplification
aattacatgactcgagctaaggctgcgttctagaagggct

SEQ ID NO: 22971 - DNA, 40 bp, Artificial Sequence
  PCR primer for ORF amplification
aattacatgactcgagttatttatgcttcttgtttaatct

SEQ ID NO: 22972 - DNA, 40 bp, Artificial Sequence
  PCR primer for ORF amplification
aattacatgactcgagtcaaaatgattctaactcccttac

SEQ ID NO: 22973 - DNA, 40 bp, Artificial Sequence
  PCR primer for ORF amplification
aattacatgactcgagttagttagcagtcataacttgcca

SEQ ID NO: 22974 - DNA, 40 bp, Artificial Sequence
  PCR primer for ORF amplification
aattacatgactcgagctaatggtggtatttaccttcccc

SEQ ID NO: 22975 - DNA, 40 bp, Artificial Sequence
  PCR primer for ORF amplification
aattacatgactcgagttatatctcctcaataatagagtt

SEQ ID NO: 22976 - DNA, 40 bp, Artificial Sequence
  PCR primer for ORF amplification
aattacatgactcgagttattcacacttttccttagattc

SEQ ID NO: 22977 - DNA, 40 bp, Artificial Sequence
  PCR primer for ORF amplification
aattacatgactcgagttatgctgatcttggagcgatctt

SEQ ID NO: 22978 - DNA, 40 bp, Artificial Sequence
  PCR primer for ORF amplification
aattacatgactcgagttaattagtgtacaggtcataggt

SEQ ID NO: 22979 - DNA, 40 bp, Artificial Sequence
  PCR primer for ORF amplification
aattacatgactcgagttacatctcgtcgtcactattgat

SEQ ID NO: 22980 - DNA, 40 bp, Artificial Sequence
  PCR primer for ORF amplification
aattacatgactcgagttagaccaacgacttggagtaaga

SEQ ID NO: 22981 - DNA, 40 bp, Artificial Sequence
  PCR primer for ORF amplification
aattacatgactcgagtcataaactatttccaatagagtc

SEQ ID NO: 22982 - DNA, 40 bp, Artificial Sequence
  PCR primer for ORF amplification
aattacatgactcgagttagaacaacactctttccttggc

SEQ ID NO: 22983 - DNA, 40 bp, Artificial Sequence
  PCR primer for ORF amplification
aattacatgactcgagctagaaaaggctttccagttgaaa

SEQ ID NO: 22984 - DNA, 40 bp, Artificial Sequence
  PCR primer for ORF amplification
aattacatgactcgagctagtttttcatagaaaccaattt

SEQ ID NO: 22985 - DNA, 40 bp, Artificial Sequence
  PCR primer for ORF amplification
aattacatgactcgagctaactatctgattgttctttctt

SEQ ID NO: 22986 - DNA, 40 bp, Artificial Sequence
  PCR primer for ORF amplification
aattacatgactcgagttatatttcttcccaagtaaatgg

SEQ ID NO: 22987 - DNA, 40 bp, Artificial Sequence
  PCR primer for ORF amplification
aattacatgactcgagttacaatgcagctgcctcgaactc

SEQ ID NO: 22988 - DNA, 40 bp, Artificial Sequence
  PCR primer for ORF amplification
aattacatgactcgagttatttacaagttagaatattatc

SEQ ID NO: 22989 - DNA, 40 bp, Artificial Sequence
  PCR primer for ORF amplification
aattacatgactcgagtcagccttgtaagaaattgtccag

SEQ ID NO: 22990 - DNA, 40 bp, Artificial Sequence
  PCR primer for ORF amplification
aattacatgactcgagttaagcaaacgtgatacgtggatg

SEQ ID NO: 22991 - DNA, 40 bp, Artificial Sequence
  PCR primer for ORF amplification
aattacatgactcgagtcaaatatccaaagttaatgaaga

SEQ ID NO: 22992 - DNA, 40 bp, Artificial Sequence
  PCR primer for ORF amplification
aattacatgactcgagctatttcttcaacagttcgtgaac

SEQ ID NO: 22993 - DNA, 40 bp, Artificial Sequence
  PCR primer for ORF amplification
aattacatgactcgagttaacagtctatcaaatcgatagc

SEQ ID NO: 22994 - DNA, 40 bp, Artificial Sequence
  PCR primer for ORF amplification
aattacatgactcgagttacaaatggaagaggcgtcgttt

SEQ ID NO: 22995 - DNA, 40 bp, Artificial Sequence
  PCR primer for ORF amplification
aattacatgactcgagtcaattacgtgaccagctatacat

SEQ ID NO: 22996 - DNA, 40 bp, Artificial Sequence
  PCR primer for ORF amplification
aattacatgactcgagttataagtacttcgtaaaattcga

SEQ ID NO: 22997 - DNA, 40 bp, Artificial Sequence
  PCR primer for ORF amplification
aattacatgactcgagttagaggggcgaccttcttttacg

SEQ ID NO: 22998 - DNA, 40 bp, Artificial Sequence
  PCR primer for ORF amplification
aattacatgactcgagtcagttactctccaataattcttt

SEQ ID NO: 22999 - DNA, 40 bp, Artificial Sequence
  PCR primer for ORF amplification
aattacatgactcgagttatttagaatcggataggtcaaa

SEQ ID NO: 23000 - DNA, 40 bp, Artificial Sequence
  PCR primer for ORF amplification
aattacatgactcgagtcacacaatcatatcaatttgata

SEQ ID NO: 23001 - DNA, 40 bp, Artificial Sequence
  PCR primer for ORF amplification
aattacatgactcgagttactttgtagcatctagatcatc

SEQ ID NO: 23002 - DNA, 40 bp, Artificial Sequence
  PCR primer for ORF amplification
aattacatgactcgagttaatcaaatgttttctttgaacc

SEQ ID NO: 23003 - DNA, 40 bp, Artificial Sequence
  PCR primer for ORF amplification
aattacatgactcgagctatttcatattccatgacaaact

SEQ ID NO: 23004 - DNA, 40 bp, Artificial Sequence
  PCR primer for ORF amplification
aattacatgactcgagttatttcatgtttcttttcttcaa

SEQ ID NO: 23005 - DNA, 40 bp, Artificial Sequence
  PCR primer for ORF amplification
aattacatgactcgagttacctggttggtgatctttcacg

SEQ ID NO: 23006 - DNA, 40 bp, Artificial Sequence
  PCR primer for ORF amplification
aattacatgactcgagttaatcattatcagtctgtctctt

SEQ ID NO: 23007 - DNA, 40 bp, Artificial Sequence
  PCR primer for ORF amplification
aattacatgactcgagctactggctcttcttgccccagat

SEQ ID NO: 23008 - DNA, 40 bp, Artificial Sequence
  PCR primer for ORF amplification
aattacatgactcgagctagagttcttcccaagtcagggc

SEQ ID NO: 23009 - DNA, 40 bp, Artificial Sequence
  PCR primer for ORF amplification
aattacatgactcgagtcaactaatgaaggtgctctcaac

SEQ ID NO: 23010 - DNA, 40 bp, Artificial Sequence
  PCR primer for ORF amplification
aattacatgactcgagttacgaggactctatgggcgtata

SEQ ID NO: 23011 - DNA, 40 bp, Artificial Sequence
  PCR primer for ORF amplification
aattacatgactcgagtcattcttcctgtttgattttcgc

SEQ ID NO: 23012 - DNA, 40 bp, Artificial Sequence
  PCR primer for ORF amplification
aattacatgactcgagctaacgtcttggacctcttcctct

SEQ ID NO: 23013 - DNA, 40 bp, Artificial Sequence
  PCR primer for ORF amplification
aattacatgactcgagttattttaagaccttaccgtcaac

SEQ ID NO: 23014 - DNA, 40 bp, Artificial Sequence
  PCR primer for ORF amplification
aattacatgactcgagttaatattttgatattaaggctgg

SEQ ID NO: 23015 - DNA, 40 bp, Artificial Sequence
  PCR primer for ORF amplification
aattacatgactcgagttattttttacttaatttcatcca

SEQ ID NO: 23016 - DNA, 40 bp, Artificial Sequence
  PCR primer for ORF amplification
aattacatgactcgagttaatgtcttgtaggatcattgag

SEQ ID NO: 23017 - DNA, 40 bp, Artificial Sequence
  PCR primer for ORF amplification
aattacatgactcgagttattcccgttttactgatctttt

SEQ ID NO: 23018 - DNA, 40 bp, Artificial Sequence
  PCR primer for ORF amplification
aattacatgactcgagtcaatctactaggcgaacacctaa

SEQ ID NO: 23019 - DNA, 40 bp, Artificial Sequence
  PCR primer for ORF amplification
aattacatgactcgagttatttcttttcggataagaaagc

SEQ ID NO: 23020 - DNA, 40 bp, Artificial Sequence
  PCR primer for ORF amplification
aattacatgactcgagctaaggattcttcacgttgtaatt

SEQ ID NO: 23021 - DNA, 40 bp, Artificial Sequence
  PCR primer for ORF amplification
aattacatgactcgagttaaggattacttaagttatacaa

SEQ ID NO: 23022 - DNA, 40 bp, Artificial Sequence
  PCR primer for ORF amplification
aattacatgactcgagtcatgtgtgacgcagtttagcctc

SEQ ID NO: 23023 - DNA, 40 bp, Artificial Sequence
  PCR primer for ORF amplification
aattacatgactcgagttatgaagtggtggcatcgcttag

SEQ ID NO: 23024 - DNA, 40 bp, Artificial Sequence
  PCR primer for ORF amplification
aattacatgactcgagctatgcatgggtgtcattattatt

SEQ ID NO: 23025 - DNA, 40 bp, Artificial Sequence
  PCR primer for ORF amplification
aattacatgactcgagttactgttgccttaattgagtaat

SEQ ID NO: 23026 - DNA, 40 bp, Artificial Sequence
  PCR primer for ORF amplification
aattacatgactcgagctattgcaatggtgtatacagtat

SEQ ID NO: 23027 - DNA, 40 bp, Artificial Sequence
  PCR primer for ORF amplification
aattacatgactcgagctaatgtgtcttttcattagtgag

SEQ ID NO: 23028 - DNA, 40 bp, Artificial Sequence
  PCR primer for ORF amplification
aattacatgactcgagttatgactgcttgcattcaggagc

SEQ ID NO: 23029 - DNA, 40 bp, Artificial Sequence
  PCR primer for ORF amplification
aattacatgactcgagctaaacgcaacaaattgattgatt

SEQ ID NO: 23030 - DNA, 40 bp, Artificial Sequence
  PCR primer for ORF amplification
aattacatgactcgagctattctttaataaagatggcggc

SEQ ID NO: 23031 - DNA, 40 bp, Artificial Sequence
  PCR primer for ORF amplification
aattacatgactcgagttaacaagccattgatgacctact

SEQ ID NO: 23032 - DNA, 40 bp, Artificial Sequence
  PCR primer for ORF amplification
aattacatgactcgagttagttcctctggaatatatcgct

SEQ ID NO: 23033 - DNA, 40 bp, Artificial Sequence
  PCR primer for ORF amplification
aattacatgactcgagttacccaactatcttcaattctgc

SEQ ID NO: 23034 - DNA, 40 bp, Artificial Sequence
  PCR primer for ORF amplification
aattacatgactcgagtcaaatatcctttttcgttggagt

SEQ ID NO: 23035 - DNA, 40 bp, Artificial Sequence
  PCR primer for ORF amplification
aattacatgactcgagttacaatttagcttcaatagtata

SEQ ID NO: 23036 - DNA, 40 bp, Artificial Sequence
  PCR primer for ORF amplification
aattacatgactcgagttactctccaaatatcttacaggt

SEQ ID NO: 23037 - DNA, 40 bp, Artificial Sequence
  PCR primer for ORF amplification
aattacatgactcgagctaattgcgaacgatttgcctata

SEQ ID NO: 23038 - DNA, 40 bp, Artificial Sequence
  PCR primer for ORF amplification
aattacatgactcgagttagttgtatagaacaaacttagc

SEQ ID NO: 23039 - DNA, 40 bp, Artificial Sequence
  PCR primer for ORF amplification
aattacatgactcgagttatagtttgcacatacctttctt

SEQ ID NO: 23040 - DNA, 40 bp, Artificial Sequence
  PCR primer for ORF amplification
aattacatgactcgagtcatagcatatctggtggatcgtc

SEQ ID NO: 23041 - DNA, 40 bp, Artificial Sequence
  PCR primer for ORF amplification
aattacatgactcgagttaatccctagaggcaaaaccttg

SEQ ID NO: 23042 - DNA, 40 bp, Artificial Sequence
  PCR primer for ORF amplification
aattacatgactcgagtcaaaggtcgccaagaccagatat

SEQ ID NO: 23043 - DNA, 40 bp, Artificial Sequence
  PCR primer for ORF amplification
aattacatgactcgagttacaaagtcaactcttcaccttt

SEQ ID NO: 23044 - DNA, 40 bp, Artificial Sequence
  PCR primer for ORF amplification
aattacatgactcgagctacatgcccgtaactagtgcttg

SEQ ID NO: 23045 - DNA, 40 bp, Artificial Sequence
  PCR primer for ORF amplification
aattacatgactcgagtcaatcagtgagtttgtcatcaat

SEQ ID NO: 23046 - DNA, 40 bp, Artificial Sequence
  PCR primer for ORF amplification
aattacatgactcgagttactcttttagggtgtattcagt

SEQ ID NO: 23047 - DNA, 40 bp, Artificial Sequence
  PCR primer for ORF amplification
aattacatgactcgagtcagtagtcatcacctttcgaaac

SEQ ID NO: 23048 - DNA, 40 bp, Artificial Sequence
  PCR primer for ORF amplification
aattacatgactcgagctatgagaactcaaaaagtaactg

SEQ ID NO: 23049 - DNA, 40 bp, Artificial Sequence
  PCR primer for ORF amplification
aattacatgactcgagtcagagttcatctctgaaattttt

SEQ ID NO: 23050 - DNA, 40 bp, Artificial Sequence
  PCR primer for ORF amplification
aattacatgactcgagctatgtttctatatccgtttccga

SEQ ID NO: 23051 - DNA, 40 bp, Artificial Sequence
  PCR primer for ORF amplification
aattacatgactcgagtcaaagcataacaaaacgaacctt

SEQ ID NO: 23052 - DNA, 40 bp, Artificial Sequence
  PCR primer for ORF amplification
aattacatgactcgagttatgtcagcttggagcgcttgat

SEQ ID NO: 23053 - DNA, 40 bp, Artificial Sequence
  PCR primer for ORF amplification
aattacatgactcgagctactgtagggattcttcttgatc

SEQ ID NO: 23054 - DNA, 40 bp, Artificial Sequence
  PCR primer for ORF amplification
aattacatgactcgagtcacgaatgtccaacaaggtttcc

SEQ ID NO: 23055 - DNA, 40 bp, Artificial Sequence
  PCR primer for ORF amplification
aattacatgactcgagctattttgaccgtttccaagaact

SEQ ID NO: 23056 - DNA, 40 bp, Artificial Sequence
  PCR primer for ORF amplification
aattacatgactcgagttagatttgaggtgtgactactat

SEQ ID NO: 23057 - DNA, 40 bp, Artificial Sequence
  PCR primer for ORF amplification
aattacatgactcgagctaagatttcttgattttctggta

SEQ ID NO: 23058 - DNA, 40 bp, Artificial Sequence
  PCR primer for ORF amplification
aattacatgactcgagctatgcccatttccctagaagagc

SEQ ID NO: 23059 - DNA, 40 bp, Artificial Sequence
  PCR primer for ORF amplification
aattacatgactcgagttatttttttgagttgaatctact

SEQ ID NO: 23060 - DNA, 40 bp, Artificial Sequence
  PCR primer for ORF amplification
aattacatgactcgagtcaaaattgcggagggaaagcgat

SEQ ID NO: 23061 - DNA, 40 bp, Artificial Sequence
  PCR primer for ORF amplification
aattacatgactcgagctatagactatcgtctactttttc

SEQ ID NO: 23062 - DNA, 40 bp, Artificial Sequence
  PCR primer for ORF amplification
aattacatgactcgagttaagctttcacgtccttcttttt

SEQ ID NO: 23063 - DNA, 40 bp, Artificial Sequence
  PCR primer for ORF amplification
aattacatgactcgagttatatgcgtctatttatgtagga

SEQ ID NO: 23064 - DNA, 40 bp, Artificial Sequence
  PCR primer for ORF amplification
aattacatgactcgagctatttcctagtgcagaataactt

SEQ ID NO: 23065 - DNA, 40 bp, Artificial Sequence
  PCR primer for ORF amplification
aattacatgactcgagtcatttgctatggggaaagggctc

SEQ ID NO: 23066 - DNA, 40 bp, Artificial Sequence
  PCR primer for ORF amplification
aattacatgactcgagctattgaatatctttcgtagctac

SEQ ID NO: 23067 - DNA, 40 bp, Artificial Sequence
  PCR primer for ORF amplification
aattacatgactcgagttaaaacagcagttctgtattcaa

SEQ ID NO: 23068 - DNA, 40 bp, Artificial Sequence
  PCR primer for ORF amplification
aattacatgactcgagctattgataacctggagaccatat

SEQ ID NO: 23069 - DNA, 40 bp, Artificial Sequence
  PCR primer for ORF amplification
aattacatgactcgagtcatgcccatctttgcacgacaac

SEQ ID NO: 23070 - DNA, 40 bp, Artificial Sequence
  PCR primer for ORF amplification
aattacatgactcgagttagaccttattttgatggggagc

SEQ ID NO: 23071 - DNA, 40 bp, Artificial Sequence
  PCR primer for ORF amplification
aattacatgactcgagttaagcgtaaaccgcttcaatagc

SEQ ID NO: 23072 - DNA, 40 bp, Artificial Sequence
  PCR primer for ORF amplification
aattacatgactcgagctaaatttcttttggatgtttaat

SEQ ID NO: 23073 - DNA, 40 bp, Artificial Sequence
  PCR primer for ORF amplification
aattacatgactcgagtcagttcgctgattgtttcttctt

SEQ ID NO: 23074 - DNA, 40 bp, Artificial Sequence
  PCR primer for ORF amplification
aattacatgactcgagtcaggattgcataaactcaagaat

SEQ ID NO: 23075 - DNA, 40 bp, Artificial Sequence
  PCR primer for ORF amplification
aattacatgactcgagttataacagatcgatacacttggc

SEQ ID NO: 23076 - DNA, 40 bp, Artificial Sequence
  PCR primer for ORF amplification
aattacatgactcgagctactctagtatatagtttcctag

SEQ ID NO: 23077 - DNA, 40 bp, Artificial Sequence
  PCR primer for ORF amplification
aattacatgactcgagttagattatatattcttttctaaa

SEQ ID NO: 23078 - DNA, 40 bp, Artificial Sequence
  PCR primer for ORF amplification
aattacatgactcgagctattcaatcgcatgtttcggagt

SEQ ID NO: 23079 - DNA, 40 bp, Artificial Sequence
  PCR primer for ORF amplification
aattacatgactcgagctatgaatcgtgtttgaggaagta

SEQ ID NO: 23080 - DNA, 40 bp, Artificial Sequence
  PCR primer for ORF amplification
aattacatgactcgagttattttttatttcgtagcctgct

SEQ ID NO: 23081 - DNA, 40 bp, Artificial Sequence
  PCR primer for ORF amplification
aattacatgactcgagctaggattgggccccgtgaacaac

SEQ ID NO: 23082 - DNA, 40 bp, Artificial Sequence
  PCR primer for ORF amplification
aattacatgactcgagctatgatgactgcatcttaattat

SEQ ID NO: 23083 - DNA, 40 bp, Artificial Sequence
  PCR primer for ORF amplification
aattacatgactcgagttacataatcgagcagttcttctg

SEQ ID NO: 23084 - DNA, 40 bp, Artificial Sequence
  PCR primer for ORF amplification
aattacatgactcgagttataactctgtaggcttttcttc

SEQ ID NO: 23085 - DNA, 40 bp, Artificial Sequence
  PCR primer for ORF amplification
aattacatgactcgagttaaaactgtatacaattatttgc

SEQ ID NO: 23086 - DNA, 40 bp, Artificial Sequence
  PCR primer for ORF amplification
aattacatgactcgagctacattctcattgtggtttctaa

SEQ ID NO: 23087 - DNA, 40 bp, Artificial Sequence
  PCR primer for ORF amplification
aattacatgactcgagtcaatcttctgcacgcgtgttatt

SEQ ID NO: 23088 - DNA, 40 bp, Artificial Sequence
  PCR primer for ORF amplification
aattacatgactcgagttagttagatctttctactctgtg

SEQ ID NO: 23089 - DNA, 40 bp, Artificial Sequence
  PCR primer for ORF amplification
aattacatgactcgagttacagagctgccaaagagtcaaa

SEQ ID NO: 23090 - DNA, 40 bp, Artificial Sequence
  PCR primer for ORF amplification
aattacatgactcgagttaatcacgtctagcataagagat

SEQ ID NO: 23091 - DNA, 40 bp, Artificial Sequence
  PCR primer for ORF amplification
aattacatgactcgagttagtttctcaagtgactattgtg

SEQ ID NO: 23092 - DNA, 40 bp, Artificial Sequence
  PCR primer for ORF amplification
aattacatgactcgagttagaatcttctggcacgtctact

SEQ ID NO: 23093 - DNA, 40 bp, Artificial Sequence
  PCR primer for ORF amplification
aattacatgactcgagttatattgttacatccaaaatttt

SEQ ID NO: 23094 - DNA, 40 bp, Artificial Sequence
  PCR primer for ORF amplification
aattacatgactcgagttaagttgggttagcccactgtaa

SEQ ID NO: 23095 - DNA, 40 bp, Artificial Sequence
  PCR primer for ORF amplification
aattacatgactcgagttaattttgggtcaattcaacgac

SEQ ID NO: 23096 - DNA, 40 bp, Artificial Sequence
  PCR primer for ORF amplification
aattacatgactcgagtcaacgaggtgggaatgccaaatt

SEQ ID NO: 23097 - DNA, 40 bp, Artificial Sequence
  PCR primer for ORF amplification
aattacatgactcgagttaggcggatggcttagtccgctt

SEQ ID NO: 23098 - DNA, 40 bp, Artificial Sequence
  PCR primer for ORF amplification
aattacatgactcgagttaccatttctgaaaaggtaacca

SEQ ID NO: 23099 - DNA, 40 bp, Artificial Sequence
  PCR primer for ORF amplification
aattacatgactcgagttactcgatcgacttgatttcttt

SEQ ID NO: 23100 - DNA, 40 bp, Artificial Sequence
  PCR primer for ORF amplification
aattacatgactcgagtcattccacagtctccttcttgtt

SEQ ID NO: 23101 - DNA, 40 bp, Artificial Sequence
  PCR primer for ORF amplification
aattacatgactcgagtcatttgtagaagtcgaatttatc

SEQ ID NO: 23102 - DNA, 40 bp, Artificial Sequence
  PCR primer for ORF amplification
aattacatgactcgagtcattggaaaaggagggatgcagc

SEQ ID NO: 23103 - DNA, 40 bp, Artificial Sequence
  PCR primer for ORF amplification
aattacatgactcgagttaaatctcgtcttgctcttcttt

SEQ ID NO: 23104 - DNA, 40 bp, Artificial Sequence
  PCR primer for ORF amplification
aattacatgactcgagtcaatctaaatcaatccgtgacct

SEQ ID NO: 23105 - DNA, 40 bp, Artificial Sequence
  PCR primer for ORF amplification
aattacatgactcgagctaagaatagtactcctcctcttt

SEQ ID NO: 23106 - DNA, 40 bp, Artificial Sequence
  PCR primer for ORF amplification
aattacatgactcgagctagaatttttcgacgttcatgat

SEQ ID NO: 23107 - DNA, 40 bp, Artificial Sequence
  PCR primer for ORF amplification
aattacatgactcgagttatttgtcacccgctgactgcgt

SEQ ID NO: 23108 - DNA, 40 bp, Artificial Sequence
  PCR primer for ORF amplification
aattacatgactcgagtcaaacacgatctgaccctgtcaa

SEQ ID NO: 23109 - DNA, 40 bp, Artificial Sequence
  PCR primer for ORF amplification
aattacatgactcgagttaggtccatctgtgcgcttcgtt

SEQ ID NO: 23110 - DNA, 40 bp, Artificial Sequence
  PCR primer for ORF amplification
aattacatgactcgagtcattccagggttttacgtaacag

SEQ ID NO: 23111 - DNA, 40 bp, Artificial Sequence
  PCR primer for ORF amplification
aattacatgactcgagtcatttctttgattcttgacgttg

SEQ ID NO: 23112 - DNA, 40 bp, Artificial Sequence
  PCR primer for ORF amplification
aattacatgactcgagttaggctctattagcttcttcatc

SEQ ID NO: 23113 - DNA, 40 bp, Artificial Sequence
  PCR primer for ORF amplification
aattacatgactcgagttattcgctgtaaatgctactgct

SEQ ID NO: 23114 - DNA, 40 bp, Artificial Sequence
  PCR primer for ORF amplification
aattacatgactcgagttagtttgtttttttgaatgtttc

SEQ ID NO: 23115 - DNA, 40 bp, Artificial Sequence
  PCR primer for ORF amplification
aattacatgactcgagctatactggcaagtgacagttgtg

SEQ ID NO: 23116 - DNA, 40 bp, Artificial Sequence
  PCR primer for ORF amplification
aattacatgactcgagtcaaaaaccttcaactttcattat

SEQ ID NO: 23117 - DNA, 40 bp, Artificial Sequence
  PCR primer for ORF amplification
aattacatgactcgagttagaaaattgatggtacggtgcc

SEQ ID NO: 23118 - DNA, 40 bp, Artificial Sequence
  PCR primer for ORF amplification
aattacatgactcgagttagtaatcgtcgtcaccaccgta

SEQ ID NO: 23119 - DNA, 40 bp, Artificial Sequence
  PCR primer for ORF amplification
aattacatgactcgagtcaatgttgactagccagcatgtc

SEQ ID NO: 23120 - DNA, 40 bp, Artificial Sequence
  PCR primer for ORF amplification
aattacatgactcgagctatgcaaccaatgcaggtggtgg

SEQ ID NO: 23121 - DNA, 40 bp, Artificial Sequence
  PCR primer for ORF amplification
aattacatgactcgagttatatctctgggtctagtaggaa

SEQ ID NO: 23122 - DNA, 40 bp, Artificial Sequence
  PCR primer for ORF amplification
aattacatgactcgagttactcacctttgcaactttgttc

SEQ ID NO: 23123 - DNA, 40 bp, Artificial Sequence
  PCR primer for ORF amplification
aattacatgactcgagtcaggtgaattgtctagaaccccc

SEQ ID NO: 23124 - DNA, 40 bp, Artificial Sequence
  PCR primer for ORF amplification
aattacatgactcgagttaacttggagaagataaattgga

SEQ ID NO: 23125 - DNA, 40 bp, Artificial Sequence
  PCR primer for ORF amplification
aattacatgactcgagtcagtttggtacctcgaacaccag

SEQ ID NO: 23126 - DNA, 40 bp, Artificial Sequence
  PCR primer for ORF amplification
aattacatgactcgagtcaagagcgcaaacttttcccgtc

SEQ ID NO: 23127 - DNA, 40 bp, Artificial Sequence
  PCR primer for ORF amplification
aattacatgactcgagctatatattgaagccgctgaggtc

SEQ ID NO: 23128 - DNA, 40 bp, Artificial Sequence
  PCR primer for ORF amplification
aattacatgactcgagtcataaattattattatcttcagt

SEQ ID NO: 23129 - DNA, 40 bp, Artificial Sequence
  PCR primer for ORF amplification
aattacatgactcgagttaagtatgtggcgccggaaggaa

SEQ ID NO: 23130 - DNA, 40 bp, Artificial Sequence
  PCR primer for ORF amplification
aattacatgactcgagttacttcttttcttgcttagtttt

SEQ ID NO: 23131 - DNA, 40 bp, Artificial Sequence
  PCR primer for ORF amplification
aattacatgactcgagctattgcaacaactcatccctgta

SEQ ID NO: 23132 - DNA, 40 bp, Artificial Sequence
  PCR primer for ORF amplification
aattacatgactcgagttatatatccggggccgacatcgc

SEQ ID NO: 23133 - DNA, 40 bp, Artificial Sequence
  PCR primer for ORF amplification
aattacatgactcgagctatcttggaccaaatttagtcat

SEQ ID NO: 23134 - DNA, 40 bp, Artificial Sequence
  PCR primer for ORF amplification
aattacatgactcgagtcatgtatgtctcttcttttttgt

SEQ ID NO: 23135 - DNA, 40 bp, Artificial Sequence
  PCR primer for ORF amplification
aattacatgactcgagttaatcactctttgaggatacact

SEQ ID NO: 23136 - DNA, 40 bp, Artificial Sequence
  PCR primer for ORF amplification
aattacatgactcgagctacataataaattgcagatttac

SEQ ID NO: 23137 - DNA, 40 bp, Artificial Sequence
  PCR primer for ORF amplification
aattacatgactcgagtcagttaaaattattgaagtaccg

SEQ ID NO: 23138 - DNA, 40 bp, Artificial Sequence
  PCR primer for ORF amplification
aattacatgactcgagttaaaacctataatacacatatat

SEQ ID NO: 23139 - DNA, 40 bp, Artificial Sequence
  PCR primer for ORF amplification
aattacatgactcgagttattgaacttggttgtctgattt

SEQ ID NO: 23140 - DNA, 40 bp, Artificial Sequence
  PCR primer for ORF amplification
aattacatgactcgagtcaggctggtggtaaaaaagctgc

SEQ ID NO: 23141 - DNA, 40 bp, Artificial Sequence
  PCR primer for ORF amplification
aattacatgactcgagtcattggtccccatcaataccgta

SEQ ID NO: 23142 - DNA, 40 bp, Artificial Sequence
  PCR primer for ORF amplification
aattacatgactcgagctatacacagaaggaccgtagttc

SEQ ID NO: 23143 - DNA, 40 bp, Artificial Sequence
  PCR primer for ORF amplification
aattacatgactcgagttagttaacaccctgaaatgaatt

SEQ ID NO: 23144 - DNA, 40 bp, Artificial Sequence
  PCR primer for ORF amplification
aattacatgactcgagtcaatagaattcattgtcatgctc

SEQ ID NO: 23145 - DNA, 40 bp, Artificial Sequence
  PCR primer for ORF amplification
aattacatgactcgagctatttaatttctttatgcaacat

SEQ ID NO: 23146 - DNA, 40 bp, Artificial Sequence
  PCR primer for ORF amplification
aattacatgactcgagtcaggatactgaatccggctgcca

SEQ ID NO: 23147 - DNA, 40 bp, Artificial Sequence
  PCR primer for ORF amplification
aattacatgactcgagtcacacgaagtaggacaacaagct

SEQ ID NO: 23148 - DNA, 40 bp, Artificial Sequence
  PCR primer for ORF amplification
aattacatgactcgagtcaccttggttgtgtatatgggac

SEQ ID NO: 23149 - DNA, 40 bp, Artificial Sequence
  PCR primer for ORF amplification
aattacatgactcgagctatataatttcccattccaattt

SEQ ID NO: 23150 - DNA, 40 bp, Artificial Sequence
  PCR primer for ORF amplification
aattacatgactcgagttatttaggtcctcccttcttttt

SEQ ID NO: 23151 - DNA, 40 bp, Artificial Sequence
  PCR primer for ORF amplification
aattacatgactcgagttaaaagtctcctgcgttgttaaa

SEQ ID NO: 23152 - DNA, 40 bp, Artificial Sequence
  PCR primer for ORF amplification
aattacatgactcgagttatgcataaaaggataccgattt

SEQ ID NO: 23153 - DNA, 40 bp, Artificial Sequence
  PCR primer for ORF amplification
aattacatgactcgagttacatccaattctggctctggaa

SEQ ID NO: 23154 - DNA, 40 bp, Artificial Sequence
  PCR primer for ORF amplification
aattacatgactcgagttatatagtaatttcgttctccct

SEQ ID NO: 23155 - DNA, 40 bp, Artificial Sequence
  PCR primer for ORF amplification
aattacatgactcgagttacaaaacaatttccttttcttc

SEQ ID NO: 23156 - DNA, 40 bp, Artificial Sequence
  PCR primer for ORF amplification
aattacatgactcgagctaatacaagacacttgccttttc

SEQ ID NO: 23157 - DNA, 40 bp, Artificial Sequence
  PCR primer for ORF amplification
aattacatgactcgagttataaggaagactcggattcacc

SEQ ID NO: 23158 - DNA, 40 bp, Artificial Sequence
  PCR primer for ORF amplification
aattacatgactcgagttaatttttgatgaattttaattt

SEQ ID NO: 23159 - DNA, 40 bp, Artificial Sequence
  PCR primer for ORF amplification
aattacatgactcgagtcatacacgacggccgggaacaca

SEQ ID NO: 23160 - DNA, 40 bp, Artificial Sequence
  PCR primer for ORF amplification
aattacatgactcgagttactgttggaactcattagcgta

SEQ ID NO: 23161 - DNA, 40 bp, Artificial Sequence
  PCR primer for ORF amplification
aattacatgactcgagttatcgatatcttgtttgccagtg

SEQ ID NO: 23162 - DNA, 40 bp, Artificial Sequence
  PCR primer for ORF amplification
aattacatgactcgagttataaactataatgcgagatatt

SEQ ID NO: 23163 - DNA, 40 bp, Artificial Sequence
  PCR primer for ORF amplification
aattacatgactcgagctacttaagattaaatagattttg

SEQ ID NO: 23164 - DNA, 40 bp, Artificial Sequence
  PCR primer for ORF amplification
aattacatgactcgagttacatagggcggacattgcttag

SEQ ID NO: 23165 - DNA, 40 bp, Artificial Sequence
  PCR primer for ORF amplification
aattacatgactcgagctaaatatattcgttgcatttttc

SEQ ID NO: 23166 - DNA, 40 bp, Artificial Sequence
  PCR primer for ORF amplification
aattacatgactcgagttataaaggttctgttaatgccaa

SEQ ID NO: 23167 - DNA, 40 bp, Artificial Sequence
  PCR primer for ORF amplification
aattacatgactcgagctaaatttccaaaccatttagaac

SEQ ID NO: 23168 - DNA, 40 bp, Artificial Sequence
  PCR primer for ORF amplification
aattacatgactcgagtcattgtctcttgattgtatggta

SEQ ID NO: 23169 - DNA, 40 bp, Artificial Sequence
  PCR primer for ORF amplification
aattacatgactcgagttagatactataaaaagggttctg

SEQ ID NO: 23170 - DNA, 40 bp, Artificial Sequence
  PCR primer for ORF amplification
aattacatgactcgagttatttggttgtgtctggattcat

SEQ ID NO: 23171 - DNA, 40 bp, Artificial Sequence
  PCR primer for ORF amplification
aattacatgactcgagttatttcaatacagtatatagttg

SEQ ID NO: 23172 - DNA, 40 bp, Artificial Sequence
  PCR primer for ORF amplification
aattacatgactcgagctatttcttaccaacaacttccca

SEQ ID NO: 23173 - DNA, 40 bp, Artificial Sequence
  PCR primer for ORF amplification
aattacatgactcgagtcagttgggctttacgctttccgg

SEQ ID NO: 23174 - DNA, 40 bp, Artificial Sequence
  PCR primer for ORF amplification
aattacatgactcgagtcaagttttaggcaaggctttagc

SEQ ID NO: 23175 - DNA, 40 bp, Artificial Sequence
  PCR primer for ORF amplification
aattacatgactcgagttattttttatcttcgtccttttt

SEQ ID NO: 23176 - DNA, 40 bp, Artificial Sequence
  PCR primer for ORF amplification
aattacatgactcgagttataatttgtcaccgtggtggaa

SEQ ID NO: 23177 - DNA, 40 bp, Artificial Sequence
  PCR primer for ORF amplification
aattacatgactcgagttacaacttgtcaccgtggtggaa

SEQ ID NO: 23178 - DNA, 40 bp, Artificial Sequence
  PCR primer for ORF amplification
aattacatgactcgagttatagtttgtttccatcatgaaa

SEQ ID NO: 23179 - DNA, 40 bp, Artificial Sequence
  PCR primer for ORF amplification
aattacatgactcgagctagttaccttcttgaccaaaatc

SEQ ID NO: 23180 - DNA, 40 bp, Artificial Sequence
  PCR primer for ORF amplification
aattacatgactcgagtcataatttttggtattctatagt

SEQ ID NO: 23181 - DNA, 40 bp, Artificial Sequence
  PCR primer for ORF amplification
aattacatgactcgagctattcgctttcctcggtataggg

SEQ ID NO: 23182 - DNA, 40 bp, Artificial Sequence
  PCR primer for ORF amplification
aattacatgactcgagttaaatgaaatcatagtcggatcc

SEQ ID NO: 23183 - DNA, 40 bp, Artificial Sequence
  PCR primer for ORF amplification
aattacatgactcgagctaattcttttggattccatgctt

SEQ ID NO: 23184 - DNA, 40 bp, Artificial Sequence
  PCR primer for ORF amplification
aattacatgactcgagtcacaagtataaaccttctaaatt

SEQ ID NO: 23185 - DNA, 40 bp, Artificial Sequence
  PCR primer for ORF amplification
aattacatgactcgagtcagtttctgttggtaattgaact

SEQ ID NO: 23186 - DNA, 40 bp, Artificial Sequence
  PCR primer for ORF amplification
aattacatgactcgagctattcaataatacgtgtgattag

SEQ ID NO: 23187 - DNA, 40 bp, Artificial Sequence
  PCR primer for ORF amplification
aattacatgactcgagttaaatgttttctgtctcattgaa

SEQ ID NO: 23188 - DNA, 40 bp, Artificial Sequence
  PCR primer for ORF amplification
aattacatgactcgagttatatccaattctggtaaccaaa

SEQ ID NO: 23189 - DNA, 40 bp, Artificial Sequence
  PCR primer for ORF amplification
aattacatgactcgagttaataaacatatggaatgatctt

SEQ ID NO: 23190 - DNA, 40 bp, Artificial Sequence
  PCR primer for ORF amplification
aattacatgactcgagctatgttggacggtaattctccag

SEQ ID NO: 23191 - DNA, 40 bp, Artificial Sequence
  PCR primer for ORF amplification
aattacatgactcgagttaatgatcctctaagcaatcagc

SEQ ID NO: 23192 - DNA, 40 bp, Artificial Sequence
  PCR primer for ORF amplification
aattacatgactcgagctatttcttggttcggaagtcccc

SEQ ID NO: 23193 - DNA, 40 bp, Artificial Sequence
  PCR primer for ORF amplification
aattacatgactcgagttaatcaataaggtgagaatattc

SEQ ID NO: 23194 - DNA, 40 bp, Artificial Sequence
  PCR primer for ORF amplification
aattacatgactcgagctaatatttaggaatggtttgatc

SEQ ID NO: 23195 - DNA, 40 bp, Artificial Sequence
  PCR primer for ORF amplification
aattacatgactcgagctacctgtctctagttaaattttt

SEQ ID NO: 23196 - DNA, 40 bp, Artificial Sequence
  PCR primer for ORF amplification
aattacatgactcgagctattcgtcatcgatgtctagctc

SEQ ID NO: 23197 - DNA, 40 bp, Artificial Sequence
  PCR primer for ORF amplification
aattacatgactcgagctagaagaactgctggttgtcagg

SEQ ID NO: 23198 - DNA, 40 bp, Artificial Sequence
  PCR primer for ORF amplification
aattacatgactcgagctaaagttttaggttttttaactt

SEQ ID NO: 23199 - DNA, 40 bp, Artificial Sequence
  PCR primer for ORF amplification
aattacatgactcgagtcataatgtaaaggtgtccttgta

SEQ ID NO: 23200 - DNA, 40 bp, Artificial Sequence
  PCR primer for ORF amplification
aattacatgactcgagttaaagtttgctgataattaaatc

SEQ ID NO: 23201 - DNA, 40 bp, Artificial Sequence
  PCR primer for ORF amplification
aattacatgactcgagctatttggtgacctttgccttttt

SEQ ID NO: 23202 - DNA, 40 bp, Artificial Sequence
  PCR primer for ORF amplification
aattacatgactcgagttatgaacggtaatcaccgttaat

SEQ ID NO: 23203 - DNA, 40 bp, Artificial Sequence
  PCR primer for ORF amplification
aattacatgactcgagtcatctggacttcttgcctaatgg

SEQ ID NO: 23204 - DNA, 40 bp, Artificial Sequence
  PCR primer for ORF amplification
aattacatgactcgagtcatttcttagggcttgcgtcagc

SEQ ID NO: 23205 - DNA, 40 bp, Artificial Sequence
  PCR primer for ORF amplification
aattacatgactcgagttaaggcttgaaggaaaacgagct

SEQ ID NO: 23206 - DNA, 40 bp, Artificial Sequence
  PCR primer for ORF amplification
aattacatgactcgagtcagacctgctgggatgaacgact

SEQ ID NO: 23207 - DNA, 40 bp, Artificial Sequence
  PCR primer for ORF amplification
aattacatgactcgagttacttatttttgttgttcttttt

SEQ ID NO: 23208 - DNA, 40 bp, Artificial Sequence
  PCR primer for ORF amplification
aattacatgactcgagttacaggcaattggaagtattgca

SEQ ID NO: 23209 - DNA, 40 bp, Artificial Sequence
  PCR primer for ORF amplification
aattacatgactcgagttagtttaattttgtttcgttaga

SEQ ID NO: 23210 - DNA, 40 bp, Artificial Sequence
  PCR primer for ORF amplification
aattacatgactcgagctactcacggaattttttccagtt

SEQ ID NO: 23211 - DNA, 40 bp, Artificial Sequence
  PCR primer for ORF amplification
aattacatgactcgagctacattccaaataattctacgtt

SEQ ID NO: 23212 - DNA, 40 bp, Artificial Sequence
  PCR primer for ORF amplification
aattacatgactcgagttaactcccttcccatttcttgaa

SEQ ID NO: 23213 - DNA, 40 bp, Artificial Sequence
  PCR primer for ORF amplification
aattacatgactcgagctacatagttatgttattggtgat

SEQ ID NO: 23214 - DNA, 40 bp, Artificial Sequence
  PCR primer for ORF amplification
aattacatgactcgagtcatatatagttactatcgagtat

SEQ ID NO: 23215 - DNA, 40 bp, Artificial Sequence
  PCR primer for ORF amplification
aattacatgactcgagttatattttattgagctttatggt

SEQ ID NO: 23216 - DNA, 40 bp, Artificial Sequence
  PCR primer for ORF amplification
aattacatgactcgagttatttcttcttcttaccctcaat

SEQ ID NO: 23217 - DNA, 40 bp, Artificial Sequence
  PCR primer for ORF amplification
aattacatgactcgagctacatgggcaatagccccacaga

SEQ ID NO: 23218 - DNA, 40 bp, Artificial Sequence
  PCR primer for ORF amplification
aattacatgactcgagttatgaagtccatggtaaattcgt

SEQ ID NO: 23219 - DNA, 40 bp, Artificial Sequence
  PCR primer for ORF amplification
aattacatgactcgagtcataaggaagcgtgagttttaac

SEQ ID NO: 23220 - DNA, 40 bp, Artificial Sequence
  PCR primer for ORF amplification
aattacatgactcgagttataagtagtccttgagtagttt

SEQ ID NO: 23221 - DNA, 40 bp, Artificial Sequence
  PCR primer for ORF amplification
aattacatgactcgagtcagtttttaaggccaatttgatt

SEQ ID NO: 23222 - DNA, 40 bp, Artificial Sequence
  PCR primer for ORF amplification
aattacatgactcgagttacagaagtttgaccttcttgat

SEQ ID NO: 23223 - DNA, 40 bp, Artificial Sequence
  PCR primer for ORF amplification
aattacatgactcgagtcacgagtaatgttctccatgttt

SEQ ID NO: 23224 - DNA, 40 bp, Artificial Sequence
  PCR primer for ORF amplification
aattacatgactcgagttacattatagacatgatgattgc

SEQ ID NO: 23225 - DNA, 40 bp, Artificial Sequence
  PCR primer for ORF amplification
aattacatgactcgagtcatggtttttggccagcgaaaac

SEQ ID NO: 23226 - DNA, 40 bp, Artificial Sequence
  PCR primer for ORF amplification
aattacatgactcgagctactcacctagaaacatcttgcg

SEQ ID NO: 23227 - DNA, 40 bp, Artificial Sequence
  PCR primer for ORF amplification
aattacatgactcgagtcacgctctgtgtaaagtgtatat

SEQ ID NO: 23228 - DNA, 40 bp, Artificial Sequence
  PCR primer for ORF amplification
aattacatgactcgagtcagcattcaaacaaacctccctc

SEQ ID NO: 23229 - DNA, 40 bp, Artificial Sequence
  PCR primer for ORF amplification
aattacatgactcgagctaggacattccatcaggcttcca

SEQ ID NO: 23230 - DNA, 40 bp, Artificial Sequence
  PCR primer for ORF amplification
aattacatgactcgagtcatagcagtttggtctttatgat

SEQ ID NO: 23231 - DNA, 40 bp, Artificial Sequence
  PCR primer for ORF amplification
aattacatgactcgagttactctaaatatctatatgaagt

SEQ ID NO: 23232 - DNA, 40 bp, Artificial Sequence
  PCR primer for ORF amplification
aattacatgactcgagtcaatgacattggttaggatattt

SEQ ID NO: 23233 - DNA, 40 bp, Artificial Sequence
  PCR primer for ORF amplification
aattacatgactcgagtcatttagcttgcaaaccgtgcat

SEQ ID NO: 23234 - DNA, 40 bp, Artificial Sequence
  PCR primer for ORF amplification
aattacatgactcgagctattcttcttgtaaagtttcctt

SEQ ID NO: 23235 - DNA, 40 bp, Artificial Sequence
  PCR primer for ORF amplification
aattacatgactcgagttaccaggcaaagcgtaactgaga

SEQ ID NO: 23236 - DNA, 40 bp, Artificial Sequence
  PCR primer for ORF amplification
aattacatgactcgagttatattttttgcatttctttcgt

SEQ ID NO: 23237 - DNA, 40 bp, Artificial Sequence
  PCR primer for ORF amplification
aattacatgactcgagtcagtttatgttgaatgccttctc

SEQ ID NO: 23238 - DNA, 40 bp, Artificial Sequence
  PCR primer for ORF amplification
aattacatgactcgagttaaatgtatcgttggccattcat

SEQ ID NO: 23239 - DNA, 40 bp, Artificial Sequence
  PCR primer for ORF amplification
aattacatgactcgagttatggtaacctatcccaaccttc

SEQ ID NO: 23240 - DNA, 40 bp, Artificial Sequence
  PCR primer for ORF amplification
aattacatgactcgagtcattcttctgttttggtatcctt

SEQ ID NO: 23241 - DNA, 40 bp, Artificial Sequence
  PCR primer for ORF amplification
aattacatgactcgagttaagccactgtcttttcctttag

SEQ ID NO: 23242 - DNA, 40 bp, Artificial Sequence
  PCR primer for ORF amplification
aattacatgactcgagttaattattcaaataagtggacgg

SEQ ID NO: 23243 - DNA, 40 bp, Artificial Sequence
  PCR primer for ORF amplification
aattacatgactcgagttatgacaaagggatgaaattccc

SEQ ID NO: 23244 - DNA, 40 bp, Artificial Sequence
  PCR primer for ORF amplification
aattacatgactcgagttatgaggcttggttgtcaccgaa

SEQ ID NO: 23245 - DNA, 40 bp, Artificial Sequence
  PCR primer for ORF amplification
aattacatgactcgagttagtcttctgacttcgactcccg

SEQ ID NO: 23246 - DNA, 40 bp, Artificial Sequence
  PCR primer for ORF amplification
aattacatgactcgagtcatctgaattgagagtaataagc

SEQ ID NO: 23247 - DNA, 40 bp, Artificial Sequence
  PCR primer for ORF amplification
aattacatgactcgagttaatcatttatttgtaagttttg

SEQ ID NO: 23248 - DNA, 40 bp, Artificial Sequence
  PCR primer for ORF amplification
aattacatgactcgagttagttagaaattgtgccacattg

SEQ ID NO: 23249 - DNA, 40 bp, Artificial Sequence
  PCR primer for ORF amplification
aattacatgactcgagtcactcttgcttttcccatacttg

SEQ ID NO: 23250 - DNA, 40 bp, Artificial Sequence
  PCR primer for ORF amplification
aattacatgactcgagttaaagctctctccatgattctct

SEQ ID NO: 23251 - DNA, 40 bp, Artificial Sequence
  PCR primer for ORF amplification
aattacatgactcgagttaatggcggttcatttgcttttt

SEQ ID NO: 23252 - DNA, 40 bp, Artificial Sequence
  PCR primer for ORF amplification
aattacatgactcgagctattgttttgctgggttctgctt

SEQ ID NO: 23253 - DNA, 40 bp, Artificial Sequence
  PCR primer for ORF amplification
aattacatgactcgagtcatttagttccaatccaaaattg

SEQ ID NO: 23254 - DNA, 40 bp, Artificial Sequence
  PCR primer for ORF amplification
aattacatgactcgagttagtttagcttcaaagctgcggt

SEQ ID NO: 23255 - DNA, 40 bp, Artificial Sequence
  PCR primer for ORF amplification
aattacatgactcgagtcaaaactgtaatgctgacgaagg

SEQ ID NO: 23256 - DNA, 40 bp, Artificial Sequence
  PCR primer for ORF amplification
aattacatgactcgagtcaacgtactgtccataggttgtc

SEQ ID NO: 23257 - DNA, 40 bp, Artificial Sequence
  PCR primer for ORF amplification
aattacatgactcgagctaattcgcgcgaaaggttgtggc

SEQ ID NO: 23258 - DNA, 40 bp, Artificial Sequence
  PCR primer for ORF amplification
aattacatgactcgagtcaaaagactaaccacagagcaca

SEQ ID NO: 23259 - DNA, 40 bp, Artificial Sequence
  PCR primer for ORF amplification
aattacatgactcgagtcattgtaacactccagagtcttt

SEQ ID NO: 23260 - DNA, 40 bp, Artificial Sequence
  PCR primer for ORF amplification
aattacatgactcgagtcaaaccatgttgaaaaggctgaa

SEQ ID NO: 23261 - DNA, 40 bp, Artificial Sequence
  PCR primer for ORF amplification
aattacatgactcgagtcaatatctgtagtggtcggcctt

SEQ ID NO: 23262 - DNA, 40 bp, Artificial Sequence
  PCR primer for ORF amplification
aattacatgactcgagtcaatgaattagcttcaaatctct

SEQ ID NO: 23263 - DNA, 40 bp, Artificial Sequence
  PCR primer for ORF amplification
aattacatgactcgagtcaacgtggttgttcttccatcat

SEQ ID NO: 23264 - DNA, 40 bp, Artificial Sequence
  PCR primer for ORF amplification
aattacatgactcgagtcaattactcttgtgcatcaagta

SEQ ID NO: 23265 - DNA, 40 bp, Artificial Sequence
  PCR primer for ORF amplification
aattacatgactcgagtcacctatgggaaaggactaaact

SEQ ID NO: 23266 - DNA, 40 bp, Artificial Sequence
  PCR primer for ORF amplification
aattacatgactcgagttatatccatttctgtcttgcagc

SEQ ID NO: 23267 - DNA, 40 bp, Artificial Sequence
  PCR primer for ORF amplification
aattacatgactcgagctagtcctgcatggcatatacatc

SEQ ID NO: 23268 - DNA, 40 bp, Artificial Sequence
  PCR primer for ORF amplification
aattacatgactcgagttaatcagtttctaataatctatg

SEQ ID NO: 23269 - DNA, 40 bp, Artificial Sequence
  PCR primer for ORF amplification
aattacatgactcgagttattctgacagagaaagtagagc

SEQ ID NO: 23270 - DNA, 40 bp, Artificial Sequence
  PCR primer for ORF amplification
aattacatgactcgagctattgcatatattcgagcatttc

SEQ ID NO: 23271 - DNA, 40 bp, Artificial Sequence
  PCR primer for ORF amplification
aattacatgactcgagctaaaatcttttggcgcttaagtt

SEQ ID NO: 23272 - DNA, 40 bp, Artificial Sequence
  PCR primer for ORF amplification
aattacatgactcgagttactgcttttcttgttcttgtct

SEQ ID NO: 23273 - DNA, 40 bp, Artificial Sequence
  PCR primer for ORF amplification
aattacatgactcgagtcatacgactaattcatcaaactt

SEQ ID NO: 23274 - DNA, 40 bp, Artificial Sequence
  PCR primer for ORF amplification
aattacatgactcgagttatttatcaagataagtttccgg

SEQ ID NO: 23275 - DNA, 40 bp, Artificial Sequence
  PCR primer for ORF amplification
aattacatgactcgagttatgcgagtttgtccattttcga

SEQ ID NO: 23276 - DNA, 40 bp, Artificial Sequence
  PCR primer for ORF amplification
aattacatgactcgagctattttccggttctgtgatgtga

SEQ ID NO: 23277 - DNA, 40 bp, Artificial Sequence
  PCR primer for ORF amplification
aattacatgactcgagctaatacactgccgaatacggaaa

SEQ ID NO: 23278 - DNA, 40 bp, Artificial Sequence
  PCR primer for ORF amplification
aattacatgactcgagttaaaatttgtcttccaaaggaga

SEQ ID NO: 23279 - DNA, 40 bp, Artificial Sequence
  PCR primer for ORF amplification
aattacatgactcgagttaatctggagagtttgtcgaact

SEQ ID NO: 23280 - DNA, 40 bp, Artificial Sequence
  PCR primer for ORF amplification
aattacatgactcgagttatgtatttcttttttcagcggc

SEQ ID NO: 23281 - DNA, 40 bp, Artificial Sequence
  PCR primer for ORF amplification
aattacatgactcgagctattgttcataaccaggtggtgg

SEQ ID NO: 23282 - DNA, 40 bp, Artificial Sequence
  PCR primer for ORF amplification
aattacatgactcgagctatgaaaaggcaatcaatccact

SEQ ID NO: 23283 - DNA, 40 bp, Artificial Sequence
  PCR primer for ORF amplification
aattacatgactcgagttatgtatcacaactattaaattc

SEQ ID NO: 23284 - DNA, 40 bp, Artificial Sequence
  PCR primer for ORF amplification
aattacatgactcgagtcaatttttatcttcatttttaat

SEQ ID NO: 23285 - DNA, 40 bp, Artificial Sequence
  PCR primer for ORF amplification
aattacatgactcgagctactttgagtattggtgggattt

SEQ ID NO: 23286 - DNA, 40 bp, Artificial Sequence
  PCR primer for ORF amplification
aattacatgactcgagttatgcctgacgtccatctttttt

SEQ ID NO: 23287 - DNA, 40 bp, Artificial Sequence
  PCR primer for ORF amplification
aattacatgactcgagttatatattacttgactggtcttg

SEQ ID NO: 23288 - DNA, 40 bp, Artificial Sequence
  PCR primer for ORF amplification
aattacatgactcgagtcaaggcgatttagtttcgtctga

SEQ ID NO: 23289 - DNA, 40 bp, Artificial Sequence
  PCR primer for ORF amplification
aattacatgactcgagtcattcaactttttttgatatggc

SEQ ID NO: 23290 - DNA, 40 bp, Artificial Sequence
  PCR primer for ORF amplification
aattacatgactcgagctacaacttatccatcgcctcatt

SEQ ID NO: 23291 - DNA, 40 bp, Artificial Sequence
  PCR primer for ORF amplification
aattacatgactcgagttattcgacctcactaaataagtc

SEQ ID NO: 23292 - DNA, 40 bp, Artificial Sequence
  PCR primer for ORF amplification
aattacatgactcgagttattctacttcactgaataagtc

SEQ ID NO: 23293 - DNA, 40 bp, Artificial Sequence
  PCR primer for ORF amplification
aattacatgactcgagtcaccttcttccccatcgtccatt

SEQ ID NO: 23294 - DNA, 40 bp, Artificial Sequence
  PCR primer for ORF amplification
aattacatgactcgagttattgttgttgctgctgttgctg

SEQ ID NO: 23295 - DNA, 40 bp, Artificial Sequence
  PCR primer for ORF amplification
aattacatgactcgagttagtttttcttcttttcactaac

SEQ ID NO: 23296 - DNA, 40 bp, Artificial Sequence
  PCR primer for ORF amplification
aattacatgactcgagctatttttttgatggacgaagcag

SEQ ID NO: 23297 - DNA, 40 bp, Artificial Sequence
  PCR primer for ORF amplification
aattacatgactcgagttacttctctttgatggcagcggc

SEQ ID NO: 23298 - DNA, 40 bp, Artificial Sequence
  PCR primer for ORF amplification
aattacatgactcgagttaaaatacatcaccttggtcaaa

SEQ ID NO: 23299 - DNA, 40 bp, Artificial Sequence
  PCR primer for ORF amplification
aattacatgactcgagttatttggccaaagcacccattgg

SEQ ID NO: 23300 - DNA, 40 bp, Artificial Sequence
  PCR primer for ORF amplification
aattacatgactcgagtcataaatcaattagagtatatcc

SEQ ID NO: 23301 - DNA, 40 bp, Artificial Sequence
  PCR primer for ORF amplification
aattacatgactcgagtcagttttcgaccctaggaacccc

SEQ ID NO: 23302 - DNA, 40 bp, Artificial Sequence
  PCR primer for ORF amplification
aattacatgactcgagtcaccaaagaacgtgagaatgggc

SEQ ID NO: 23303 - DNA, 40 bp, Artificial Sequence
  PCR primer for ORF amplification
aattacatgactcgagtcattcgtccaggcgttccattac

SEQ ID NO: 23304 - DNA, 40 bp, Artificial Sequence
  PCR primer for ORF amplification
aattacatgactcgagctatttgaagtccttatgtgtcca

SEQ ID NO: 23305 - DNA, 40 bp, Artificial Sequence
  PCR primer for ORF amplification
aattacatgactcgagctagtcacatacatatatcttacc

SEQ ID NO: 23306 - DNA, 40 bp, Artificial Sequence
  PCR primer for ORF amplification
aattacatgactcgagtcaatcgtattctactccggatcc

SEQ ID NO: 23307 - DNA, 40 bp, Artificial Sequence
  PCR primer for ORF amplification
aattacatgactcgagctacaacataacaacaccgacatt

SEQ ID NO: 23308 - DNA, 40 bp, Artificial Sequence
  PCR primer for ORF amplification
aattacatgactcgagctatggcaaggccgcagaagaacc

SEQ ID NO: 23309 - DNA, 40 bp, Artificial Sequence
  PCR primer for ORF amplification
aattacatgactcgagtcaatcaataatgacatcaaccat

SEQ ID NO: 23310 - DNA, 40 bp, Artificial Sequence
  PCR primer for ORF amplification
aattacatgactcgagtcagtaagatgctggtttagtggc

SEQ ID NO: 23311 - DNA, 40 bp, Artificial Sequence
  PCR primer for ORF amplification
aattacatgactcgagtcaacatgatgcgaaatcatggct

SEQ ID NO: 23312 - DNA, 40 bp, Artificial Sequence
  PCR primer for ORF amplification
aattacatgactcgagttattttataattttcttcaacat

SEQ ID NO: 23313 - DNA, 40 bp, Artificial Sequence
  PCR primer for ORF amplification
aattacatgactcgagttaatagtctaaagatatcttggt

SEQ ID NO: 23314 - DNA, 40 bp, Artificial Sequence
  PCR primer for ORF amplification
aattacatgactcgagttataatgtcacagtctttatatc

SEQ ID NO: 23315 - DNA, 40 bp, Artificial Sequence
  PCR primer for ORF amplification
aattacatgactcgagctagaaaatatgattagcgttccg

SEQ ID NO: 23316 - DNA, 40 bp, Artificial Sequence
  PCR primer for ORF amplification
aattacatgactcgagtcatatcagcccggataccaagat

SEQ ID NO: 23317 - DNA, 40 bp, Artificial Sequence
  PCR primer for ORF amplification
aattacatgactcgagttataaaactaactcatcaaagct

SEQ ID NO: 23318 - DNA, 40 bp, Artificial Sequence
  PCR primer for ORF amplification
aattacatgactcgagctaaaaaacgtctccctggtcaag

SEQ ID NO: 23319 - DNA, 40 bp, Artificial Sequence
  PCR primer for ORF amplification
aattacatgactcgagctaaatgtttaatttatcaaattt

SEQ ID NO: 23320 - DNA, 40 bp, Artificial Sequence
  PCR primer for ORF amplification
aattacatgactcgagttattcaaaattctcagtgattgg

SEQ ID NO: 23321 - DNA, 40 bp, Artificial Sequence
  PCR primer for ORF amplification
aattacatgactcgagttaccatctcatcatggacatgtc

SEQ ID NO: 23322 - DNA, 40 bp, Artificial Sequence
  PCR primer for ORF amplification
aattacatgactcgagtcacctaaacacttcaaattggac

SEQ ID NO: 23323 - DNA, 40 bp, Artificial Sequence
  PCR primer for ORF amplification
aattacatgactcgagtcagctttcgaagacagaatgaaa

SEQ ID NO: 23324 - DNA, 40 bp, Artificial Sequence
  PCR primer for ORF amplification
aattacatgactcgagtcaagagtgattggtcaatgattt

SEQ ID NO: 23325 - DNA, 40 bp, Artificial Sequence
  PCR primer for ORF amplification
aattacatgactcgagttatttcttagcagccttttgagc

SEQ ID NO: 23326 - DNA, 40 bp, Artificial Sequence
  PCR primer for ORF amplification
aattacatgactcgagttattggcttattttctttttgtt

SEQ ID NO: 23327 - DNA, 40 bp, Artificial Sequence
  PCR primer for ORF amplification
aattacatgactcgagctacttgtcttctaaattatcttc

SEQ ID NO: 23328 - DNA, 40 bp, Artificial Sequence
  PCR primer for ORF amplification
aattacatgactcgagtcaggttgatatagcattgataga

SEQ ID NO: 23329 - DNA, 40 bp, Artificial Sequence
  PCR primer for ORF amplification
aattacatgactcgagttaaaacagcatccacacagcccc

SEQ ID NO: 23330 - DNA, 40 bp, Artificial Sequence
  PCR primer for ORF amplification
aattacatgactcgagtcagttgagctttttttccataga

SEQ ID NO: 23331 - DNA, 40 bp, Artificial Sequence
  PCR primer for ORF amplification
aattacatgactcgagttatgctaaacgcgtaaaatctag

SEQ ID NO: 23332 - DNA, 40 bp, Artificial Sequence
  PCR primer for ORF amplification
aattacatgactcgagttaaaacttcatcttcttttttgt

SEQ ID NO: 23333 - DNA, 40 bp, Artificial Sequence
  PCR primer for ORF amplification
aattacatgactcgagctacagtaaaccacctttagcaac

SEQ ID NO: 23334 - DNA, 40 bp, Artificial Sequence
  PCR primer for ORF amplification
aattacatgactcgagtcaaacgttaaagggagtggtatc

SEQ ID NO: 23335 - DNA, 40 bp, Artificial Sequence
  PCR primer for ORF amplification
aattacatgactcgagctaacttctccttttggaactgtt

SEQ ID NO: 23336 - DNA, 40 bp, Artificial Sequence
  PCR primer for ORF amplification
aattacatgactcgagtcattggatacagcagtacgaact

SEQ ID NO: 23337 - DNA, 40 bp, Artificial Sequence
  PCR primer for ORF amplification
aattacatgactcgagtcaatgtgatgatgtgcccaaaaa

SEQ ID NO: 23338 - DNA, 40 bp, Artificial Sequence
  PCR primer for ORF amplification
aattacatgactcgagctaatccgaccaatcatcctcgtc

SEQ ID NO: 23339 - DNA, 40 bp, Artificial Sequence
  PCR primer for ORF amplification
aattacatgactcgagttaatgatatggtggggggctatc

SEQ ID NO: 23340 - DNA, 40 bp, Artificial Sequence
  PCR primer for ORF amplification
aattacatgactcgagctatttcttgctcttttcagcttg

SEQ ID NO: 23341 - DNA, 40 bp, Artificial Sequence
  PCR primer for ORF amplification
aattacatgactcgagtcagtttttgaaaatgttgtctcc

SEQ ID NO: 23342 - DNA, 40 bp, Artificial Sequence
  PCR primer for ORF amplification
aattacatgactcgagctatagtttgctttcaatgttttt

SEQ ID NO: 23343 - DNA, 40 bp, Artificial Sequence
  PCR primer for ORF amplification
aattacatgactcgagttaacttttggcagctccaacctc

SEQ ID NO: 23344 - DNA, 40 bp, Artificial Sequence
  PCR primer for ORF amplification
aattacatgactcgagttaggcttctgtcgaaacaatcca

SEQ ID NO: 23345 - DNA, 40 bp, Artificial Sequence
  PCR primer for ORF amplification
aattacatgactcgagtcaggctgtttctattcctcgctt

SEQ ID NO: 23346 - DNA, 40 bp, Artificial Sequence
  PCR primer for ORF amplification
aattacatgactcgagttaacgtctagaatcaagcaaagt

SEQ ID NO: 23347 - DNA, 40 bp, Artificial Sequence
  PCR primer for ORF amplification
aattacatgactcgagctaatttggttccacaaaggctct

SEQ ID NO: 23348 - DNA, 40 bp, Artificial Sequence
  PCR primer for ORF amplification
aattacatgactcgagtcaggaacgttctcttgtcaaaaa

SEQ ID NO: 23349 - DNA, 40 bp, Artificial Sequence
  PCR primer for ORF amplification
aattacatgactcgagttagttagttaaagaagaggaact

SEQ ID NO: 23350 - DNA, 40 bp, Artificial Sequence
  PCR primer for ORF amplification
aattacatgactcgagttaagcattggaacacggtattgc

SEQ ID NO: 23351 - DNA, 40 bp, Artificial Sequence
  PCR primer for ORF amplification
aattacatgactcgagttaagttattacgggcttggattc

SEQ ID NO: 23352 - DNA, 40 bp, Artificial Sequence
  PCR primer for ORF amplification
aattacatgactcgagttatttaagaagaattgtttgaat

SEQ ID NO: 23353 - DNA, 40 bp, Artificial Sequence
  PCR primer for ORF amplification
aattacatgactcgagttacttgtagtttttttccagctc

SEQ ID NO: 23354 - DNA, 40 bp, Artificial Sequence
  PCR primer for ORF amplification
aattacatgactcgagttatagagaaggagacattgaaac

SEQ ID NO: 23355 - DNA, 40 bp, Artificial Sequence
  PCR primer for ORF amplification
aattacatgactcgagttaagtacttactataacgtcgac

SEQ ID NO: 23356 - DNA, 40 bp, Artificial Sequence
  PCR primer for ORF amplification
aattacatgactcgagctaaaatcgttcctgtggtcgctt

SEQ ID NO: 23357 - DNA, 40 bp, Artificial Sequence
  PCR primer for ORF amplification
aattacatgactcgagctatcttctcagagcccattctgg

SEQ ID NO: 23358 - DNA, 40 bp, Artificial Sequence
  PCR primer for ORF amplification
aattacatgactcgagctaagtgtcttgatcatgttctgg

SEQ ID NO: 23359 - DNA, 40 bp, Artificial Sequence
  PCR primer for ORF amplification
aattacatgactcgagttatattttatatgttgcggatga

SEQ ID NO: 23360 - DNA, 40 bp, Artificial Sequence
  PCR primer for ORF amplification
aattacatgactcgagttaattcttctttttcttgtcttt

SEQ ID NO: 23361 - DNA, 40 bp, Artificial Sequence
  PCR primer for ORF amplification
aattacatgactcgagtcattggttcagtttttcttcgat

SEQ ID NO: 23362 - DNA, 40 bp, Artificial Sequence
  PCR primer for ORF amplification
aattacatgactcgagttaaaacaataacatagcaacaag

SEQ ID NO: 23363 - DNA, 40 bp, Artificial Sequence
  PCR primer for ORF amplification
aattacatgactcgagttaaattttgcttttcttactggc

SEQ ID NO: 23364 - DNA, 40 bp, Artificial Sequence
  PCR primer for ORF amplification
aattacatgactcgagctacggcaactgcgcaataacaca

SEQ ID NO: 23365 - DNA, 40 bp, Artificial Sequence
  PCR primer for ORF amplification
aattacatgactcgagtcaccataacaacatttttctagg

SEQ ID NO: 23366 - DNA, 40 bp, Artificial Sequence
  PCR primer for ORF amplification
aattacatgactcgagttacaaataatttgcggaagtttc

SEQ ID NO: 23367 - DNA, 40 bp, Artificial Sequence
  PCR primer for ORF amplification
aattacatgactcgagctaatttaattgggatttcaaatt

SEQ ID NO: 23368 - DNA, 40 bp, Artificial Sequence
  PCR primer for ORF amplification
aattacatgactcgagctaaaattttaagctgcttagtgt

SEQ ID NO: 23369 - DNA, 40 bp, Artificial Sequence
  PCR primer for ORF amplification
aattacatgactcgagttatataggcgtaccatcaacctt

SEQ ID NO: 23370 - DNA, 40 bp, Artificial Sequence
  PCR primer for ORF amplification
aattacatgactcgagtcaatacatttctaactcttcctc

SEQ ID NO: 23371 - DNA, 40 bp, Artificial Sequence
  PCR primer for ORF amplification
aattacatgactcgagttatgatattgactcgacaaaatc

SEQ ID NO: 23372 - DNA, 40 bp, Artificial Sequence
  PCR primer for ORF amplification
aattacatgactcgagtcaatttgtaacgtgttcattttc

SEQ ID NO: 23373 - DNA, 40 bp, Artificial Sequence
  PCR primer for ORF amplification
aattacatgactcgagtcaagtttctgtgccaggcatacc

SEQ ID NO: 23374 - DNA, 40 bp, Artificial Sequence
  PCR primer for ORF amplification
aattacatgactcgagttacctgattttagaaaacaaatt

SEQ ID NO: 23375 - DNA, 40 bp, Artificial Sequence
  PCR primer for ORF amplification
aattacatgactcgagtcattgcaagtgggaacggccggc

SEQ ID NO: 23376 - DNA, 40 bp, Artificial Sequence
  PCR primer for ORF amplification
aattacatgactcgagctaatcctcgtcttcgtcgtcctc

SEQ ID NO: 23377 - DNA, 40 bp, Artificial Sequence
  PCR primer for ORF amplification
aattacatgactcgagttatatattaaaatcggtattagc

SEQ ID NO: 23378 - DNA, 40 bp, Artificial Sequence
  PCR primer for ORF amplification
aattacatgactcgagtcaattccagagcttgatagacct

SEQ ID NO: 23379 - DNA, 40 bp, Artificial Sequence
  PCR primer for ORF amplification
aattacatgactcgagtcacttaaatagcttcttcaattt

SEQ ID NO: 23380 - DNA, 40 bp, Artificial Sequence
  PCR primer for ORF amplification
aattacatgactcgagttacaatttcgaactcttaatatt

SEQ ID NO: 23381 - DNA, 40 bp, Artificial Sequence
  PCR primer for ORF amplification
aattacatgactcgagctattccggatttatcggctcgtt

SEQ ID NO: 23382 - DNA, 40 bp, Artificial Sequence
  PCR primer for ORF amplification
aattacatgactcgagttatttgtcatgaggaaacttctc

SEQ ID NO: 23383 - DNA, 40 bp, Artificial Sequence
  PCR primer for ORF amplification
aattacatgactcgagttatatgcttaaacctggcaatgt

SEQ ID NO: 23384 - DNA, 40 bp, Artificial Sequence
  PCR primer for ORF amplification
aattacatgactcgagttaaggaagcgcatctacatcttc

SEQ ID NO: 23385 - DNA, 40 bp, Artificial Sequence
  PCR primer for ORF amplification
aattacatgactcgagtcaatttgctgaaccactgctatc

SEQ ID NO: 23386 - DNA, 40 bp, Artificial Sequence
  PCR primer for ORF amplification
aattacatgactcgagctagcccgatggggttattataga

SEQ ID NO: 23387 - DNA, 40 bp, Artificial Sequence
  PCR primer for ORF amplification
aattacatgactcgagtcaatcgagttcagagtctatgta

SEQ ID NO: 23388 - DNA, 40 bp, Artificial Sequence
  PCR primer for ORF amplification
aattacatgactcgagtcacttttcgaacattttattgag

SEQ ID NO: 23389 - DNA, 40 bp, Artificial Sequence
  PCR primer for ORF amplification
aattacatgactcgagttactgttttaataaagtgtcgtt

SEQ ID NO: 23390 - DNA, 40 bp, Artificial Sequence
  PCR primer for ORF amplification
aattacatgactcgagttaatgcttcttccatctttgatc

SEQ ID NO: 23391 - DNA, 40 bp, Artificial Sequence
  PCR primer for ORF amplification
aattacatgactcgagtcaattggtgaaaaattccataag

SEQ ID NO: 23392 - DNA, 40 bp, Artificial Sequence
  PCR primer for ORF amplification
aattacatgactcgagtcaattatattgcatataacgcga

SEQ ID NO: 23393 - DNA, 40 bp, Artificial Sequence
  PCR primer for ORF amplification
aattacatgactcgagttaccctgtaaagtagtccataat

SEQ ID NO: 23394 - DNA, 40 bp, Artificial Sequence
  PCR primer for ORF amplification
aattacatgactcgagctataagacataacctaggatgac

SEQ ID NO: 23395 - DNA, 40 bp, Artificial Sequence
  PCR primer for ORF amplification
aattacatgactcgagttaatcgtcgtaacctctgccaat

SEQ ID NO: 23396 - DNA, 40 bp, Artificial Sequence
  PCR primer for ORF amplification
aattacatgactcgagtcactcgcctatgagctcaatatg

SEQ ID NO: 23397 - DNA, 40 bp, Artificial Sequence
  PCR primer for ORF amplification
aattacatgactcgagctattgtctcaatagactggcgtt

SEQ ID NO: 23398 - DNA, 40 bp, Artificial Sequence
  PCR primer for ORF amplification
aattacatgactcgagttattgttttaatagggtatcgtt

SEQ ID NO: 23399 - DNA, 40 bp, Artificial Sequence
  PCR primer for ORF amplification
aattacatgactcgagctagtataaatttaagtaatcttt

SEQ ID NO: 23400 - DNA, 40 bp, Artificial Sequence
  PCR primer for ORF amplification
aattacatgactcgagttagtcgaagcattctgtcttgcc

SEQ ID NO: 23401 - DNA, 40 bp, Artificial Sequence
  PCR primer for ORF amplification
aattacatgactcgagttaaggaattatgtcgtcttcatc

SEQ ID NO: 23402 - DNA, 40 bp, Artificial Sequence
  PCR primer for ORF amplification
aattacatgactcgagtcacaaatcgactggcgtaggatg

SEQ ID NO: 23403 - DNA, 40 bp, Artificial Sequence
  PCR primer for ORF amplification
aattacatgactcgagttattcaatttcttcaatcttgga

SEQ ID NO: 23404 - DNA, 40 bp, Artificial Sequence
  PCR primer for ORF amplification
aattacatgactcgagttattgattcactaaggatgcgtt

SEQ ID NO: 23405 - DNA, 40 bp, Artificial Sequence
  PCR primer for ORF amplification
aattacatgactcgagttattcaagttctactgatacttt

SEQ ID NO: 23406 - DNA, 40 bp, Artificial Sequence
  PCR primer for ORF amplification
aattacatgactcgagttaatatagcaatctaattgagat

SEQ ID NO: 23407 - DNA, 40 bp, Artificial Sequence
  PCR primer for ORF amplification
aattacatgactcgagtcacgtttgaacaggtgaataaaa

SEQ ID NO: 23408 - DNA, 40 bp, Artificial Sequence
  PCR primer for ORF amplification
aattacatgactcgagttacacagccaatgggtattcgcc

SEQ ID NO: 23409 - DNA, 40 bp, Artificial Sequence
  PCR primer for ORF amplification
aattacatgactcgagttagtttgcttggttcaaaaagtc

SEQ ID NO: 23410 - DNA, 40 bp, Artificial Sequence
  PCR primer for ORF amplification
aattacatgactcgagttagtataataacctgatggaaac

SEQ ID NO: 23411 - DNA, 40 bp, Artificial Sequence
  PCR primer for ORF amplification
aattacatgactcgagctatctgagttctacgctgtattc

SEQ ID NO: 23412 - DNA, 40 bp, Artificial Sequence
  PCR primer for ORF amplification
aattacatgactcgagtcaatttttcttgtcttctatcaa

SEQ ID NO: 23413 - DNA, 40 bp, Artificial Sequence
  PCR primer for ORF amplification
aattacatgactcgagttatttatgtataccagagcagaa

SEQ ID NO: 23414 - DNA, 40 bp, Artificial Sequence
  PCR primer for ORF amplification
aattacatgactcgagttagggaataatgtcgacttcatc

SEQ ID NO: 23415 - DNA, 40 bp, Artificial Sequence
  PCR primer for ORF amplification
aattacatgactcgagtcatttttgtccctttatatcaat

SEQ ID NO: 23416 - DNA, 40 bp, Artificial Sequence
  PCR primer for ORF amplification
aattacatgactcgagttaagggcctgcagtattttctga

SEQ ID NO: 23417 - DNA, 40 bp, Artificial Sequence
  PCR primer for ORF amplification
aattacatgactcgagttaattttctttatctttttcaga

SEQ ID NO: 23418 - DNA, 40 bp, Artificial Sequence
  PCR primer for ORF amplification
aattacatgactcgagttacagttcgtaaaacttcataag

SEQ ID NO: 23419 - DNA, 40 bp, Artificial Sequence
  PCR primer for ORF amplification
aattacatgactcgagttacttgcggtcattggcaataga

SEQ ID NO: 23420 - DNA, 40 bp, Artificial Sequence
  PCR primer for ORF amplification
aattacatgactcgagtcaagcatcatctatttctcgaaa

SEQ ID NO: 23421 - DNA, 40 bp, Artificial Sequence
  PCR primer for ORF amplification
aattacatgactcgagtcaagtaggcttgcgtgcatgcag

SEQ ID NO: 23422 - DNA, 40 bp, Artificial Sequence
  PCR primer for ORF amplification
aattacatgactcgagtcaatttacttgacgaatggtgta

SEQ ID NO: 23423 - DNA, 40 bp, Artificial Sequence
  PCR primer for ORF amplification
aattacatgactcgagttaacttttacttacaggaggtac

SEQ ID NO: 23424 - DNA, 40 bp, Artificial Sequence
  PCR primer for ORF amplification
aattacatgactcgagctaaaaaaataaactaaaagtaaa

SEQ ID NO: 23425 - DNA, 40 bp, Artificial Sequence
  PCR primer for ORF amplification
aattacatgactcgagctattgcttaagtaggtgtgagtc

SEQ ID NO: 23426 - DNA, 40 bp, Artificial Sequence
  PCR primer for ORF amplification
aattacatgactcgagtcagcttgtatctgagaattttct

SEQ ID NO: 23427 - DNA, 40 bp, Artificial Sequence
  PCR primer for ORF amplification
aattacatgactcgagtcactcatgcaatgtcataatatc

SEQ ID NO: 23428 - DNA, 40 bp, Artificial Sequence
  PCR primer for ORF amplification
aattacatgactcgagttattccgtagtatccatggcatc

SEQ ID NO: 23429 - DNA, 40 bp, Artificial Sequence
  PCR primer for ORF amplification
aattacatgactcgagtcataattcattaactgatttggc

SEQ ID NO: 23430 - DNA, 40 bp, Artificial Sequence
  PCR primer for ORF amplification
aattacatgactcgagtcatataataccaatttttttaag

SEQ ID NO: 23431 - DNA, 40 bp, Artificial Sequence
  PCR primer for ORF amplification
aattacatgactcgagtcatatgctcaatgatgccagtgt

SEQ ID NO: 23432 - DNA, 40 bp, Artificial Sequence
  PCR primer for ORF amplification
aattacatgactcgagtcaagggtctatgtcttcattatc

SEQ ID NO: 23433 - DNA, 40 bp, Artificial Sequence
  PCR primer for ORF amplification
aattacatgactcgagttaaaaatggatgtcggcacctaa

SEQ ID NO: 23434 - DNA, 40 bp, Artificial Sequence
  PCR primer for ORF amplification
aattacatgactcgagttagacaaatagtagcgaggacca

SEQ ID NO: 23435 - DNA, 40 bp, Artificial Sequence
  PCR primer for ORF amplification
aattacatgactcgagctagaaaacataaggaataaagac

SEQ ID NO: 23436 - DNA, 40 bp, Artificial Sequence
  PCR primer for ORF amplification
aattacatgactcgagttaatagtaattctcgtaatcaaa

SEQ ID NO: 23437 - DNA, 40 bp, Artificial Sequence
  PCR primer for ORF amplification
aattacatgactcgagttatactaatttatgatcaccgtc

SEQ ID NO: 23438 - DNA, 40 bp, Artificial Sequence
  PCR primer for ORF amplification
aattacatgactcgagttagactctcctaggtaattgttt

SEQ ID NO: 23439 - DNA, 40 bp, Artificial Sequence
  PCR primer for ORF amplification
aattacatgactcgagttactttcttcttgttagtatact

SEQ ID NO: 23440 - DNA, 40 bp, Artificial Sequence
  PCR primer for ORF amplification
aattacatgactcgagttacaagcccttcgatcttgctat

SEQ ID NO: 23441 - DNA, 40 bp, Artificial Sequence
  PCR primer for ORF amplification
aattacatgactcgagttatcttcttgttttaggtttcgc

SEQ ID NO: 23442 - DNA, 40 bp, Artificial Sequence
  PCR primer for ORF amplification
aattacatgactcgagtcatcctatatgtgtagcataatt

SEQ ID NO: 23443 - DNA, 40 bp, Artificial Sequence
  PCR primer for ORF amplification
aattacatgactcgagtcacatatcgtcatcaccagaatc

SEQ ID NO: 23444 - DNA, 40 bp, Artificial Sequence
  PCR primer for ORF amplification
aattacatgactcgagttacaaatcattccatccaaataa

SEQ ID NO: 23445 - DNA, 40 bp, Artificial Sequence
  PCR primer for ORF amplification
aattacatgactcgagttacgtcagccttattgtataatc

SEQ ID NO: 23446 - DNA, 40 bp, Artificial Sequence
  PCR primer for ORF amplification
aattacatgactcgagtcatgctcctactttgctttcttc

SEQ ID NO: 23447 - DNA, 40 bp, Artificial Sequence
  PCR primer for ORF amplification
aattacatgactcgagttaattgtataagacgaaatgagc

SEQ ID NO: 23448 - DNA, 40 bp, Artificial Sequence
  PCR primer for ORF amplification
aattacatgactcgagtcagttagttacgttcatgttcaa

SEQ ID NO: 23449 - DNA, 40 bp, Artificial Sequence
  PCR primer for ORF amplification
aattacatgactcgagttataatccgggaggcccttgcag

SEQ ID NO: 23450 - DNA, 40 bp, Artificial Sequence
  PCR primer for ORF amplification
aattacatgactcgagtcataggcctactctttttggaat

SEQ ID NO: 23451 - DNA, 40 bp, Artificial Sequence
  PCR primer for ORF amplification
aattacatgactcgagttatttggattcagcaatcttctt

SEQ ID NO: 23452 - DNA, 40 bp, Artificial Sequence
  PCR primer for ORF amplification
aattacatgactcgagttactgtgcatttctgattacatt

SEQ ID NO: 23453 - DNA, 40 bp, Artificial Sequence
  PCR primer for ORF amplification
aattacatgactcgagtcacttggtgattgacataccagc

SEQ ID NO: 23454 - DNA, 40 bp, Artificial Sequence
  PCR primer for ORF amplification
aattacatgactcgagctatttcttataaactaacatagc

SEQ ID NO: 23455 - DNA, 40 bp, Artificial Sequence
  PCR primer for ORF amplification
aattacatgactcgagctagtttgttgcgttcgtagcctg

SEQ ID NO: 23456 - DNA, 40 bp, Artificial Sequence
  PCR primer for ORF amplification
aattacatgactcgagttatttttctaatactataccact

SEQ ID NO: 23457 - DNA, 40 bp, Artificial Sequence
  PCR primer for ORF amplification
aattacatgactcgagtcatttctcgctcaagaaagtttg

SEQ ID NO: 23458 - DNA, 40 bp, Artificial Sequence
  PCR primer for ORF amplification
aattacatgactcgagtcacatatgggattttgattgatt

SEQ ID NO: 23459 - DNA, 40 bp, Artificial Sequence
  PCR primer for ORF amplification
aattacatgactcgagctaccaaaaaccatccaatttctt

SEQ ID NO: 23460 - DNA, 40 bp, Artificial Sequence
  PCR primer for ORF amplification
aattacatgactcgagttatattttttgtttcttagctcc

SEQ ID NO: 23461 - DNA, 40 bp, Artificial Sequence
  PCR primer for ORF amplification
aattacatgactcgagctagttgggggaaaggatcttgaa

SEQ ID NO: 23462 - DNA, 40 bp, Artificial Sequence
  PCR primer for ORF amplification
aattacatgactcgagttatattaccaaaacctgagagat

SEQ ID NO: 23463 - DNA, 40 bp, Artificial Sequence
  PCR primer for ORF amplification
aattacatgactcgagttagaaacacttgtggtgaacgat

SEQ ID NO: 23464 - DNA, 40 bp, Artificial Sequence
  PCR primer for ORF amplification
aattacatgactcgagttaataattaagatataaactgcc

SEQ ID NO: 23465 - DNA, 40 bp, Artificial Sequence
  PCR primer for ORF amplification
aattacatgactcgagttatttgaaggtatatccaatgat

SEQ ID NO: 23466 - DNA, 40 bp, Artificial Sequence
  PCR primer for ORF amplification
aattacatgactcgagtcaaagacccatacggtcaatgac

SEQ ID NO: 23467 - DNA, 40 bp, Artificial Sequence
  PCR primer for ORF amplification
aattacatgactcgagttaaatatctgattctggctcttc

SEQ ID NO: 23468 - DNA, 40 bp, Artificial Sequence
  PCR primer for ORF amplification
aattacatgactcgagtcattcgtgaatatcgctgaagta

SEQ ID NO: 23469 - DNA, 40 bp, Artificial Sequence
  PCR primer for ORF amplification
aattacatgactcgagtcattgtatgacaggtactcttct

SEQ ID NO: 23470 - DNA, 40 bp, Artificial Sequence
  PCR primer for ORF amplification
aattacatgactcgagctatgattgcaggtcttgtaagtg

SEQ ID NO: 23471 - DNA, 40 bp, Artificial Sequence
  PCR primer for ORF amplification
aattacatgactcgagttatttggtctcaattttaatatt

SEQ ID NO: 23472 - DNA, 40 bp, Artificial Sequence
  PCR primer for ORF amplification
aattacatgactcgagttagttcttactttcgattttctt

SEQ ID NO: 23473 - DNA, 40 bp, Artificial Sequence
  PCR primer for ORF amplification
aattacatgactcgagtcatttctcatttcctcctaatgt

SEQ ID NO: 23474 - DNA, 40 bp, Artificial Sequence
  PCR primer for ORF amplification
aattacatgactcgagtcatctgcaatctgcaatcttagt

SEQ ID NO: 23475 - DNA, 40 bp, Artificial Sequence
  PCR primer for ORF amplification
aattacatgactcgagtcattggtttatgtgggatttcca

SEQ ID NO: 23476 - DNA, 40 bp, Artificial Sequence
  PCR primer for ORF amplification
aattacatgactcgagtcacatcaaatcagaaaatcctgg

SEQ ID NO: 23477 - DNA, 40 bp, Artificial Sequence
  PCR primer for ORF amplification
aattacatgactcgagttatttatgacctgcatttttatc

SEQ ID NO: 23478 - DNA, 40 bp, Artificial Sequence
  PCR primer for ORF amplification
aattacatgactcgagctatatttggcagtgctgtccatc

SEQ ID NO: 23479 - DNA, 40 bp, Artificial Sequence
  PCR primer for ORF amplification
aattacatgactcgagctaaaccttttttttcttgcggac

SEQ ID NO: 23480 - DNA, 40 bp, Artificial Sequence
  PCR primer for ORF amplification
aattacatgactcgagttagttttctggcgattcagagta

SEQ ID NO: 23481 - DNA, 40 bp, Artificial Sequence
  PCR primer for ORF amplification
aattacatgactcgagtcatgcttcattgtaagactcctc

SEQ ID NO: 23482 - DNA, 40 bp, Artificial Sequence
  PCR primer for ORF amplification
aattacatgactcgagttatttcttttcgaaatagtccgc

SEQ ID NO: 23483 - DNA, 40 bp, Artificial Sequence
  PCR primer for ORF amplification
aattacatgactcgagctaatcctttaacactttcttaac

SEQ ID NO: 23484 - DNA, 40 bp, Artificial Sequence
  PCR primer for ORF amplification
aattacatgactcgagctagttcttgttgagttgcacgta

SEQ ID NO: 23485 - DNA, 40 bp, Artificial Sequence
  PCR primer for ORF amplification
aattacatgactcgagctaaacatttaacttgacttgttc

SEQ ID NO: 23486 - DNA, 40 bp, Artificial Sequence
  PCR primer for ORF amplification
aattacatgactcgagtcaaaaccaacccttcttcttggg

SEQ ID NO: 23487 - DNA, 40 bp, Artificial Sequence
  PCR primer for ORF amplification
aattacatgactcgagtcaaacgtcctcaaactcaatgtc

SEQ ID NO: 23488 - DNA, 40 bp, Artificial Sequence
  PCR primer for ORF amplification
aattacatgactcgagttattttttgtcctttttggccaa

SEQ ID NO: 23489 - DNA, 40 bp, Artificial Sequence
  PCR primer for ORF amplification
aattacatgactcgagttacctaatccttctaaacttatt

SEQ ID NO: 23490 - DNA, 40 bp, Artificial Sequence
  PCR primer for ORF amplification
aattacatgactcgagttaatcatccatttcatccgctct

SEQ ID NO: 23491 - DNA, 40 bp, Artificial Sequence
  PCR primer for ORF amplification
aattacatgactcgagtcacaatagcatttccaaaggatt

SEQ ID NO: 23492 - DNA, 40 bp, Artificial Sequence
  PCR primer for ORF amplification
aattacatgactcgagtcacacaagagtacttttgaaggc

SEQ ID NO: 23493 - DNA, 40 bp, Artificial Sequence
  PCR primer for ORF amplification
aattacatgactcgagtcatctcatagtaaccaattcttc

SEQ ID NO: 23494 - DNA, 40 bp, Artificial Sequence
  PCR primer for ORF amplification
aattacatgactcgagtcaattgacatcaatcattaaatc

SEQ ID NO: 23495 - DNA, 40 bp, Artificial Sequence
  PCR primer for ORF amplification
aattacatgactcgagttatagtcttccttgggagtacag

SEQ ID NO: 23496 - DNA, 40 bp, Artificial Sequence
  PCR primer for ORF amplification
aattacatgactcgagctacagccttacttgaaaattgcc

SEQ ID NO: 23497 - DNA, 40 bp, Artificial Sequence
  PCR primer for ORF amplification
aattacatgactcgagtcatttcttagatttcttagattt

SEQ ID NO: 23498 - DNA, 40 bp, Artificial Sequence
  PCR primer for ORF amplification
aattacatgactcgagttataaaaatgccagaccaagacc

SEQ ID NO: 23499 - DNA, 40 bp, Artificial Sequence
  PCR primer for ORF amplification
aattacatgactcgagctaatgtttatgggtgtgagtatc

SEQ ID NO: 23500 - DNA, 40 bp, Artificial Sequence
  PCR primer for ORF amplification
aattacatgactcgagctatagaagaagcccgctctttga

SEQ ID NO: 23501 - DNA, 40 bp, Artificial Sequence
  PCR primer for ORF amplification
aattacatgactcgagctaaaaatattttctatctaatcc

SEQ ID NO: 23502 - DNA, 40 bp, Artificial Sequence
  PCR primer for ORF amplification
aattacatgactcgagttagtctttctcactctctttctc

SEQ ID NO: 23503 - DNA, 40 bp, Artificial Sequence
  PCR primer for ORF amplification
aattacatgactcgagttatcttttgtgatagttcttctt

SEQ ID NO: 23504 - DNA, 40 bp, Artificial Sequence
  PCR primer for ORF amplification
aattacatgactcgagttatttctttgatttcgttttttt

SEQ ID NO: 23505 - DNA, 40 bp, Artificial Sequence
  PCR primer for ORF amplification
aattacatgactcgagttattcgcataattcatgaatgaa

SEQ ID NO: 23506 - DNA, 40 bp, Artificial Sequence
  PCR primer for ORF amplification
aattacatgactcgagtcaactcagagaggaattgttcac

SEQ ID NO: 23507 - DNA, 40 bp, Artificial Sequence
  PCR primer for ORF amplification
aattacatgactcgagtcataaaaccaagttataaagttc

SEQ ID NO: 23508 - DNA, 40 bp, Artificial Sequence
  PCR primer for ORF amplification
aattacatgactcgagttaagcgccaatgataccaagaga

SEQ ID NO: 23509 - DNA, 40 bp, Artificial Sequence
  PCR primer for ORF amplification
aattacatgactcgagtcacagaaaatcaatcattttgca

SEQ ID NO: 23510 - DNA, 40 bp, Artificial Sequence
  PCR primer for ORF amplification
aattacatgactcgagttaagtttctcttgcttccttcgt

SEQ ID NO: 23511 - DNA, 40 bp, Artificial Sequence
  PCR primer for ORF amplification
aattacatgactcgagttaaaattcctcttcctcagcgta

SEQ ID NO: 23512 - DNA, 40 bp, Artificial Sequence
  PCR primer for ORF amplification
aattacatgactcgagttaagcaccgatgataccaacgga

SEQ ID NO: 23513 - DNA, 40 bp, Artificial Sequence
  PCR primer for ORF amplification
aattacatgactcgagttagccgctcctcttggtctccgg

SEQ ID NO: 23514 - DNA, 40 bp, Artificial Sequence
  PCR primer for ORF amplification
aattacatgactcgagttactcaaccttgatatcggacaa

SEQ ID NO: 23515 - DNA, 40 bp, Artificial Sequence
  PCR primer for ORF amplification
aattacatgactcgagttaataaaagttcccatgcgattg

SEQ ID NO: 23516 - DNA, 40 bp, Artificial Sequence
  PCR primer for ORF amplification
aattacatgactcgagctaccccgaaccaaattctaaaag

SEQ ID NO: 23517 - DNA, 40 bp, Artificial Sequence
  PCR primer for ORF amplification
aattacatgactcgagtcatttaccatttctcaagtaata

SEQ ID NO: 23518 - DNA, 40 bp, Artificial Sequence
  PCR primer for ORF amplification
aattacatgactcgagttaaattctgagttttctactttt

SEQ ID NO: 23519 - DNA, 40 bp, Artificial Sequence
  PCR primer for ORF amplification
aattacatgactcgagttataatggtttcgaggctaactt

SEQ ID NO: 23520 - DNA, 40 bp, Artificial Sequence
  PCR primer for ORF amplification
aattacatgactcgagtcactgcaccccaataacgctcaa

SEQ ID NO: 23521 - DNA, 40 bp, Artificial Sequence
  PCR primer for ORF amplification
aattacatgactcgagttacaacttgttaacattgcttgc

SEQ ID NO: 23522 - DNA, 40 bp, Artificial Sequence
  PCR primer for ORF amplification
aattacatgactcgagctaccagttggtaacttcttcggc

SEQ ID NO: 23523 - DNA, 40 bp, Artificial Sequence
  PCR primer for ORF amplification
aattacatgactcgagtcaacaatttctccgacaacgctg

SEQ ID NO: 23524 - DNA, 40 bp, Artificial Sequence
  PCR primer for ORF amplification
aattacatgactcgagttaattgttaccgggtgggtcttt

SEQ ID NO: 23525 - DNA, 40 bp, Artificial Sequence
  PCR primer for ORF amplification
aattacatgactcgagttaaatgtcaatcttgaccgtctc

SEQ ID NO: 23526 - DNA, 40 bp, Artificial Sequence
  PCR primer for ORF amplification
aattacatgactcgagttattttttctttctacccccagc

SEQ ID NO: 23527 - DNA, 40 bp, Artificial Sequence
  PCR primer for ORF amplification
aattacatgactcgagtcatagtagcatggcggcaacagc

SEQ ID NO: 23528 - DNA, 40 bp, Artificial Sequence
  PCR primer for ORF amplification
aattacatgactcgagtcagtagccagcccaaacctcgct

SEQ ID NO: 23529 - DNA, 40 bp, Artificial Sequence
  PCR primer for ORF amplification
aattacatgactcgagtcaatcttccgttaagattccttt

SEQ ID NO: 23530 - DNA, 40 bp, Artificial Sequence
  PCR primer for ORF amplification
aattacatgactcgagttatttaggacctagcatgtgttc

SEQ ID NO: 23531 - DNA, 40 bp, Artificial Sequence
  PCR primer for ORF amplification
aattacatgactcgagctacttttcttgagtatcacgttt

SEQ ID NO: 23532 - DNA, 40 bp, Artificial Sequence
  PCR primer for ORF amplification
aattacatgactcgagctaaatctggtagacttgctggcc

SEQ ID NO: 23533 - DNA, 40 bp, Artificial Sequence
  PCR primer for ORF amplification
aattacatgactcgagctattttgctggctttttccaaaa

SEQ ID NO: 23534 - DNA, 40 bp, Artificial Sequence
  PCR primer for ORF amplification
aattacatgactcgagctagtgtttctttttaagtgttcc

SEQ ID NO: 23535 - DNA, 40 bp, Artificial Sequence
  PCR primer for ORF amplification
aattacatgactcgagttaaggaagaaacatcatctgttc

SEQ ID NO: 23536 - DNA, 40 bp, Artificial Sequence
  PCR primer for ORF amplification
aattacatgactcgagttaagaagagtccgcctggatatc

SEQ ID NO: 23537 - DNA, 40 bp, Artificial Sequence
  PCR primer for ORF amplification
aattacatgactcgagttattcatcatatagactggagct

SEQ ID NO: 23538 - DNA, 40 bp, Artificial Sequence
  PCR primer for ORF amplification
aattacatgactcgagttattccattatattctcgttaaa

SEQ ID NO: 23539 - DNA, 40 bp, Artificial Sequence
  PCR primer for ORF amplification
aattacatgactcgagtcatgcttcttttgcgtgatgcaa

SEQ ID NO: 23540 - DNA, 40 bp, Artificial Sequence
  PCR primer for ORF amplification
aattacatgactcgagctatggtctcaaagaggtgtttct

SEQ ID NO: 23541 - DNA, 40 bp, Artificial Sequence
  PCR primer for ORF amplification
aattacatgactcgagctatctaaacctatcgttaagcaa

SEQ ID NO: 23542 - DNA, 40 bp, Artificial Sequence
  PCR primer for ORF amplification
aattacatgactcgagttaagcttggtatgtagaggaaga

SEQ ID NO: 23543 - DNA, 40 bp, Artificial Sequence
  PCR primer for ORF amplification
aattacatgactcgagctatttgttgtgactaacaataag

SEQ ID NO: 23544 - DNA, 40 bp, Artificial Sequence
  PCR primer for ORF amplification
aattacatgactcgagttaatctctttcaaaacagacagc

SEQ ID NO: 23545 - DNA, 40 bp, Artificial Sequence
  PCR primer for ORF amplification
aattacatgactcgagttagtgatatgagtagccacatcc

SEQ ID NO: 23546 - DNA, 40 bp, Artificial Sequence
  PCR primer for ORF amplification
aattacatgactcgagttaaacgaatcctttctttattgc

SEQ ID NO: 23547 - DNA, 40 bp, Artificial Sequence
  PCR primer for ORF amplification
aattacatgactcgagttaggcttcatctgaacggttgaa

SEQ ID NO: 23548 - DNA, 40 bp, Artificial Sequence
  PCR primer for ORF amplification
aattacatgactcgagttatagcttaatgaatattctttt

SEQ ID NO: 23549 - DNA, 40 bp, Artificial Sequence
  PCR primer for ORF amplification
aattacatgactcgagttacatagcacctggaacacccaa

SEQ ID NO: 23550 - DNA, 40 bp, Artificial Sequence
  PCR primer for ORF amplification
aattacatgactcgagttagacaacaatttcagattctat

SEQ ID NO: 23551 - DNA, 40 bp, Artificial Sequence
  PCR primer for ORF amplification
aattacatgactcgagttagatatcacctgggacagggta

SEQ ID NO: 23552 - DNA, 40 bp, Artificial Sequence
  PCR primer for ORF amplification
aattacatgactcgagttaaactagttcaacgtaatttgc

SEQ ID NO: 23553 - DNA, 40 bp, Artificial Sequence
  PCR primer for ORF amplification
aattacatgactcgagttattttttaacatcgtaagatct

SEQ ID NO: 23554 - DNA, 40 bp, Artificial Sequence
  PCR primer for ORF amplification
aattacatgactcgagctacaaatttttcataaaatcacg

SEQ ID NO: 23555 - DNA, 40 bp, Artificial Sequence
  PCR primer for ORF amplification
aattacatgactcgagtcatttttccttcttctccacttg

SEQ ID NO: 23556 - DNA, 40 bp, Artificial Sequence
  PCR primer for ORF amplification
aattacatgactcgagtcaactaccagaacctattaattc

SEQ ID NO: 23557 - DNA, 40 bp, Artificial Sequence
  PCR primer for ORF amplification
aattacatgactcgagtcaaacgaggcagatttccctgga

SEQ ID NO: 23558 - DNA, 40 bp, Artificial Sequence
  PCR primer for ORF amplification
aattacatgactcgagttaccaggtgctcccaacagagac

SEQ ID NO: 23559 - DNA, 40 bp, Artificial Sequence
  PCR primer for ORF amplification
aattacatgactcgagttattttggagttccacattttct

SEQ ID NO: 23560 - DNA, 40 bp, Artificial Sequence
  PCR primer for ORF amplification
aattacatgactcgagctagtacctcacctcgtaagaacc

SEQ ID NO: 23561 - DNA, 40 bp, Artificial Sequence
  PCR primer for ORF amplification
aattacatgactcgagctagtaaagaataatactgtccaa

SEQ ID NO: 23562 - DNA, 40 bp, Artificial Sequence
  PCR primer for ORF amplification
aattacatgactcgagctagactacagtataaaaataaat

SEQ ID NO: 23563 - DNA, 40 bp, Artificial Sequence
  PCR primer for ORF amplification
aattacatgactcgagtcattcatgcaaggtcattatatc

SEQ ID NO: 23564 - DNA, 40 bp, Artificial Sequence
  PCR primer for ORF amplification
aattacatgactcgagtcacactttatctaattgtagttt

SEQ ID NO: 23565 - DNA, 40 bp, Artificial Sequence
  PCR primer for ORF amplification
aattacatgactcgagctaggttcttggatcttgctgatg

SEQ ID NO: 23566 - DNA, 40 bp, Artificial Sequence
  PCR primer for ORF amplification
aattacatgactcgagctattttcttctttcctttgggcg

SEQ ID NO: 23567 - DNA, 40 bp, Artificial Sequence
  PCR primer for ORF amplification
aattacatgactcgagttacgaaataagatcggctaaagc

SEQ ID NO: 23568 - DNA, 40 bp, Artificial Sequence
  PCR primer for ORF amplification
aattacatgactcgagtcaatgttctaatatattcaatat

SEQ ID NO: 23569 - DNA, 40 bp, Artificial Sequence
  PCR primer for ORF amplification
aattacatgactcgagttaacgcatttctattataaaaca

SEQ ID NO: 23570 - DNA, 40 bp, Artificial Sequence
  PCR primer for ORF amplification
aattacatgactcgagttacctattggcaggatcttcttg

SEQ ID NO: 23571 - DNA, 40 bp, Artificial Sequence
  PCR primer for ORF amplification
aattacatgactcgagctataaatcatcaaacttcttgat

SEQ ID NO: 23572 - DNA, 40 bp, Artificial Sequence
  PCR primer for ORF amplification
aattacatgactcgagtcatgtgtttcctaatgcctgtct

SEQ ID NO: 23573 - DNA, 40 bp, Artificial Sequence
  PCR primer for ORF amplification
aattacatgactcgagttaagcttggtaggttgaggaaga

SEQ ID NO: 23574 - DNA, 40 bp, Artificial Sequence
  PCR primer for ORF amplification
aattacatgactcgagtcaaaaatcgatggattctgcaga

SEQ ID NO: 23575 - DNA, 40 bp, Artificial Sequence
  PCR primer for ORF amplification
aattacatgactcgagttaattggagggatcagtaaaggt

SEQ ID NO: 23576 - DNA, 40 bp, Artificial Sequence
  PCR primer for ORF amplification
aattacatgactcgagttaatatccattcatatcctccag

SEQ ID NO: 23577 - DNA, 40 bp, Artificial Sequence
  PCR primer for ORF amplification
aattacatgactcgagttatatgccttctacaccgttcca

SEQ ID NO: 23578 - DNA, 40 bp, Artificial Sequence
  PCR primer for ORF amplification
aattacatgactcgagttattttcttaagtagtcccttaa

SEQ ID NO: 23579 - DNA, 40 bp, Artificial Sequence
  PCR primer for ORF amplification
aattacatgactcgagtcatgtggagtactggaattgtat

SEQ ID NO: 23580 - DNA, 40 bp, Artificial Sequence
  PCR primer for ORF amplification
aattacatgactcgagttattgtaataaactcttctcctt

SEQ ID NO: 23581 - DNA, 40 bp, Artificial Sequence
  PCR primer for ORF amplification
aattacatgactcgagttattcctccccatcggaattaat

SEQ ID NO: 23582 - DNA, 40 bp, Artificial Sequence
  PCR primer for ORF amplification
aattacatgactcgagttatctcatgaaaacgttagactt

SEQ ID NO: 23583 - DNA, 40 bp, Artificial Sequence
  PCR primer for ORF amplification
aattacatgactcgagctaaccatgaccggaaaaccaatt

SEQ ID NO: 23584 - DNA, 40 bp, Artificial Sequence
  PCR primer for ORF amplification
aattacatgactcgagctagcatttttcatcaataggact

SEQ ID NO: 23585 - DNA, 40 bp, Artificial Sequence
  PCR primer for ORF amplification
aattacatgactcgagttatacacataaggatgtgcatat

SEQ ID NO: 23586 - DNA, 40 bp, Artificial Sequence
  PCR primer for ORF amplification
aattacatgactcgagttacaaccaaattgactggccagc

SEQ ID NO: 23587 - DNA, 40 bp, Artificial Sequence
  PCR primer for ORF amplification
aattacatgactcgagttatgaatatgctgctgcgtattc

SEQ ID NO: 23588 - DNA, 40 bp, Artificial Sequence
  PCR primer for ORF amplification
aattacatgactcgagtcacttcttcacgcaaggacgttt

SEQ ID NO: 23589 - DNA, 40 bp, Artificial Sequence
  PCR primer for ORF amplification
aattacatgactcgagttagattgcaaaatgagcctgacg

SEQ ID NO: 23590 - DNA, 40 bp, Artificial Sequence
  PCR primer for ORF amplification
aattacatgactcgagtcagtttttggtggcagaggagct

SEQ ID NO: 23591 - DNA, 40 bp, Artificial Sequence
  PCR primer for ORF amplification
aattacatgactcgagctacagatattcatatcccttgta

SEQ ID NO: 23592 - DNA, 40 bp, Artificial Sequence
  PCR primer for ORF amplification
aattacatgactcgagttaatctaataaaatattttttaa

SEQ ID NO: 23593 - DNA, 40 bp, Artificial Sequence
  PCR primer for ORF amplification
aattacatgactcgagttaaaattgcacgtcccaaagagc

SEQ ID NO: 23594 - DNA, 40 bp, Artificial Sequence
  PCR primer for ORF amplification
aattacatgactcgagttatgtaaatttattatttttagt

SEQ ID NO: 23595 - DNA, 40 bp, Artificial Sequence
  PCR primer for ORF amplification
aattacatgactcgagtcaaatgtacttgtatgggtttaa

SEQ ID NO: 23596 - DNA, 40 bp, Artificial Sequence
  PCR primer for ORF amplification
aattacatgactcgagctaccatccatgctcgaacaacat

SEQ ID NO: 23597 - DNA, 40 bp, Artificial Sequence
  PCR primer for ORF amplification
aattacatgactcgagttaaccaatcaactcaccaaacaa

SEQ ID NO: 23598 - DNA, 40 bp, Artificial Sequence
  PCR primer for ORF amplification
aattacatgactcgagttaaatgctgtttggcaaattccc

SEQ ID NO: 23599 - DNA, 40 bp, Artificial Sequence
  PCR primer for ORF amplification
aattacatgactcgagttactccaaaaccttcttcttttt

SEQ ID NO: 23600 - DNA, 40 bp, Artificial Sequence
  PCR primer for ORF amplification
aattacatgactcgagctatctagttggatgccccagttt

SEQ ID NO: 23601 - DNA, 40 bp, Artificial Sequence
  PCR primer for ORF amplification
aattacatgactcgagctaaaaatattcttcatgcccttt

SEQ ID NO: 23602 - DNA, 40 bp, Artificial Sequence
  PCR primer for ORF amplification
aattacatgactcgagctatttatgaggcccgttattgtt

SEQ ID NO: 23603 - DNA, 40 bp, Artificial Sequence
  PCR primer for ORF amplification
aattacatgactcgagtcaatgacctgaccatttgatgga

SEQ ID NO: 23604 - DNA, 40 bp, Artificial Sequence
  PCR primer for ORF amplification
aattacatgactcgagttaagtataattatatgtacgatc

SEQ ID NO: 23605 - DNA, 40 bp, Artificial Sequence
  PCR primer for ORF amplification
aattacatgactcgagtcatacgttagctggaagttggaa

SEQ ID NO: 23606 - DNA, 40 bp, Artificial Sequence
  PCR primer for ORF amplification
aattacatgactcgagttacagaccaaatcctttatacat

SEQ ID NO: 23607 - DNA, 40 bp, Artificial Sequence
  PCR primer for ORF amplification
aattacatgactcgagttactgacttttcctgccgacctt

SEQ ID NO: 23608 - DNA, 40 bp, Artificial Sequence
  PCR primer for ORF amplification
aattacatgactcgagctattcccggacatgtacgccagg

SEQ ID NO: 23609 - DNA, 40 bp, Artificial Sequence
  PCR primer for ORF amplification
aattacatgactcgagtcaatgttccaagatttgcaaatt

SEQ ID NO: 23610 - DNA, 40 bp, Artificial Sequence
  PCR primer for ORF amplification
aattacatgactcgagttatactatatggtcagtgttctt

SEQ ID NO: 23611 - DNA, 40 bp, Artificial Sequence
  PCR primer for ORF amplification
aattacatgactcgagttatttatttacacgttcgtagta

SEQ ID NO: 23612 - DNA, 40 bp, Artificial Sequence
  PCR primer for ORF amplification
aattacatgactcgagtcaacaatgaatagctttatcata

SEQ ID NO: 23613 - DNA, 40 bp, Artificial Sequence
  PCR primer for ORF amplification
aattacatgactcgagctagtttctatcagggtcgaagtc

SEQ ID NO: 23614 - DNA, 40 bp, Artificial Sequence
  PCR primer for ORF amplification
aattacatgactcgagttacaacttaattctgacagcttt

SEQ ID NO: 23615 - DNA, 40 bp, Artificial Sequence
  PCR primer for ORF amplification
aattacatgactcgagctatttggaaataccaaattcttc

SEQ ID NO: 23616 - DNA, 40 bp, Artificial Sequence
  PCR primer for ORF amplification
aattacatgactcgagttatttccatcttaagccatcgtt

SEQ ID NO: 23617 - DNA, 40 bp, Artificial Sequence
  PCR primer for ORF amplification
aattacatgactcgagtcattttaaatcattctttccaat

SEQ ID NO: 23618 - DNA, 40 bp, Artificial Sequence
  PCR primer for ORF amplification
aattacatgactcgagttattctatttcagggtcaagctt

SEQ ID NO: 23619 - DNA, 40 bp, Artificial Sequence
  PCR primer for ORF amplification
aattacatgactcgagtcatgctacaagcgcacacaaggc

SEQ ID NO: 23620 - DNA, 40 bp, Artificial Sequence
  PCR primer for ORF amplification
aattacatgactcgagttatgccaccagagcacacaaagc

SEQ ID NO: 23621 - DNA, 40 bp, Artificial Sequence
  PCR primer for ORF amplification
aattacatgactcgagttaaacggtagagacttgcaaagt

SEQ ID NO: 23622 - DNA, 40 bp, Artificial Sequence
  PCR primer for ORF amplification
aattacatgactcgagtcaatccatcaagatggaatactg

SEQ ID NO: 23623 - DNA, 40 bp, Artificial Sequence
  PCR primer for ORF amplification
aattacatgactcgagtcagtacaattttgctatgttatc

SEQ ID NO: 23624 - DNA, 40 bp, Artificial Sequence
  PCR primer for ORF amplification
aattacatgactcgagttaatacttattaaactcatctaa

SEQ ID NO: 23625 - DNA, 40 bp, Artificial Sequence
  PCR primer for ORF amplification
aattacatgactcgagttagtttaaaccctcttttttggc

SEQ ID NO: 23626 - DNA, 40 bp, Artificial Sequence
  PCR primer for ORF amplification
aattacatgactcgagttaaactttataggcaaaaatctc

SEQ ID NO: 23627 - DNA, 40 bp, Artificial Sequence
  PCR primer for ORF amplification
aattacatgactcgagtcaaaacccttcaagagcctttgt

SEQ ID NO: 23628 - DNA, 40 bp, Artificial Sequence
  PCR primer for ORF amplification
aattacatgactcgagctacctttctcccatgtccatatt

SEQ ID NO: 23629 - DNA, 40 bp, Artificial Sequence
  PCR primer for ORF amplification
aattacatgactcgagtcaatcacaaccaaaatactttga

SEQ ID NO: 23630 - DNA, 40 bp, Artificial Sequence
  PCR primer for ORF amplification
aattacatgactcgagttaaaacttacaaagcttcgcacc

SEQ ID NO: 23631 - DNA, 40 bp, Artificial Sequence
  PCR primer for ORF amplification
aattacatgactcgagtcacacttggtctaaaatttcctt

SEQ ID NO: 23632 - DNA, 40 bp, Artificial Sequence
  PCR primer for ORF amplification
aattacatgactcgagctatgtaaatactacacaacaaag

SEQ ID NO: 23633 - DNA, 40 bp, Artificial Sequence
  PCR primer for ORF amplification
aattacatgactcgagtcagaacttctcttgttccatgtt

SEQ ID NO: 23634 - DNA, 40 bp, Artificial Sequence
  PCR primer for ORF amplification
aattacatgactcgagttatttcttgtgtttccgtttacg

SEQ ID NO: 23635 - DNA, 40 bp, Artificial Sequence
  PCR primer for ORF amplification
aattacatgactcgagttacaggacaccaaagggtttggg

SEQ ID NO: 23636 - DNA, 40 bp, Artificial Sequence
  PCR primer for ORF amplification
aattacatgactcgagctaaaaaattatcgagaacaatac

SEQ ID NO: 23637 - DNA, 40 bp, Artificial Sequence
  PCR primer for ORF amplification
aattacatgactcgagtcagagaaacctgctgtcacacca

SEQ ID NO: 23638 - DNA, 40 bp, Artificial Sequence
  PCR primer for ORF amplification
aattacatgactcgagtcaataatctggtaaccatttctc

SEQ ID NO: 23639 - DNA, 40 bp, Artificial Sequence
  PCR primer for ORF amplification
aattacatgactcgagttactgttgtttctttcgtggctg

SEQ ID NO: 23640 - DNA, 40 bp, Artificial Sequence
  PCR primer for ORF amplification
aattacatgactcgagttatttatatccgtaccttttcca

SEQ ID NO: 23641 - DNA, 40 bp, Artificial Sequence
  PCR primer for ORF amplification
aattacatgactcgagttatatttcttcataagggtagga

SEQ ID NO: 23642 - DNA, 40 bp, Artificial Sequence
  PCR primer for ORF amplification
aattacatgactcgagtcagcgcaaagaactattattgga

SEQ ID NO: 23643 - DNA, 40 bp, Artificial Sequence
  PCR primer for ORF amplification
aattacatgactcgagttagggtgtcaatgcaacaatatt

SEQ ID NO: 23644 - DNA, 40 bp, Artificial Sequence
  PCR primer for ORF amplification
aattacatgactcgagtcaagtgaaaagggcactcgctag

SEQ ID NO: 23645 - DNA, 40 bp, Artificial Sequence
  PCR primer for ORF amplification
aattacatgactcgagtcacatttgctcactatataaaat

SEQ ID NO: 23646 - DNA, 40 bp, Artificial Sequence
  PCR primer for ORF amplification
aattacatgactcgagttattcgtacaagtcttcgtccaa

SEQ ID NO: 23647 - DNA, 40 bp, Artificial Sequence
  PCR primer for ORF amplification
aattacatgactcgagttagaagtctgtcatttcaactga

SEQ ID NO: 23648 - DNA, 40 bp, Artificial Sequence
  PCR primer for ORF amplification
aattacatgactcgagtcagatagtttggtagttggagga

SEQ ID NO: 23649 - DNA, 40 bp, Artificial Sequence
  PCR primer for ORF amplification
aattacatgactcgagtcagtccatgtgtgggaagggcaa

SEQ ID NO: 23650 - DNA, 40 bp, Artificial Sequence
  PCR primer for ORF amplification
aattacatgactcgagttaatccttacttttcttcttttt

SEQ ID NO: 23651 - DNA, 40 bp, Artificial Sequence
  PCR primer for ORF amplification
aattacatgactcgagttaaaaatcaatcaatgagccagt

SEQ ID NO: 23652 - DNA, 40 bp, Artificial Sequence
  PCR primer for ORF amplification
aattacatgactcgagttattgctgtagggcaatttgctc

SEQ ID NO: 23653 - DNA, 40 bp, Artificial Sequence
  PCR primer for ORF amplification
aattacatgactcgagctaattatccttcgtatcttctgg

SEQ ID NO: 23654 - DNA, 40 bp, Artificial Sequence
  PCR primer for ORF amplification
aattacatgactcgagttattttgaaatagtactgaatgg

SEQ ID NO: 23655 - DNA, 40 bp, Artificial Sequence
  PCR primer for ORF amplification
aattacatgactcgagttattttaagctatgcactttctc

SEQ ID NO: 23656 - DNA, 40 bp, Artificial Sequence
  PCR primer for ORF amplification
aattacatgactcgagtcataaagctatattttcaaattc

SEQ ID NO: 23657 - DNA, 40 bp, Artificial Sequence
  PCR primer for ORF amplification
aattacatgactcgagttacttatgagttttacgtctttt

SEQ ID NO: 23658 - DNA, 40 bp, Artificial Sequence
  PCR primer for ORF amplification
aattacatgactcgagttagttgtccaaagagagatttat

SEQ ID NO: 23659 - DNA, 40 bp, Artificial Sequence
  PCR primer for ORF amplification
aattacatgactcgagttatttatccaatgaaagatccac

SEQ ID NO: 23660 - DNA, 40 bp, Artificial Sequence
  PCR primer for ORF amplification
aattacatgactcgagctagaattcttgaccaacagtaga

SEQ ID NO: 23661 - DNA, 40 bp, Artificial Sequence
  PCR primer for ORF amplification
aattacatgactcgagttattgaatggcattagtgttatt

SEQ ID NO: 23662 - DNA, 40 bp, Artificial Sequence
  PCR primer for ORF amplification
aattacatgactcgagttatgaacattcaaagatggatcc

SEQ ID NO: 23663 - DNA, 40 bp, Artificial Sequence
  PCR primer for ORF amplification
aattacatgactcgagctagtcaacagtgtcggcagtatg

SEQ ID NO: 23664 - DNA, 40 bp, Artificial Sequence
  PCR primer for ORF amplification
aattacatgactcgagttatatcccatccttttccttttc

SEQ ID NO: 23665 - DNA, 40 bp, Artificial Sequence
  PCR primer for ORF amplification
aattacatgactcgagttaatactggggttgtgactgacc

SEQ ID NO: 23666 - DNA, 40 bp, Artificial Sequence
  PCR primer for ORF amplification
aattacatgactcgagttatagcaaggctagtaaagctac

SEQ ID NO: 23667 - DNA, 40 bp, Artificial Sequence
  PCR primer for ORF amplification
aattacatgactcgagttagttttctgtgagagaaatgtc

SEQ ID NO: 23668 - DNA, 40 bp, Artificial Sequence
  PCR primer for ORF amplification
aattacatgactcgagctattcagatattaggagaacatc

SEQ ID NO: 23669 - DNA, 40 bp, Artificial Sequence
  PCR primer for ORF amplification
aattacatgactcgagtcaattacgatacttgctgaagaa

SEQ ID NO: 23670 - DNA, 40 bp, Artificial Sequence
  PCR primer for ORF amplification
aattacatgactcgagttaagctgatcctacgatatcggc

SEQ ID NO: 23671 - DNA, 40 bp, Artificial Sequence
  PCR primer for ORF amplification
aattacatgactcgagttatgctaagtagctcagtaaatc

SEQ ID NO: 23672 - DNA, 40 bp, Artificial Sequence
  PCR primer for ORF amplification
aattacatgactcgagtcattgtgggttctgctgctgctc

SEQ ID NO: 23673 - DNA, 40 bp, Artificial Sequence
  PCR primer for ORF amplification
aattacatgactcgagtcactcacttgagtcttcatcact

SEQ ID NO: 23674 - DNA, 40 bp, Artificial Sequence
  PCR primer for ORF amplification
aattacatgactcgagttacgaaaagaaaacggaaaggat

SEQ ID NO: 23675 - DNA, 40 bp, Artificial Sequence
  PCR primer for ORF amplification
aattacatgactcgagctaactagcattttccaaggtgga

SEQ ID NO: 23676 - DNA, 40 bp, Artificial Sequence
  PCR primer for ORF amplification
aattacatgactcgagctatttcagtaagtcagagattcg

SEQ ID NO: 23677 - DNA, 40 bp, Artificial Sequence
  PCR primer for ORF amplification
aattacatgactcgagttaatctttccagcacttcctcac

SEQ ID NO: 23678 - DNA, 40 bp, Artificial Sequence
  PCR primer for ORF amplification
aattacatgactcgagttagtatgtaggcttagtaaccca

SEQ ID NO: 23679 - DNA, 40 bp, Artificial Sequence
  PCR primer for ORF amplification
aattacatgactcgagttagctagttaaaggaatgttcag

SEQ ID NO: 23680 - DNA, 40 bp, Artificial Sequence
  PCR primer for ORF amplification
aattacatgactcgagtcaatgttcttgccgtacaaattc

SEQ ID NO: 23681 - DNA, 40 bp, Artificial Sequence
  PCR primer for ORF amplification
aattacatgactcgagttaactctgctttgctgccactaa

SEQ ID NO: 23682 - DNA, 40 bp, Artificial Sequence
  PCR primer for ORF amplification
aattacatgactcgagttacatagttatatcgtgatctgt

SEQ ID NO: 23683 - DNA, 40 bp, Artificial Sequence
  PCR primer for ORF amplification
aattacatgactcgagctataaattcagattcaaccaatc

SEQ ID NO: 23684 - DNA, 40 bp, Artificial Sequence
  PCR primer for ORF amplification
aattacatgactcgagttaaaagaacttaccagtttcgta

SEQ ID NO: 23685 - DNA, 40 bp, Artificial Sequence
  PCR primer for ORF amplification
aattacatgactcgagtcaataatctgcacaattatataa

SEQ ID NO: 23686 - DNA, 40 bp, Artificial Sequence
  PCR primer for ORF amplification
aattacatgactcgagtcaaatatgagtattcgtatggtc

SEQ ID NO: 23687 - DNA, 40 bp, Artificial Sequence
  PCR primer for ORF amplification
aattacatgactcgagttaaaatacaaaaaagccattgtc

SEQ ID NO: 23688 - DNA, 40 bp, Artificial Sequence
  PCR primer for ORF amplification
aattacatgactcgagttattcacgagaaatcggcatatc

SEQ ID NO: 23689 - DNA, 40 bp, Artificial Sequence
  PCR primer for ORF amplification
aattacatgactcgagttatttcttctctttcttctcttt

SEQ ID NO: 23690 - DNA, 40 bp, Artificial Sequence
  PCR primer for ORF amplification
aattacatgactcgagttaattttttttgtcacctttgat

SEQ ID NO: 23691 - DNA, 40 bp, Artificial Sequence
  PCR primer for ORF amplification
aattacatgactcgagtcattgctttcttgaatccaaatg

SEQ ID NO: 23692 - DNA, 40 bp, Artificial Sequence
  PCR primer for ORF amplification
aattacatgactcgagctagttggcttcagcggctaactt

SEQ ID NO: 23693 - DNA, 40 bp, Artificial Sequence
  PCR primer for ORF amplification
aattacatgactcgagttagacactgattgttttccagac

SEQ ID NO: 23694 - DNA, 40 bp, Artificial Sequence
  PCR primer for ORF amplification
aattacatgactcgagttacagtggtgccacttggtcctc

SEQ ID NO: 23695 - DNA, 40 bp, Artificial Sequence
  PCR primer for ORF amplification
aattacatgactcgagctaccttttgatgtgaacgtttac

SEQ ID NO: 23696 - DNA, 40 bp, Artificial Sequence
  PCR primer for ORF amplification
aattacatgactcgagctatcggaaaggatttgaaatttc

SEQ ID NO: 23697 - DNA, 40 bp, Artificial Sequence
  PCR primer for ORF amplification
aattacatgactcgagtcagtcgtattcttggagacagtc

SEQ ID NO: 23698 - DNA, 40 bp, Artificial Sequence
  PCR primer for ORF amplification
aattacatgactcgagttaccagaagaatatcttgttctt

SEQ ID NO: 23699 - DNA, 40 bp, Artificial Sequence
  PCR primer for ORF amplification
aattacatgactcgagttaaatcaactttttggctgccac

SEQ ID NO: 23700 - DNA, 40 bp, Artificial Sequence
  PCR primer for ORF amplification
aattacatgactcgagttagttgaaccctaatatgctttt

SEQ ID NO: 23701 - DNA, 40 bp, Artificial Sequence
  PCR primer for ORF amplification
aattacatgactcgagtcaacttttatagttgtcaaaaaa

SEQ ID NO: 23702 - DNA, 40 bp, Artificial Sequence
  PCR primer for ORF amplification
aattacatgactcgagttattgtttctttttcaactttct

SEQ ID NO: 23703 - DNA, 40 bp, Artificial Sequence
  PCR primer for ORF amplification
aattacatgactcgagttagaggcaagataattctgagta

SEQ ID NO: 23704 - DNA, 40 bp, Artificial Sequence
  PCR primer for ORF amplification
aattacatgactcgagctataatcctttaaaaaagtctct

SEQ ID NO: 23705 - DNA, 40 bp, Artificial Sequence
  PCR primer for ORF amplification
aattacatgactcgagttatacatcaagttccagatcagc

SEQ ID NO: 23706 - DNA, 40 bp, Artificial Sequence
  PCR primer for ORF amplification
aattacatgactcgagctacattaaaaagctattgacgct

SEQ ID NO: 23707 - DNA, 40 bp, Artificial Sequence
  PCR primer for ORF amplification
aattacatgactcgagctataaaccaaaaccaccattaga

SEQ ID NO: 23708 - DNA, 40 bp, Artificial Sequence
  PCR primer for ORF amplification
aattacatgactcgagttaagattttaagctcattaataa

SEQ ID NO: 23709 - DNA, 40 bp, Artificial Sequence
  PCR primer for ORF amplification
aattacatgactcgagctagtgaaggaaaggtttcaaaat

SEQ ID NO: 23710 - DNA, 40 bp, Artificial Sequence
  PCR primer for ORF amplification
aattacatgactcgagttaactcgttaaaagttgaagcat

SEQ ID NO: 23711 - DNA, 40 bp, Artificial Sequence
  PCR primer for ORF amplification
aattacatgactcgagctaatccattttgttataaatagc

SEQ ID NO: 23712 - DNA, 40 bp, Artificial Sequence
  PCR primer for ORF amplification
aattacatgactcgagttataatttcattttagcaagttc

SEQ ID NO: 23713 - DNA, 40 bp, Artificial Sequence
  PCR primer for ORF amplification
aattacatgactcgagtcacaactcgccgaattcatcgta

SEQ ID NO: 23714 - DNA, 40 bp, Artificial Sequence
  PCR primer for ORF amplification
aattacatgactcgagtcaatcatcccatgcatacggcga

SEQ ID NO: 23715 - DNA, 40 bp, Artificial Sequence
  PCR primer for ORF amplification
aattacatgactcgagtcaattcatcctatgcagacaggc

SEQ ID NO: 23716 - DNA, 40 bp, Artificial Sequence
  PCR primer for ORF amplification
aattacatgactcgagtcaacgctgtggtgggtacgatat

SEQ ID NO: 23717 - DNA, 40 bp, Artificial Sequence
  PCR primer for ORF amplification
aattacatgactcgagctatagttgtaactctaaatcaca

SEQ ID NO: 23718 - DNA, 40 bp, Artificial Sequence
  PCR primer for ORF amplification
aattacatgactcgagttaattaaacccatggtcacccag

SEQ ID NO: 23719 - DNA, 40 bp, Artificial Sequence
  PCR primer for ORF amplification
aattacatgactcgagctagtcctttctttttaggggttg

SEQ ID NO: 23720 - DNA, 40 bp, Artificial Sequence
  PCR primer for ORF amplification
aattacatgactcgagttattctataaaatgctgcttttc

SEQ ID NO: 23721 - DNA, 40 bp, Artificial Sequence
  PCR primer for ORF amplification
aattacatgactcgagtcaatgcgtccacaatcttaccat

SEQ ID NO: 23722 - DNA, 40 bp, Artificial Sequence
  PCR primer for ORF amplification
aattacatgactcgagtcaaaatttggagttactcgaaag

SEQ ID NO: 23723 - DNA, 40 bp, Artificial Sequence
  PCR primer for ORF amplification
aattacatgactcgagtcaatgggttgatctttccgattg

SEQ ID NO: 23724 - DNA, 40 bp, Artificial Sequence
  PCR primer for ORF amplification
aattacatgactcgagttaacagagatttcccaaacattc

SEQ ID NO: 23725 - DNA, 40 bp, Artificial Sequence
  PCR primer for ORF amplification
aattacatgactcgagttatagtagttcgatggagtacac

SEQ ID NO: 23726 - DNA, 40 bp, Artificial Sequence
  PCR primer for ORF amplification
aattacatgactcgagtcaggttgggtacattttgataga

SEQ ID NO: 23727 - DNA, 40 bp, Artificial Sequence
  PCR primer for ORF amplification
aattacatgactcgagttagttcatagccttaaccaattt

SEQ ID NO: 23728 - DNA, 40 bp, Artificial Sequence
  PCR primer for ORF amplification
aattacatgactcgagctattcgccaaaaaatatcgcact

SEQ ID NO: 23729 - DNA, 40 bp, Artificial Sequence
  PCR primer for ORF amplification
aattacatgactcgagtcatccctcagtaaacaaatccat

SEQ ID NO: 23730 - DNA, 40 bp, Artificial Sequence
  PCR primer for ORF amplification
aattacatgactcgagctattcaataaaggattcgaagca

SEQ ID NO: 23731 - DNA, 40 bp, Artificial Sequence
  PCR primer for ORF amplification
aattacatgactcgagctacctgataataaagtcaattat

SEQ ID NO: 23732 - DNA, 40 bp, Artificial Sequence
  PCR primer for ORF amplification
aattacatgactcgagttataattcatcatgtacggtatc

SEQ ID NO: 23733 - DNA, 40 bp, Artificial Sequence
  PCR primer for ORF amplification
aattacatgactcgagctattcaattactctaaaattttc

SEQ ID NO: 23734 - DNA, 40 bp, Artificial Sequence
  PCR primer for ORF amplification
aattacatgactcgagttagattagagattcttcttggct

SEQ ID NO: 23735 - DNA, 40 bp, Artificial Sequence
  PCR primer for ORF amplification
aattacatgactcgagttacgatgggctgttaaccttctg

SEQ ID NO: 23736 - DNA, 40 bp, Artificial Sequence
  PCR primer for ORF amplification
aattacatgactcgagttatgggcgtaaagcttctcgttc

SEQ ID NO: 23737 - DNA, 40 bp, Artificial Sequence
  PCR primer for ORF amplification
aattacatgactcgagtcaactttgatcgacctgtctgac

SEQ ID NO: 23738 - DNA, 40 bp, Artificial Sequence
  PCR primer for ORF amplification
aattacatgactcgagttactgctgagattcaacgggtgt

SEQ ID NO: 23739 - DNA, 40 bp, Artificial Sequence
  PCR primer for ORF amplification
aattacatgactcgagtcaagaaaaacttagagtatcagc

SEQ ID NO: 23740 - DNA, 40 bp, Artificial Sequence
  PCR primer for ORF amplification
aattacatgactcgagtcaagctgattgaattttacattt

SEQ ID NO: 23741 - DNA, 40 bp, Artificial Sequence
  PCR primer for ORF amplification
aattacatgactcgagttaactcgccatttcagtatatgt

SEQ ID NO: 23742 - DNA, 40 bp, Artificial Sequence
  PCR primer for ORF amplification
aattacatgactcgagctacttgtcaaattcagactgacg

SEQ ID NO: 23743 - DNA, 40 bp, Artificial Sequence
  PCR primer for ORF amplification
aattacatgactcgagtcaaaattgtgacccaaagttgtc

SEQ ID NO: 23744 - DNA, 40 bp, Artificial Sequence
  PCR primer for ORF amplification
aattacatgactcgagtcaatcaaatttgatcttcttacc

SEQ ID NO: 23745 - DNA, 40 bp, Artificial Sequence
  PCR primer for ORF amplification
aattacatgactcgagtcaaagagtaattaatttttcaca

SEQ ID NO: 23746 - DNA, 40 bp, Artificial Sequence
  PCR primer for ORF amplification
aattacatgactcgagttatatgctttccatataatgttc

SEQ ID NO: 23747 - DNA, 40 bp, Artificial Sequence
  PCR primer for ORF amplification
aattacatgactcgagttactcgtccaatttggcacggac

SEQ ID NO: 23748 - DNA, 40 bp, Artificial Sequence
  PCR primer for ORF amplification
aattacatgactcgagttattgttcgtacaaacaagtacc

SEQ ID NO: 23749 - DNA, 40 bp, Artificial Sequence
  PCR primer for ORF amplification
aattacatgactcgagttattccatcattgtatcttgatc

SEQ ID NO: 23750 - DNA, 40 bp, Artificial Sequence
  PCR primer for ORF amplification
aattacatgactcgagctaacgtaaaaatcccttcttctt

SEQ ID NO: 23751 - DNA, 40 bp, Artificial Sequence
  PCR primer for ORF amplification
aattacatgactcgagtcaacgaattggcttgtcaatggc

SEQ ID NO: 23752 - DNA, 40 bp, Artificial Sequence
  PCR primer for ORF amplification
aattacatgactcgagttaaacccactgaaaaaacccaca

SEQ ID NO: 23753 - DNA, 40 bp, Artificial Sequence
  PCR primer for ORF amplification
aattacatgactcgagttatgttaagcttctcttgggaat

SEQ ID NO: 23754 - DNA, 40 bp, Artificial Sequence
  PCR primer for ORF amplification
aattacatgactcgagttacaactcgtatttggtgcagaa

SEQ ID NO: 23755 - DNA, 40 bp, Artificial Sequence
  PCR primer for ORF amplification
aattacatgactcgagttatttcaaaaccttaccgtcaac

SEQ ID NO: 23756 - DNA, 40 bp, Artificial Sequence
  PCR primer for ORF amplification
aattacatgactcgagctaaagttttttacccaaaatgga

SEQ ID NO: 23757 - DNA, 40 bp, Artificial Sequence
  PCR primer for ORF amplification
aattacatgactcgagttaaaatctgacccacttgaagcc

SEQ ID NO: 23758 - DNA, 40 bp, Artificial Sequence
  PCR primer for ORF amplification
aattacatgactcgagttatttggtcggcctcttccagaa

SEQ ID NO: 23759 - DNA, 40 bp, Artificial Sequence
  PCR primer for ORF amplification
aattacatgactcgagttacaattcatcgtgaatggcatc

SEQ ID NO: 23760 - DNA, 40 bp, Artificial Sequence
  PCR primer for ORF amplification
aattacatgactcgagtcattcttcctgctttatggttcc

SEQ ID NO: 23761 - DNA, 40 bp, Artificial Sequence
  PCR primer for ORF amplification
aattacatgactcgagtcaattgaatatattttctaggtc

SEQ ID NO: 23762 - DNA, 40 bp, Artificial Sequence
  PCR primer for ORF amplification
aattacatgactcgagttaaggatggctatcaacatcctt

SEQ ID NO: 23763 - DNA, 40 bp, Artificial Sequence
  PCR primer for ORF amplification
aattacatgactcgagctagtttccgaactgtcttagata

SEQ ID NO: 23764 - DNA, 40 bp, Artificial Sequence
  PCR primer for ORF amplification
aattacatgactcgagttagtaaatgtacctgaaatttct

SEQ ID NO: 23765 - DNA, 40 bp, Artificial Sequence
  PCR primer for ORF amplification
aattacatgactcgagttaataagcagatctatcaattaa

SEQ ID NO: 23766 - DNA, 40 bp, Artificial Sequence
  PCR primer for ORF amplification
aattacatgactcgagctaatcgaaagtaattttttttgg

SEQ ID NO: 23767 - DNA, 40 bp, Artificial Sequence
  PCR primer for ORF amplification
aattacatgactcgagttattttgttggagagggagacac

SEQ ID NO: 23768 - DNA, 40 bp, Artificial Sequence
  PCR primer for ORF amplification
aattacatgactcgagtcatacggccttcttgctatcgcg

SEQ ID NO: 23769 - DNA, 40 bp, Artificial Sequence
  PCR primer for ORF amplification
aattacatgactcgagtcaaaggacgcggacgttttgaaa

SEQ ID NO: 23770 - DNA, 40 bp, Artificial Sequence
  PCR primer for ORF amplification
aattacatgactcgagtcagttatgtaaacgcttttcgta

SEQ ID NO: 23771 - DNA, 40 bp, Artificial Sequence
  PCR primer for ORF amplification
aattacatgactcgagttagttatgtaaacgcttttcgta

SEQ ID NO: 23772 - DNA, 40 bp, Artificial Sequence
  PCR primer for ORF amplification
aattacatgactcgagttataagaatcccaaatcgtcgag

SEQ ID NO: 23773 - DNA, 40 bp, Artificial Sequence
  PCR primer for ORF amplification
aattacatgactcgagttatattttaatcttgtgcaaaag

SEQ ID NO: 23774 - DNA, 40 bp, Artificial Sequence
  PCR primer for ORF amplification
aattacatgactcgagttaagaaaggatggtggcgtcgaa

SEQ ID NO: 23775 - DNA, 40 bp, Artificial Sequence
  PCR primer for ORF amplification
aattacatgactcgagtcaatagtgcattaactctcccat

SEQ ID NO: 23776 - DNA, 40 bp, Artificial Sequence
  PCR primer for ORF amplification
aattacatgactcgagtcaagcaaacataaaaccattact

SEQ ID NO: 23777 - DNA, 40 bp, Artificial Sequence
  PCR primer for ORF amplification
aattacatgactcgagtcataagctattctcacctgctac

SEQ ID NO: 23778 - DNA, 40 bp, Artificial Sequence
  PCR primer for ORF amplification
aattacatgactcgagtcagagtagagcagaaatcagacc

SEQ ID NO: 23779 - DNA, 40 bp, Artificial Sequence
  PCR primer for ORF amplification
aattacatgactcgagtcactcatagtagtcccattcttc

SEQ ID NO: 23780 - DNA, 40 bp, Artificial Sequence
  PCR primer for ORF amplification
aattacatgactcgagtcaaggttgaaaatttaaacgatc

SEQ ID NO: 23781 - DNA, 40 bp, Artificial Sequence
  PCR primer for ORF amplification
aattacatgactcgagttaagaaactctaacgtagtttgc

SEQ ID NO: 23782 - DNA, 40 bp, Artificial Sequence
  PCR primer for ORF amplification
aattacatgactcgagtcaacagcaacaaaaacagcaaca

SEQ ID NO: 23783 - DNA, 40 bp, Artificial Sequence
  PCR primer for ORF amplification
aattacatgactcgagctaagggcctaaaaggagagcttt

SEQ ID NO: 23784 - DNA, 40 bp, Artificial Sequence
  PCR primer for ORF amplification
aattacatgactcgagttaaaatatatttttaaagataga

SEQ ID NO: 23785 - DNA, 40 bp, Artificial Sequence
  PCR primer for ORF amplification
aattacatgactcgagtcaaaagtacttctccaaatagct

SEQ ID NO: 23786 - DNA, 40 bp, Artificial Sequence
  PCR primer for ORF amplification
aattacatgactcgagttatttatgtagtcctgaacaatg

SEQ ID NO: 23787 - DNA, 40 bp, Artificial Sequence
  PCR primer for ORF amplification
aattacatgactcgagtcaccatattattctttgcaaata

SEQ ID NO: 23788 - DNA, 40 bp, Artificial Sequence
  PCR primer for ORF amplification
aattacatgactcgagtcattcccattcaacagttgcagg

SEQ ID NO: 23789 - DNA, 40 bp, Artificial Sequence
  PCR primer for ORF amplification
aattacatgactcgagtcagttcatttccgtatcttgttc

SEQ ID NO: 23790 - DNA, 40 bp, Artificial Sequence
  PCR primer for ORF amplification
aattacatgactcgagttatgaacaattcctattttcttt

SEQ ID NO: 23791 - DNA, 40 bp, Artificial Sequence
  PCR primer for ORF amplification
aattacatgactcgagttattttcctatacaaaatttgct

SEQ ID NO: 23792 - DNA, 40 bp, Artificial Sequence
  PCR primer for ORF amplification
aattacatgactcgagctagtcaactggttcccagctgtc

SEQ ID NO: 23793 - DNA, 40 bp, Artificial Sequence
  PCR primer for ORF amplification
aattacatgactcgagttatctttcatccactgcgaccga

SEQ ID NO: 23794 - DNA, 40 bp, Artificial Sequence
  PCR primer for ORF amplification
aattacatgactcgagttaaccagcatgttcgaaaacagc

SEQ ID NO: 23795 - DNA, 40 bp, Artificial Sequence
  PCR primer for ORF amplification
aattacatgactcgagttataatgcggaaaaaatgaataa

SEQ ID NO: 23796 - DNA, 40 bp, Artificial Sequence
  PCR primer for ORF amplification
aattacatgactcgagctattgtggtttcttgtgtttcat

SEQ ID NO: 23797 - DNA, 40 bp, Artificial Sequence
  PCR primer for ORF amplification
aattacatgactcgagctagtcggacaactcactaggatc

SEQ ID NO: 23798 - DNA, 40 bp, Artificial Sequence
  PCR primer for ORF amplification
aattacatgactcgagttaagaagggacaccttctagctc

SEQ ID NO: 23799 - DNA, 40 bp, Artificial Sequence
  PCR primer for ORF amplification
aattacatgactcgagctatgcaagcggatcaaaaaacca

SEQ ID NO: 23800 - DNA, 40 bp, Artificial Sequence
  PCR primer for ORF amplification
aattacatgactcgagtcagttgggaattaggataatatc

SEQ ID NO: 23801 - DNA, 40 bp, Artificial Sequence
  PCR primer for ORF amplification
aattacatgactcgagttaagcgatgggttccaatgtagt

SEQ ID NO: 23802 - DNA, 40 bp, Artificial Sequence
  PCR primer for ORF amplification
aattacatgactcgagttacatatgttgtctattggcggt

SEQ ID NO: 23803 - DNA, 40 bp, Artificial Sequence
  PCR primer for ORF amplification
aattacatgactcgagttaaattccaagtcttttcaattg

SEQ ID NO: 23804 - DNA, 40 bp, Artificial Sequence
  PCR primer for ORF amplification
aattacatgactcgagtcagcctatatgccctctttgctt

SEQ ID NO: 23805 - DNA, 40 bp, Artificial Sequence
  PCR primer for ORF amplification
aattacatgactcgagttaggaaagttgggttgcttccat

SEQ ID NO: 23806 - DNA, 40 bp, Artificial Sequence
  PCR primer for ORF amplification
aattacatgactcgagtcacatggcgatactgcctctctg

SEQ ID NO: 23807 - DNA, 40 bp, Artificial Sequence
  PCR primer for ORF amplification
aattacatgactcgagttacaaaaagataacggcagcgag

SEQ ID NO: 23808 - DNA, 40 bp, Artificial Sequence
  PCR primer for ORF amplification
aattacatgactcgagtcaggcaaaattaatattgtaatc

SEQ ID NO: 23809 - DNA, 40 bp, Artificial Sequence
  PCR primer for ORF amplification
aattacatgactcgagttataattcatatagacagctgcc

SEQ ID NO: 23810 - DNA, 40 bp, Artificial Sequence
  PCR primer for ORF amplification
aattacatgactcgagctaatccaaccttctttcactttc

SEQ ID NO: 23811 - DNA, 40 bp, Artificial Sequence
  PCR primer for ORF amplification
aattacatgactcgagttatttatgcgatactagatgctt

SEQ ID NO: 23812 - DNA, 40 bp, Artificial Sequence
  PCR primer for ORF amplification
aattacatgactcgagtcaatatccattaatatcatggtc

SEQ ID NO: 23813 - DNA, 40 bp, Artificial Sequence
  PCR primer for ORF amplification
aattacatgactcgagttaacgaccaaagtacttgagctc

SEQ ID NO: 23814 - DNA, 40 bp, Artificial Sequence
  PCR primer for ORF amplification
aattacatgactcgagttatttatcatcatcgtcattatt

SEQ ID NO: 23815 - DNA, 40 bp, Artificial Sequence
  PCR primer for ORF amplification
aattacatgactcgagttaacggctgaatgcaatatcatc

SEQ ID NO: 23816 - DNA, 40 bp, Artificial Sequence
  PCR primer for ORF amplification
aattacatgactcgagctaatgattaccattattgaatag

SEQ ID NO: 23817 - DNA, 40 bp, Artificial Sequence
  PCR primer for ORF amplification
aattacatgactcgagttataggtcattccaaccaaataa

SEQ ID NO: 23818 - DNA, 40 bp, Artificial Sequence
  PCR primer for ORF amplification
aattacatgactcgagtcacagttgtgtccaggagtagta

SEQ ID NO: 23819 - DNA, 40 bp, Artificial Sequence
  PCR primer for ORF amplification
aattacatgactcgagttacaatagaatataacccagtgc

SEQ ID NO: 23820 - DNA, 40 bp, Artificial Sequence
  PCR primer for ORF amplification
aattacatgactcgagtcaattgagtatgggcatgaagtt

SEQ ID NO: 23821 - DNA, 40 bp, Artificial Sequence
  PCR primer for ORF amplification
aattacatgactcgagttatactgaaaaccttgcttgaga

SEQ ID NO: 23822 - DNA, 40 bp, Artificial Sequence
  PCR primer for ORF amplification
aattacatgactcgagtcacaccaaaccttgcttcttaag

SEQ ID NO: 23823 - DNA, 40 bp, Artificial Sequence
  PCR primer for ORF amplification
aattacatgactcgagtcaaagtacagcaagaatattctg

SEQ ID NO: 23824 - DNA, 40 bp, Artificial Sequence
  PCR primer for ORF amplification
aattacatgactcgagtcaaaatgccctgcctgccatagg

SEQ ID NO: 23825 - DNA, 40 bp, Artificial Sequence
  PCR primer for ORF amplification
aattacatgactcgagtcatcgaccgaaatatttgagttc

SEQ ID NO: 23826 - DNA, 40 bp, Artificial Sequence
  PCR primer for ORF amplification
aattacatgactcgagtcaaatgtatttgtaagggtttaa

SEQ ID NO: 23827 - DNA, 40 bp, Artificial Sequence
  PCR primer for ORF amplification
aattacatgactcgagttagatcttttgttctggatttct

SEQ ID NO: 23828 - DNA, 40 bp, Artificial Sequence
  PCR primer for ORF amplification
aattacatgactcgagttaacccatgacataaccaatatt

SEQ ID NO: 23829 - DNA, 40 bp, Artificial Sequence
  PCR primer for ORF amplification
aattacatgactcgagttacaaaggatatataaaagtttc

SEQ ID NO: 23830 - DNA, 40 bp, Artificial Sequence
  PCR primer for ORF amplification
aattacatgactcgagttataaggagaaaccaccgtggat

SEQ ID NO: 23831 - DNA, 40 bp, Artificial Sequence
  PCR primer for ORF amplification
aattacatgactcgagctattttacttcccttacttggaa

SEQ ID NO: 23832 - DNA, 40 bp, Artificial Sequence
  PCR primer for ORF amplification
aattacatgactcgagttatgtagtacttctatcattttt

SEQ ID NO: 23833 - DNA, 40 bp, Artificial Sequence
  PCR primer for ORF amplification
aattacatgactcgagtcaggaagaacaatgagcgtaaat

SEQ ID NO: 23834 - DNA, 40 bp, Artificial Sequence
  PCR primer for ORF amplification
aattacatgactcgagtcaaatatggcctatatggtcgct

SEQ ID NO: 23835 - DNA, 40 bp, Artificial Sequence
  PCR primer for ORF amplification
aattacatgactcgagttacaacaatctctcttcgaatct

SEQ ID NO: 23836 - DNA, 40 bp, Artificial Sequence
  PCR primer for ORF amplification
aattacatgactcgagttaggagataacagtggccgtgta

SEQ ID NO: 23837 - DNA, 40 bp, Artificial Sequence
  PCR primer for ORF amplification
aattacatgactcgagttagtgtactggtcttggaggata

SEQ ID NO: 23838 - DNA, 40 bp, Artificial Sequence
  PCR primer for ORF amplification
aattacatgactcgagctaacgaccgaagtattttaattc

SEQ ID NO: 23839 - DNA, 40 bp, Artificial Sequence
  PCR primer for ORF amplification
aattacatgactcgagctaatacatgtacttaaactcagg

SEQ ID NO: 23840 - DNA, 40 bp, Artificial Sequence
  PCR primer for ORF amplification
aattacatgactcgagttacctattatatggatggtagcc

SEQ ID NO: 23841 - DNA, 40 bp, Artificial Sequence
  PCR primer for ORF amplification
aattacatgactcgagttattcttgttttcttacaccact

SEQ ID NO: 23842 - DNA, 40 bp, Artificial Sequence
  PCR primer for ORF amplification
aattacatgactcgagtcatctttgtaaatcccttaacat

SEQ ID NO: 23843 - DNA, 40 bp, Artificial Sequence
  PCR primer for ORF amplification
aattacatgactcgagtcaaccaaagatttggatatcatc

SEQ ID NO: 23844 - DNA, 40 bp, Artificial Sequence
  PCR primer for ORF amplification
aattacatgactcgagtcatttgttttcctttttcatagc

SEQ ID NO: 23845 - DNA, 40 bp, Artificial Sequence
  PCR primer for ORF amplification
aattacatgactcgagttaaaaaataagtttagtgtctaa

SEQ ID NO: 23846 - DNA, 40 bp, Artificial Sequence
  PCR primer for ORF amplification
aattacatgactcgagtcataattcatcttcaccatcaat

SEQ ID NO: 23847 - DNA, 40 bp, Artificial Sequence
  PCR primer for ORF amplification
aattacatgactcgagttatatggctacaactgaaccttc

SEQ ID NO: 23848 - DNA, 40 bp, Artificial Sequence
  PCR primer for ORF amplification
aattacatgactcgagttaaagcgacgcaaattcgccgat

SEQ ID NO: 23849 - DNA, 40 bp, Artificial Sequence
  PCR primer for ORF amplification
aattacatgactcgagttactctgattgtcttctcttctc

SEQ ID NO: 23850 - DNA, 40 bp, Artificial Sequence
  PCR primer for ORF amplification
aattacatgactcgagctaaacgattacgtggaaacctga

SEQ ID NO: 23851 - DNA, 40 bp, Artificial Sequence
  PCR primer for ORF amplification
aattacatgactcgagttaagagattttcttgataacgaa

SEQ ID NO: 23852 - DNA, 40 bp, Artificial Sequence
  PCR primer for ORF amplification
aattacatgactcgagttactttttctctctttgcaagaa

SEQ ID NO: 23853 - DNA, 40 bp, Artificial Sequence
  PCR primer for ORF amplification
aattacatgactcgagttataaaagaaaataagatatgaa

SEQ ID NO: 23854 - DNA, 40 bp, Artificial Sequence
  PCR primer for ORF amplification
aattacatgactcgagttaaataatcaagaagtcggccct

SEQ ID NO: 23855 - DNA, 40 bp, Artificial Sequence
  PCR primer for ORF amplification
aattacatgactcgagctaaggagacatttccggaaagga

SEQ ID NO: 23856 - DNA, 40 bp, Artificial Sequence
  PCR primer for ORF amplification
aattacatgactcgagttattcgaagacttctccagtaat

SEQ ID NO: 23857 - DNA, 40 bp, Artificial Sequence
  PCR primer for ORF amplification
aattacatgactcgagttaatggaatgggtttctgaaaag

SEQ ID NO: 23858 - DNA, 40 bp, Artificial Sequence
  PCR primer for ORF amplification
aattacatgactcgagtcaccttgcattaggaaacctcaa

SEQ ID NO: 23859 - DNA, 40 bp, Artificial Sequence
  PCR primer for ORF amplification
aattacatgactcgagttagcaacaacctaatttttggaa

SEQ ID NO: 23860 - DNA, 40 bp, Artificial Sequence
  PCR primer for ORF amplification
aattacatgactcgagctataattcaccctttacagcatt

SEQ ID NO: 23861 - DNA, 40 bp, Artificial Sequence
  PCR primer for ORF amplification
aattacatgactcgagttaattttccatatcgcctatttc

SEQ ID NO: 23862 - DNA, 40 bp, Artificial Sequence
  PCR primer for ORF amplification
aattacatgactcgagttatagtaaggcaacgccaacagc

SEQ ID NO: 23863 - DNA, 40 bp, Artificial Sequence
  PCR primer for ORF amplification
aattacatgactcgagtcaaaaggtatatagggacttgaa

SEQ ID NO: 23864 - DNA, 40 bp, Artificial Sequence
  PCR primer for ORF amplification
aattacatgactcgagtcacacattctggtgactcaattt

SEQ ID NO: 23865 - DNA, 40 bp, Artificial Sequence
  PCR primer for ORF amplification
aattacatgactcgagttatttttttgtattcaagcttgc

SEQ ID NO: 23866 - DNA, 40 bp, Artificial Sequence
  PCR primer for ORF amplification
aattacatgactcgagttatttgcttagctgtaaggcgtc

SEQ ID NO: 23867 - DNA, 40 bp, Artificial Sequence
  PCR primer for ORF amplification
aattacatgactcgagtcatatgatcatctcttcatcgct

SEQ ID NO: 23868 - DNA, 40 bp, Artificial Sequence
  PCR primer for ORF amplification
aattacatgactcgagctactccggttcaaatattttatt

SEQ ID NO: 23869 - DNA, 40 bp, Artificial Sequence
  PCR primer for ORF amplification
aattacatgactcgagtcacaacgtccttatttcacagtc

SEQ ID NO: 23870 - DNA, 40 bp, Artificial Sequence
  PCR primer for ORF amplification
aattacatgactcgagttatttgaatttcttcaaagaagc

SEQ ID NO: 23871 - DNA, 40 bp, Artificial Sequence
  PCR primer for ORF amplification
aattacatgactcgagttatgcctccaaacttctatcttc

SEQ ID NO: 23872 - DNA, 40 bp, Artificial Sequence
  PCR primer for ORF amplification
aattacatgactcgagttaaaattctatcccataagcttt

SEQ ID NO: 23873 - DNA, 40 bp, Artificial Sequence
  PCR primer for ORF amplification
aattacatgactcgagttagcccataccgaattgttttgc

SEQ ID NO: 23874 - DNA, 40 bp, Artificial Sequence
  PCR primer for ORF amplification
aattacatgactcgagttattcctcggaaactcttttttc

SEQ ID NO: 23875 - DNA, 40 bp, Artificial Sequence
  PCR primer for ORF amplification
aattacatgactcgagttaccattgaatatttaagatctc

SEQ ID NO: 23876 - DNA, 40 bp, Artificial Sequence
  PCR primer for ORF amplification
aattacatgactcgagttacgttttatttttatatttttt

SEQ ID NO: 23877 - DNA, 40 bp, Artificial Sequence
  PCR primer for ORF amplification
aattacatgactcgagttagaggtgctgaaatacttcgtc

SEQ ID NO: 23878 - DNA, 40 bp, Artificial Sequence
  PCR primer for ORF amplification
aattacatgactcgagttatggaaaatattcaatcacacc

SEQ ID NO: 23879 - DNA, 40 bp, Artificial Sequence
  PCR primer for ORF amplification
aattacatgactcgagttaaagctcatcatgttcgatgaa

SEQ ID NO: 23880 - DNA, 40 bp, Artificial Sequence
  PCR primer for ORF amplification
aattacatgactcgagttagttaaaattgaattgttggtt

SEQ ID NO: 23881 - DNA, 40 bp, Artificial Sequence
  PCR primer for ORF amplification
aattacatgactcgagttaatttactcccagttcttgctt

SEQ ID NO: 23882 - DNA, 40 bp, Artificial Sequence
  PCR primer for ORF amplification
aattacatgactcgagctaagccacagtgcaatcgtattc

SEQ ID NO: 23883 - DNA, 40 bp, Artificial Sequence
  PCR primer for ORF amplification
aattacatgactcgagctagtgaataaacctataatcaag

SEQ ID NO: 23884 - DNA, 40 bp, Artificial Sequence
  PCR primer for ORF amplification
aattacatgactcgagttaatagtcatcacaagggggagg

SEQ ID NO: 23885 - DNA, 40 bp, Artificial Sequence
  PCR primer for ORF amplification
aattacatgactcgagtcattgttgctttttggctgatat

SEQ ID NO: 23886 - DNA, 40 bp, Artificial Sequence
  PCR primer for ORF amplification
aattacatgactcgagctacaacttactcttatttctgct

SEQ ID NO: 23887 - DNA, 40 bp, Artificial Sequence
  PCR primer for ORF amplification
aattacatgactcgagctatatactcattctaatgcctgc

SEQ ID NO: 23888 - DNA, 40 bp, Artificial Sequence
  PCR primer for ORF amplification
aattacatgactcgagtcatgacaaaatccacctcttggc

SEQ ID NO: 23889 - DNA, 40 bp, Artificial Sequence
  PCR primer for ORF amplification
aattacatgactcgagtcataaagtgtatctgaaatttgg

SEQ ID NO: 23890 - DNA, 40 bp, Artificial Sequence
  PCR primer for ORF amplification
aattacatgactcgagctaaggttcttcagtaaacatttc

SEQ ID NO: 23891 - DNA, 40 bp, Artificial Sequence
  PCR primer for ORF amplification
aattacatgactcgagctacaagtccttcatggatttgct

SEQ ID NO: 23892 - DNA, 40 bp, Artificial Sequence
  PCR primer for ORF amplification
aattacatgactcgagttagtcgttctcatgacgagcaag

SEQ ID NO: 23893 - DNA, 40 bp, Artificial Sequence
  PCR primer for ORF amplification
aattacatgactcgagctaattagctgccgcttccggttg

SEQ ID NO: 23894 - DNA, 40 bp, Artificial Sequence
  PCR primer for ORF amplification
aattacatgactcgagttagaactcctcagcgtaagaatc

SEQ ID NO: 23895 - DNA, 40 bp, Artificial Sequence
  PCR primer for ORF amplification
aattacatgactcgagctacacggaggaatcccttccaag

SEQ ID NO: 23896 - DNA, 40 bp, Artificial Sequence
  PCR primer for ORF amplification
aattacatgactcgagttatatactcatgcgtatgccctc

SEQ ID NO: 23897 - DNA, 40 bp, Artificial Sequence
  PCR primer for ORF amplification
aattacatgactcgagctatattacttgggtattgcccat

SEQ ID NO: 23898 - DNA, 40 bp, Artificial Sequence
  PCR primer for ORF amplification
aattacatgactcgagttaaaaagtggcaacaaatgattc

SEQ ID NO: 23899 - DNA, 40 bp, Artificial Sequence
  PCR primer for ORF amplification
aattacatgactcgagtcacagttgagagctattgtggtt

SEQ ID NO: 23900 - DNA, 40 bp, Artificial Sequence
  PCR primer for ORF amplification
aattacatgactcgagctacaggtattttggtagtatggc

SEQ ID NO: 23901 - DNA, 40 bp, Artificial Sequence
  PCR primer for ORF amplification
aattacatgactcgagttataatcctttaattaaacgagt

SEQ ID NO: 23902 - DNA, 40 bp, Artificial Sequence
  PCR primer for ORF amplification
aattacatgactcgagctaacacagacatggctttttcac

SEQ ID NO: 23903 - DNA, 40 bp, Artificial Sequence
  PCR primer for ORF amplification
aattacatgactcgagttacataaagtttaacgtgtctga

SEQ ID NO: 23904 - DNA, 40 bp, Artificial Sequence
  PCR primer for ORF amplification
aattacatgactcgagctattggacaagatattcatctga

SEQ ID NO: 23905 - DNA, 40 bp, Artificial Sequence
  PCR primer for ORF amplification
aattacatgactcgagttatttactatcaacaataactaa

SEQ ID NO: 23906 - DNA, 40 bp, Artificial Sequence
  PCR primer for ORF amplification
aattacatgactcgagttactgtggtgtttctttcaaagt

SEQ ID NO: 23907 - DNA, 40 bp, Artificial Sequence
  PCR primer for ORF amplification
aattacatgactcgagctaacagcatcctagcttactgaa

SEQ ID NO: 23908 - DNA, 40 bp, Artificial Sequence
  PCR primer for ORF amplification
aattacatgactcgagttactctcttattattcccacacc

SEQ ID NO: 23909 - DNA, 40 bp, Artificial Sequence
  PCR primer for ORF amplification
aattacatgactcgagttaatttccgggcgggttgttatt

SEQ ID NO: 23910 - DNA, 40 bp, Artificial Sequence
  PCR primer for ORF amplification
aattacatgactcgagctacagggaatttgcagttgctct

SEQ ID NO: 23911 - DNA, 40 bp, Artificial Sequence
  PCR primer for ORF amplification
aattacatgactcgagctatatataaactgttgaaagtat

SEQ ID NO: 23912 - DNA, 40 bp, Artificial Sequence
  PCR primer for ORF amplification
aattacatgactcgagctacgtatcgtccaatggatgaat

SEQ ID NO: 23913 - DNA, 40 bp, Artificial Sequence
  PCR primer for ORF amplification
aattacatgactcgagttactgcttgataccactagaaac

SEQ ID NO: 23914 - DNA, 40 bp, Artificial Sequence
  PCR primer for ORF amplification
aattacatgactcgagttactttacatctattctatcaaa

SEQ ID NO: 23915 - DNA, 40 bp, Artificial Sequence
  PCR primer for ORF amplification
aattacatgactcgagtcagcccctttcctcctcttctaa

SEQ ID NO: 23916 - DNA, 40 bp, Artificial Sequence
  PCR primer for ORF amplification
aattacatgactcgagctactcctctgtgtacgaagatct

SEQ ID NO: 23917 - DNA, 40 bp, Artificial Sequence
  PCR primer for ORF amplification
aattacatgactcgagtcattctttatttagagcatccag

SEQ ID NO: 23918 - DNA, 40 bp, Artificial Sequence
  PCR primer for ORF amplification
aattacatgactcgagtcatgctgccgccgcgaagggatc

SEQ ID NO: 23919 - DNA, 40 bp, Artificial Sequence
  PCR primer for ORF amplification
aattacatgactcgagctattctacaccaagttgttgcgc

SEQ ID NO: 23920 - DNA, 40 bp, Artificial Sequence
  PCR primer for ORF amplification
aattacatgactcgagctagtccacattattctctatttc

SEQ ID NO: 23921 - DNA, 40 bp, Artificial Sequence
  PCR primer for ORF amplification
aattacatgactcgagctacaacgaccaacctgtggtcag

SEQ ID NO: 23922 - DNA, 40 bp, Artificial Sequence
  PCR primer for ORF amplification
aattacatgactcgagttagaggtgtacttctttgcccgt

SEQ ID NO: 23923 - DNA, 40 bp, Artificial Sequence
  PCR primer for ORF amplification
aattacatgactcgagctatattttgctaaaaagccaaga

SEQ ID NO: 23924 - DNA, 40 bp, Artificial Sequence
  PCR primer for ORF amplification
aattacatgactcgagctacactttggttttgtataactt

SEQ ID NO: 23925 - DNA, 40 bp, Artificial Sequence
  PCR primer for ORF amplification
aattacatgactcgagttacatgactttctttgaaccttc

SEQ ID NO: 23926 - DNA, 40 bp, Artificial Sequence
  PCR primer for ORF amplification
aattacatgactcgagttacccaaaagtgtcaaacgtact

SEQ ID NO: 23927 - DNA, 40 bp, Artificial Sequence
  PCR primer for ORF amplification
aattacatgactcgagctacaaactctgtaaaacttcttg

SEQ ID NO: 23928 - DNA, 40 bp, Artificial Sequence
  PCR primer for ORF amplification
aattacatgactcgagttactcgaattgaggaccagcggc

SEQ ID NO: 23929 - DNA, 40 bp, Artificial Sequence
  PCR primer for ORF amplification
aattacatgactcgagttacattggcatacctctccctct

SEQ ID NO: 23930 - DNA, 40 bp, Artificial Sequence
  PCR primer for ORF amplification
aattacatgactcgagttatatgccatgcatcctgctttc

SEQ ID NO: 23931 - DNA, 40 bp, Artificial Sequence
  PCR primer for ORF amplification
aattacatgactcgagttacctaaatccgtaaggattgtt

SEQ ID NO: 23932 - DNA, 40 bp, Artificial Sequence
  PCR primer for ORF amplification
aattacatgactcgagtcattcatattctagagcggcggt

SEQ ID NO: 23933 - DNA, 40 bp, Artificial Sequence
  PCR primer for ORF amplification
aattacatgactcgagctactcgtattctagcgcagcggt

SEQ ID NO: 23934 - DNA, 40 bp, Artificial Sequence
  PCR primer for ORF amplification
aattacatgactcgagttatttagtggacatgcccaaaag

SEQ ID NO: 23935 - DNA, 40 bp, Artificial Sequence
  PCR primer for ORF amplification
aattacatgactcgagtcaatctctacccgatgcaataga

SEQ ID NO: 23936 - DNA, 40 bp, Artificial Sequence
  PCR primer for ORF amplification
aattacatgactcgagtcattctgcagctttgcaaattcc

SEQ ID NO: 23937 - DNA, 40 bp, Artificial Sequence
  PCR primer for ORF amplification
aattacatgactcgagttatttcttgatggagccacttat

SEQ ID NO: 23938 - DNA, 40 bp, Artificial Sequence
  PCR primer for ORF amplification
aattacatgactcgagtcaatcagttttttcatcttgttt

SEQ ID NO: 23939 - DNA, 40 bp, Artificial Sequence
  PCR primer for ORF amplification
aattacatgactcgagtcaaatatcgtgaacggaaatttt

SEQ ID NO: 23940 - DNA, 40 bp, Artificial Sequence
  PCR primer for ORF amplification
aattacatgactcgagttaatagttcgtgatatttaagcc

SEQ ID NO: 23941 - DNA, 40 bp, Artificial Sequence
  PCR primer for ORF amplification
aattacatgactcgagctatcctcctttattcccttcttg

SEQ ID NO: 23942 - DNA, 40 bp, Artificial Sequence
  PCR primer for ORF amplification
aattacatgactcgagctagatatgctggataaatttatc

SEQ ID NO: 23943 - DNA, 40 bp, Artificial Sequence
  PCR primer for ORF amplification
aattacatgactcgagttacaaatctaatagcagggaccc

SEQ ID NO: 23944 - DNA, 40 bp, Artificial Sequence
  PCR primer for ORF amplification
aattacatgactcgagctattcctgttgatattcagattc

SEQ ID NO: 23945 - DNA, 40 bp, Artificial Sequence
  PCR primer for ORF amplification
aattacatgactcgagctattctaccttaggcttcttcga

SEQ ID NO: 23946 - DNA, 40 bp, Artificial Sequence
  PCR primer for ORF amplification
aattacatgactcgagttactcttcatccattctaacctt

SEQ ID NO: 23947 - DNA, 40 bp, Artificial Sequence
  PCR primer for ORF amplification
aattacatgactcgagttattcaacactgacttttttggt

SEQ ID NO: 23948 - DNA, 40 bp, Artificial Sequence
  PCR primer for ORF amplification
aattacatgactcgagctatttttccaacatcataacctc

SEQ ID NO: 23949 - DNA, 40 bp, Artificial Sequence
  PCR primer for ORF amplification
aattacatgactcgagtcaccatgctaccccaggcaagta

SEQ ID NO: 23950 - DNA, 40 bp, Artificial Sequence
  PCR primer for ORF amplification
aattacatgactcgagttaggatagtctcttgagacatct

SEQ ID NO: 23951 - DNA, 40 bp, Artificial Sequence
  PCR primer for ORF amplification
aattacatgactcgagttattttacagtaaaggatgctac

SEQ ID NO: 23952 - DNA, 40 bp, Artificial Sequence
  PCR primer for ORF amplification
aattacatgactcgagttaatcataaatagtttcataagt

SEQ ID NO: 23953 - DNA, 40 bp, Artificial Sequence
  PCR primer for ORF amplification
aattacatgactcgagttagttcatggacttaaccaattt

SEQ ID NO: 23954 - DNA, 40 bp, Artificial Sequence
  PCR primer for ORF amplification
aattacatgactcgagtcacagttgtggctttttctccgc

SEQ ID NO: 23955 - DNA, 40 bp, Artificial Sequence
  PCR primer for ORF amplification
aattacatgactcgagtcattttttatcttcagtctctag

SEQ ID NO: 23956 - DNA, 40 bp, Artificial Sequence
  PCR primer for ORF amplification
aattacatgactcgagctaggtcaaagcagatgttatgaa

SEQ ID NO: 23957 - DNA, 40 bp, Artificial Sequence
  PCR primer for ORF amplification
aattacatgactcgagtcaaaatacttgtacctttaaaaa

SEQ ID NO: 23958 - DNA, 40 bp, Artificial Sequence
  PCR primer for ORF amplification
aattacatgactcgagttactgtgaattgaataaatttcc

SEQ ID NO: 23959 - DNA, 40 bp, Artificial Sequence
  PCR primer for ORF amplification
aattacatgactcgagttatatagttgaattgagagtgtc

SEQ ID NO: 23960 - DNA, 40 bp, Artificial Sequence
  PCR primer for ORF amplification
aattacatgactcgagttagccgaatctgctcaatgcctc

SEQ ID NO: 23961 - DNA, 40 bp, Artificial Sequence
  PCR primer for ORF amplification
aattacatgactcgagctataatttacttaagtcaactgg

SEQ ID NO: 23962 - DNA, 40 bp, Artificial Sequence
  PCR primer for ORF amplification
aattacatgactcgagtcacaatttgctcaaatcagtggg

SEQ ID NO: 23963 - DNA, 40 bp, Artificial Sequence
  PCR primer for ORF amplification
aattacatgactcgagtcatggcttacatctaccgctgaa

SEQ ID NO: 23964 - DNA, 40 bp, Artificial Sequence
  PCR primer for ORF amplification
aattacatgactcgagtcacatccattccttgaattgatt

SEQ ID NO: 23965 - DNA, 40 bp, Artificial Sequence
  PCR primer for ORF amplification
aattacatgactcgagttatagaagaattccagcagctat

SEQ ID NO: 23966 - DNA, 40 bp, Artificial Sequence
  PCR primer for ORF amplification
aattacatgactcgagtcaattagtagtctcagttggttt

SEQ ID NO: 23967 - DNA, 40 bp, Artificial Sequence
  PCR primer for ORF amplification
aattacatgactcgagttattgcttgtcaagcatctgttg

SEQ ID NO: 23968 - DNA, 40 bp, Artificial Sequence
  PCR primer for ORF amplification
aattacatgactcgagctatcttctgtttttctttcgaga

SEQ ID NO: 23969 - DNA, 40 bp, Artificial Sequence
  PCR primer for ORF amplification
aattacatgactcgagttaaggcccgtccagcggagggtt

SEQ ID NO: 23970 - DNA, 40 bp, Artificial Sequence
  PCR primer for ORF amplification
aattacatgactcgagtcaatggtaggtacgaaagacata

SEQ ID NO: 23971 - DNA, 40 bp, Artificial Sequence
  PCR primer for ORF amplification
aattacatgactcgagttaccatattcttttagaaaccat

SEQ ID NO: 23972 - DNA, 40 bp, Artificial Sequence
  PCR primer for ORF amplification
aattacatgactcgagtcaggctcgattatgagatacggt

SEQ ID NO: 23973 - DNA, 40 bp, Artificial Sequence
  PCR primer for ORF amplification
aattacatgactcgagttattctataattacacttttatc

SEQ ID NO: 23974 - DNA, 40 bp, Artificial Sequence
  PCR primer for ORF amplification
aattacatgactcgagttaccattggtagtaccaataggg

SEQ ID NO: 23975 - DNA, 40 bp, Artificial Sequence
  PCR primer for ORF amplification
aattacatgactcgagtcaactaaatagagcttctgcgtc

SEQ ID NO: 23976 - DNA, 40 bp, Artificial Sequence
  PCR primer for ORF amplification
aattacatgactcgagtcaagcagatgccttaacgtgctc

SEQ ID NO: 23977 - DNA, 40 bp, Artificial Sequence
  PCR primer for ORF amplification
aattacatgactcgagttagtttccgctgatggtcttatc

SEQ ID NO: 23978 - DNA, 40 bp, Artificial Sequence
  PCR primer for ORF amplification
aattacatgactcgagttacaatgaccacggtttgtacac

SEQ ID NO: 23979 - DNA, 40 bp, Artificial Sequence
  PCR primer for ORF amplification
aattacatgactcgagttatattgtgggcaaactggtcgt

SEQ ID NO: 23980 - DNA, 40 bp, Artificial Sequence
  PCR primer for ORF amplification
aattacatgactcgagctatttctttacgccattttcttt

SEQ ID NO: 23981 - DNA, 40 bp, Artificial Sequence
  PCR primer for ORF amplification
aattacatgactcgagttaaattcttttcgacatgtatgg

SEQ ID NO: 23982 - DNA, 40 bp, Artificial Sequence
  PCR primer for ORF amplification
aattacatgactcgagtcatggtcttaatctctttggatc

SEQ ID NO: 23983 - DNA, 40 bp, Artificial Sequence
  PCR primer for ORF amplification
aattacatgactcgagtcaaatatctttattccatatgtc

SEQ ID NO: 23984 - DNA, 40 bp, Artificial Sequence
  PCR primer for ORF amplification
aattacatgactcgagttatttattagattcttggcaaca

SEQ ID NO: 23985 - DNA, 40 bp, Artificial Sequence
  PCR primer for ORF amplification
aattacatgactcgagtcaggtgaaaatgttgctgaggta

SEQ ID NO: 23986 - DNA, 40 bp, Artificial Sequence
  PCR primer for ORF amplification
aattacatgactcgagctaccgatagtggctataaaaagg

SEQ ID NO: 23987 - DNA, 40 bp, Artificial Sequence
  PCR primer for ORF amplification
aattacatgactcgagctaaaacttaaggtcaaatttgat

SEQ ID NO: 23988 - DNA, 40 bp, Artificial Sequence
  PCR primer for ORF amplification
aattacatgactcgagtcatatccatctatgctcgtcagt

SEQ ID NO: 23989 - DNA, 40 bp, Artificial Sequence
  PCR primer for ORF amplification
aattacatgactcgagtcaatgatcgtgcggatcttcttt

SEQ ID NO: 23990 - DNA, 40 bp, Artificial Sequence
  PCR primer for ORF amplification
aattacatgactcgagttaaaccaaagcaaaaccgacacc

SEQ ID NO: 23991 - DNA, 40 bp, Artificial Sequence
  PCR primer for ORF amplification
aattacatgactcgagtcattgattatagatgtataagca

SEQ ID NO: 23992 - DNA, 40 bp, Artificial Sequence
  PCR primer for ORF amplification
aattacatgactcgagctataaacgcggtttattctgcca

SEQ ID NO: 23993 - DNA, 40 bp, Artificial Sequence
  PCR primer for ORF amplification
aattacatgactcgagttatggcttacagttgtgcattat

SEQ ID NO: 23994 - DNA, 40 bp, Artificial Sequence
  PCR primer for ORF amplification
aattacatgactcgagctagatagatgaatctctacccaa

SEQ ID NO: 23995 - DNA, 40 bp, Artificial Sequence
  PCR primer for ORF amplification
aattacatgactcgagttattgcaatatcgtattatactc

SEQ ID NO: 23996 - DNA, 40 bp, Artificial Sequence
  PCR primer for ORF amplification
aattacatgactcgagttacgtacatctccaggaactgat

SEQ ID NO: 23997 - DNA, 40 bp, Artificial Sequence
  PCR primer for ORF amplification
aattacatgactcgagttactggattaacacagatgcgcc

SEQ ID NO: 23998 - DNA, 40 bp, Artificial Sequence
  PCR primer for ORF amplification
aattacatgactcgagctaaagcttataaagagacattct

SEQ ID NO: 23999 - DNA, 40 bp, Artificial Sequence
  PCR primer for ORF amplification
aattacatgactcgagtcagcattttaggtaaattccgtg

SEQ ID NO: 24000 - DNA, 40 bp, Artificial Sequence
  PCR primer for ORF amplification
aattacatgactcgagttacagtttttcgaaatcttcttc

SEQ ID NO: 24001 - DNA, 40 bp, Artificial Sequence
  PCR primer for ORF amplification
aattacatgactcgagttagatgcatgtagggaaaacaac

SEQ ID NO: 24002 - DNA, 40 bp, Artificial Sequence
  PCR primer for ORF amplification
aattacatgactcgagtcaattaacaaaatacttgtcgtc

SEQ ID NO: 24003 - DNA, 40 bp, Artificial Sequence
  PCR primer for ORF amplification
aattacatgactcgagctatgcaatgggcgaagtacttgc

SEQ ID NO: 24004 - DNA, 40 bp, Artificial Sequence
  PCR primer for ORF amplification
aattacatgactcgagtcatgataatctctggtgcttttt

SEQ ID NO: 24005 - DNA, 40 bp, Artificial Sequence
  PCR primer for ORF amplification
aattacatgactcgagttaattggcacttgcaatggacca

SEQ ID NO: 24006 - DNA, 40 bp, Artificial Sequence
  PCR primer for ORF amplification
aattacatgactcgagttagagggttttgggatgttcatc

SEQ ID NO: 24007 - DNA, 40 bp, Artificial Sequence
  PCR primer for ORF amplification
aattacatgactcgagttattgatgcttatctattatacc

SEQ ID NO: 24008 - DNA, 40 bp, Artificial Sequence
  PCR primer for ORF amplification
aattacatgactcgagtcaagaacttgaactacgtttgta

SEQ ID NO: 24009 - DNA, 40 bp, Artificial Sequence
  PCR primer for ORF amplification
aattacatgactcgagttaaagagaagcgcaaagagcggc

SEQ ID NO: 24010 - DNA, 40 bp, Artificial Sequence
  PCR primer for ORF amplification
aattacatgactcgagctacatcccatcttctaaatgagg

SEQ ID NO: 24011 - DNA, 40 bp, Artificial Sequence
  PCR primer for ORF amplification
aattacatgactcgagtcaatactcatctttaccactaat

SEQ ID NO: 24012 - DNA, 40 bp, Artificial Sequence
  PCR primer for ORF amplification
aattacatgactcgagttaaaagtaattgctttccaaata

SEQ ID NO: 24013 - DNA, 40 bp, Artificial Sequence
  PCR primer for ORF amplification
aattacatgactcgagtcacgtcgaaactttttctgaatt

SEQ ID NO: 24014 - DNA, 40 bp, Artificial Sequence
  PCR primer for ORF amplification
aattacatgactcgagttattgtatatctagcttatagga

SEQ ID NO: 24015 - DNA, 40 bp, Artificial Sequence
  PCR primer for ORF amplification
aattacatgactcgagtcacttctttccccacggtacgtg

SEQ ID NO: 24016 - DNA, 40 bp, Artificial Sequence
  PCR primer for ORF amplification
aattacatgactcgagttaatcttcatctatgctaataat

SEQ ID NO: 24017 - DNA, 40 bp, Artificial Sequence
  PCR primer for ORF amplification
aattacatgactcgagttattgtttagcgttagtagcggc

SEQ ID NO: 24018 - DNA, 40 bp, Artificial Sequence
  PCR primer for ORF amplification
aattacatgactcgagttattgtttggcatttgtagcggc

SEQ ID NO: 24019 - DNA, 40 bp, Artificial Sequence
  PCR primer for ORF amplification
aattacatgactcgagttattgcttagcgttggtagcagc

SEQ ID NO: 24020 - DNA, 40 bp, Artificial Sequence
  PCR primer for ORF amplification
aattacatgactcgagtcaattcttttcattaccgctatc

SEQ ID NO: 24021 - DNA, 40 bp, Artificial Sequence
  PCR primer for ORF amplification
aattacatgactcgagtcaatcagaaccctttgagaactt

SEQ ID NO: 24022 - DNA, 40 bp, Artificial Sequence
  PCR primer for ORF amplification
aattacatgactcgagttatttcgagaaatgtttttttga

SEQ ID NO: 24023 - DNA, 40 bp, Artificial Sequence
  PCR primer for ORF amplification
aattacatgactcgagtcaatcagaattctttgagaactt

SEQ ID NO: 24024 - DNA, 40 bp, Artificial Sequence
  PCR primer for ORF amplification
aattacatgactcgagttaataaaaagttgaaaaagggtc

SEQ ID NO: 24025 - DNA, 40 bp, Artificial Sequence
  PCR primer for ORF amplification
aattacatgactcgagtcacattgcgtctttataaacttt

SEQ ID NO: 24026 - DNA, 40 bp, Artificial Sequence
  PCR primer for ORF amplification
aattacatgactcgagttatatactgtcactctgtctccc

SEQ ID NO: 24027 - DNA, 40 bp, Artificial Sequence
  PCR primer for ORF amplification
aattacatgactcgagctactttctttttttcttcttcaa

SEQ ID NO: 24028 - DNA, 40 bp, Artificial Sequence
  PCR primer for ORF amplification
aattacatgactcgagttacaattccattgatgtgccaaa

SEQ ID NO: 24029 - DNA, 40 bp, Artificial Sequence
  PCR primer for ORF amplification
aattacatgactcgagtcagttggtcaactcatggtagta

SEQ ID NO: 24030 - DNA, 40 bp, Artificial Sequence
  PCR primer for ORF amplification
aattacatgactcgagctatgtatgagaaccacgcagtct

SEQ ID NO: 24031 - DNA, 40 bp, Artificial Sequence
  PCR primer for ORF amplification
aattacatgactcgagttagtgtgtcggaagagtgcttgt

SEQ ID NO: 24032 - DNA, 40 bp, Artificial Sequence
  PCR primer for ORF amplification
aattacatgactcgagttatatatgcgagggccaataaga

SEQ ID NO: 24033 - DNA, 40 bp, Artificial Sequence
  PCR primer for ORF amplification
aattacatgactcgagttagctaacgatatcctgaaattt

SEQ ID NO: 24034 - DNA, 40 bp, Artificial Sequence
  PCR primer for ORF amplification
aattacatgactcgagttaagcattgataaacctttcaaa

SEQ ID NO: 24035 - DNA, 40 bp, Artificial Sequence
  PCR primer for ORF amplification
aattacatgactcgagctacattcgtccatttgataatat

SEQ ID NO: 24036 - DNA, 40 bp, Artificial Sequence
  PCR primer for ORF amplification
aattacatgactcgagctaacgtatttgattaaatgcgtc

SEQ ID NO: 24037 - DNA, 40 bp, Artificial Sequence
  PCR primer for ORF amplification
aattacatgactcgagtcaattaaaactctttgggaactt

SEQ ID NO: 24038 - DNA, 40 bp, Artificial Sequence
  PCR primer for ORF amplification
aattacatgactcgagttatttcttgccgaacattttctt

SEQ ID NO: 24039 - DNA, 40 bp, Artificial Sequence
  PCR primer for ORF amplification
aattacatgactcgagttaatggtttcttgggtttctttt

SEQ ID NO: 24040 - DNA, 40 bp, Artificial Sequence
  PCR primer for ORF amplification
aattacatgactcgagtcacattgaaccgccaccttgatg

SEQ ID NO: 24041 - DNA, 40 bp, Artificial Sequence
  PCR primer for ORF amplification
aattacatgactcgagtcagctggaaaagaacctcttgta

SEQ ID NO: 24042 - DNA, 40 bp, Artificial Sequence
  PCR primer for ORF amplification
aattacatgactcgagttagctggaaaagaacctcttgta

SEQ ID NO: 24043 - DNA, 40 bp, Artificial Sequence
  PCR primer for ORF amplification
aattacatgactcgagttagtttacgtcaacagctgcggt

SEQ ID NO: 24044 - DNA, 40 bp, Artificial Sequence
  PCR primer for ORF amplification
aattacatgactcgagtcagtcttcttggtcccagttacc

SEQ ID NO: 24045 - DNA, 40 bp, Artificial Sequence
  PCR primer for ORF amplification
aattacatgactcgagctagaggcgtttagcgtacgatat

SEQ ID NO: 24046 - DNA, 40 bp, Artificial Sequence
  PCR primer for ORF amplification
aattacatgactcgagctatatatctattaagttaggatt

SEQ ID NO: 24047 - DNA, 40 bp, Artificial Sequence
  PCR primer for ORF amplification
aattacatgactcgagtcaagcgtttattttgacttttct

SEQ ID NO: 24048 - DNA, 40 bp, Artificial Sequence
  PCR primer for ORF amplification
aattacatgactcgagtcagatgaatgcaaaaagaagaga

SEQ ID NO: 24049 - DNA, 40 bp, Artificial Sequence
  PCR primer for ORF amplification
aattacatgactcgagtcaaccctcaaaatttgctttatc

SEQ ID NO: 24050 - DNA, 40 bp, Artificial Sequence
  PCR primer for ORF amplification
aattacatgactcgagctaaaacattcttttgtagaaggg

SEQ ID NO: 24051 - DNA, 40 bp, Artificial Sequence
  PCR primer for ORF amplification
aattacatgactcgagttaagatgacaaccaagtcttcgg

SEQ ID NO: 24052 - DNA, 40 bp, Artificial Sequence
  PCR primer for ORF amplification
aattacatgactcgagttaagtacgaaccgttggttcttc

SEQ ID NO: 24053 - DNA, 40 bp, Artificial Sequence
  PCR primer for ORF amplification
aattacatgactcgagttatttggtgctgaacattctctt

SEQ ID NO: 24054 - DNA, 40 bp, Artificial Sequence; identical to SEQ ID NO: 24053
  PCR primer for ORF amplification

SEQ ID NO: 24055 - DNA, 40 bp, Artificial Sequence
  PCR primer for ORF amplification
aattacatgactcgagtcataatccgtaagtctcacagac

SEQ ID NO: 24056 - DNA, 40 bp, Artificial Sequence
  PCR primer for ORF amplification
aattacatgactcgagttatttcctgctaaacaaactctt

SEQ ID NO: 24057 - DNA, 40 bp, Artificial Sequence
  PCR primer for ORF amplification
aattacatgactcgagttatgaagtgttgggacgggcttt

SEQ ID NO: 24058 - DNA, 40 bp, Artificial Sequence
  PCR primer for ORF amplification
aattacatgactcgagttaattgatttgttccaacaatga

SEQ ID NO: 24059 - DNA, 40 bp, Artificial Sequence
  PCR primer for ORF amplification
aattacatgactcgagtcaaaccacgacaaacttctgtct

SEQ ID NO: 24060 - DNA, 40 bp, Artificial Sequence
  PCR primer for ORF amplification
aattacatgactcgagctatgtgcggactgttggttcgtc

SEQ ID NO: 24061 - DNA, 40 bp, Artificial Sequence
  PCR primer for ORF amplification
aattacatgactcgagttatattatctcaagatcgctggc

SEQ ID NO: 24062 - DNA, 40 bp, Artificial Sequence
  PCR primer for ORF amplification
aattacatgactcgagttaaacttcggttttcacgtcttc

SEQ ID NO: 24063 - DNA, 40 bp, Artificial Sequence
  PCR primer for ORF amplification
aattacatgactcgagttagataggagttctccagacgtt

SEQ ID NO: 24064 - DNA, 40 bp, Artificial Sequence
  PCR primer for ORF amplification
aattacatgactcgagttatggttcctgtttggacataat

SEQ ID NO: 24065 - DNA, 40 bp, Artificial Sequence
  PCR primer for ORF amplification
aattacatgactcgagttacttgttttctagataagcttc

SEQ ID NO: 24066 - DNA, 40 bp, Artificial Sequence
  PCR primer for ORF amplification
aattacatgactcgagctagtaaaaggttgaaaaggggtc

SEQ ID NO: 24067 - DNA, 40 bp, Artificial Sequence
  PCR primer for ORF amplification
aattacatgactcgagctaggctttgtgccgttcaggctt

SEQ ID NO: 24068 - DNA, 40 bp, Artificial Sequence
  PCR primer for ORF amplification
aattacatgactcgagttaaaattctttggcagtatattt

SEQ ID NO: 24069 - DNA, 40 bp, Artificial Sequence
  PCR primer for ORF amplification
aattacatgactcgagtcattcgtattccatggcggcggt

SEQ ID NO: 24070 - DNA, 40 bp, Artificial Sequence
  PCR primer for ORF amplification
aattacatgactcgagtcataatctaggttttggctttgt

SEQ ID NO: 24071 - DNA, 40 bp, Artificial Sequence
  PCR primer for ORF amplification
aattacatgactcgagttaagcactgacgtgcttttcgtg

SEQ ID NO: 24072 - DNA, 40 bp, Artificial Sequence
  PCR primer for ORF amplification
aattacatgactcgagttattcgatatgtttttcatgaat

SEQ ID NO: 24073 - DNA, 40 bp, Artificial Sequence
  PCR primer for ORF amplification
aattacatgactcgagttacatcatacctggcattcctgg

SEQ ID NO: 24074 - DNA, 40 bp, Artificial Sequence
  PCR primer for ORF amplification
aattacatgactcgagctagacaacagtagtatcaatagt

SEQ ID NO: 24075 - DNA, 40 bp, Artificial Sequence
  PCR primer for ORF amplification
aattacatgactcgagttatgaaaggacatcccaaactcg

SEQ ID NO: 24076 - DNA, 40 bp, Artificial Sequence
  PCR primer for ORF amplification
aattacatgactcgagtcaagccttctcagcaaccatttc

SEQ ID NO: 24077 - DNA, 40 bp, Artificial Sequence
  PCR primer for ORF amplification
aattacatgactcgagctaaaagcctgtttggtcaatgac

SEQ ID NO: 24078 - DNA, 40 bp, Artificial Sequence
  PCR primer for ORF amplification
aattacatgactcgagttataagtagtaatgtgtatactt

SEQ ID NO: 24079 - DNA, 40 bp, Artificial Sequence
  PCR primer for ORF amplification
aattacatgactcgagtcaatctttcttaatgacaaaagt

SEQ ID NO: 24080 - DNA, 40 bp, Artificial Sequence
  PCR primer for ORF amplification
aattacatgactcgagttattctagcatggccttgtacca

SEQ ID NO: 24081 - DNA, 40 bp, Artificial Sequence
  PCR primer for ORF amplification
aattacatgactcgagttatacatctttagaattggaaac

SEQ ID NO: 24082 - DNA, 40 bp, Artificial Sequence
  PCR primer for ORF amplification
aattacatgactcgagttatgtcatttggtattccacacc

SEQ ID NO: 24083 - DNA, 40 bp, Artificial Sequence
  PCR primer for ORF amplification
aattacatgactcgagctaatcttttgtcgaattgattac

SEQ ID NO: 24084 - DNA, 40 bp, Artificial Sequence
  PCR primer for ORF amplification
aattacatgactcgagttacagcgatttttcttgttcact

SEQ ID NO: 24085 - DNA, 40 bp, Artificial Sequence
  PCR primer for ORF amplification
aattacatgactcgagtcatgaaatatttttttcattttc

SEQ ID NO: 24086 - DNA, 40 bp, Artificial Sequence
  PCR primer for ORF amplification
aattacatgactcgagtcatgagtgtttggagcctctgct

SEQ ID NO: 24087 - DNA, 40 bp, Artificial Sequence
  PCR primer for ORF amplification
aattacatgactcgagtcaaaattgcgtttcggtaaagct

SEQ ID NO: 24088 - DNA, 40 bp, Artificial Sequence
  PCR primer for ORF amplification
aattacatgactcgagtcatgacctcatattcgtttgttc

SEQ ID NO: 24089 - DNA, 40 bp, Artificial Sequence
  PCR primer for ORF amplification
aattacatgactcgagttagctttgttgttgttgctgctg

SEQ ID NO: 24090 - DNA, 40 bp, Artificial Sequence
  PCR primer for ORF amplification
aattacatgactcgagttattcataattcgatggatattt

SEQ ID NO: 24091 - DNA, 40 bp, Artificial Sequence
  PCR primer for ORF amplification
aattacatgactcgagtcaatctttgtattccgatgcgtc

SEQ ID NO: 24092 - DNA, 40 bp, Artificial Sequence
  PCR primer for ORF amplification
aattacatgactcgagttaactgatatcaccatgagacat

SEQ ID NO: 24093 - DNA, 40 bp, Artificial Sequence
  PCR primer for ORF amplification
aattacatgactcgagttactgcctgtttacatcatccac

SEQ ID NO: 24094 - DNA, 40 bp, Artificial Sequence
  PCR primer for ORF amplification
aattacatgactcgagttacacgcgtgttggaagttttct

SEQ ID NO: 24095 - DNA, 40 bp, Artificial Sequence
  PCR primer for ORF amplification
aattacatgactcgagtcataaatccagttttttactgaa

SEQ ID NO: 24096 - DNA, 40 bp, Artificial Sequence
  PCR primer for ORF amplification
aattacatgactcgagttaagcgtattcgttaacattaac

SEQ ID NO: 24097 - DNA, 40 bp, Artificial Sequence
  PCR primer for ORF amplification
aattacatgactcgagttatgccatgtcatcatgctcatc

SEQ ID NO: 24098 - DNA, 40 bp, Artificial Sequence
  PCR primer for ORF amplification
aattacatgactcgagttaatatttcaagaatttttgata

SEQ ID NO: 24099 - DNA, 40 bp, Artificial Sequence
  PCR primer for ORF amplification
aattacatgactcgagtcaaacttttaaatcgacctttaa

SEQ ID NO: 24100 - DNA, 40 bp, Artificial Sequence
  PCR primer for ORF amplification
aattacatgactcgagttagtcttcatgcttatcacagaa

SEQ ID NO: 24101 - DNA, 40 bp, Artificial Sequence
  PCR primer for ORF amplification
aattacatgactcgagctacttttttccgaacatcttctt

SEQ ID NO: 24102 - DNA, 40 bp, Artificial Sequence
  PCR primer for ORF amplification
aattacatgactcgagctacatatcctttagcaatacgcc

SEQ ID NO: 24103 - DNA, 40 bp, Artificial Sequence
  PCR primer for ORF amplification
aattacatgactcgagtcactgccatagtaattcgtcaaa

SEQ ID NO: 24104 - DNA, 40 bp, Artificial Sequence
  PCR primer for ORF amplification
aattacatgactcgagttattttgcagatctaatagaatc

SEQ ID NO: 24105 - DNA, 40 bp, Artificial Sequence
  PCR primer for ORF amplification
aattacatgactcgagttaagcttgctcagtttgttgttc

SEQ ID NO: 24106 - DNA, 40 bp, Artificial Sequence
  PCR primer for ORF amplification
aattacatgactcgagtcacaatgtcatggtaatggttgt

SEQ ID NO: 24107 - DNA, 40 bp, Artificial Sequence
  PCR primer for ORF amplification
aattacatgactcgagtcatctatgccgttgccttcttgc

SEQ ID NO: 24108 - DNA, 40 bp, Artificial Sequence
  PCR primer for ORF amplification
aattacatgactcgagtcattcattttcatttccctcgct

SEQ ID NO: 24109 - DNA, 40 bp, Artificial Sequence
  PCR primer for ORF amplification
aattacatgactcgagttaaacagattctggagaattacc

SEQ ID NO: 24110 - DNA, 40 bp, Artificial Sequence
  PCR primer for ORF amplification
aattacatgactcgagtcaatgtaaaaattgtaaaatctg

SEQ ID NO: 24111 - DNA, 40 bp, Artificial Sequence
  PCR primer for ORF amplification
aattacatgactcgagttaacgctcaaataatccgtcatc

SEQ ID NO: 24112 - DNA, 40 bp, Artificial Sequence
  PCR primer for ORF amplification
aattacatgactcgagttaaaagttgaatttgttttcgcc

SEQ ID NO: 24113 - DNA, 40 bp, Artificial Sequence
  PCR primer for ORF amplification
aattacatgactcgagttaacgaccaaatttacgtagctc

SEQ ID NO: 24114 - DNA, 40 bp, Artificial Sequence
  PCR primer for ORF amplification
aattacatgactcgagttatgctactggtgttgcattctt

SEQ ID NO: 24115 - DNA, 40 bp, Artificial Sequence
  PCR primer for ORF amplification
aattacatgactcgagtcaagtattttgtgaagaaggttg

SEQ ID NO: 24116 - DNA, 40 bp, Artificial Sequence
  PCR primer for ORF amplification
aattacatgactcgagttattttctcgatctgttcttctt

SEQ ID NO: 24117 - DNA, 40 bp, Artificial Sequence
  PCR primer for ORF amplification
aattacatgactcgagtcacgcgatagcaccgagactcat

SEQ ID NO: 24118 - DNA, 40 bp, Artificial Sequence
  PCR primer for ORF amplification
aattacatgactcgagctagccgctttcctgaaggatcat

SEQ ID NO: 24119 - DNA, 40 bp, Artificial Sequence
  PCR primer for ORF amplification
aattacatgactcgagtcagcgagttttcttgaggttgct

SEQ ID NO: 24120 - DNA, 40 bp, Artificial Sequence
  PCR primer for ORF amplification
aattacatgactcgagctatacaaccttgttccataattc

SEQ ID NO: 24121 - DNA, 40 bp, Artificial Sequence
  PCR primer for ORF amplification
aattacatgactcgagttaccaaaggctacctataatcat

SEQ ID NO: 24122 - DNA, 40 bp, Artificial Sequence
  PCR primer for ORF amplification
aattacatgactcgagtcataaccccgacgtgttttccat

SEQ ID NO: 24123 - DNA, 40 bp, Artificial Sequence
  PCR primer for ORF amplification
aattacatgactcgagttacttcaacaagtaaagtcttcc

SEQ ID NO: 24124 - DNA, 40 bp, Artificial Sequence
  PCR primer for ORF amplification
aattacatgactcgagttacttcaccatcttctccaggat

SEQ ID NO: 24125 - DNA, 40 bp, Artificial Sequence
  PCR primer for ORF amplification
aattacatgactcgagctagttatacccaaccataagccg

SEQ ID NO: 24126 - DNA, 40 bp, Artificial Sequence; identical to SEQ ID NO: 23327
  PCR primer for ORF amplification

SEQ ID NO: 24127 - DNA, 40 bp, Artificial Sequence
  PCR primer for ORF amplification
aattacatgactcgagtcatctggtatacttcaccggcgt

SEQ ID NO: 24128 - DNA, 40 bp, Artificial Sequence
  PCR primer for ORF amplification
aattacatgactcgagttacaaataactagtatcgaggaa

SEQ ID NO: 24129 - DNA, 40 bp, Artificial Sequence
  PCR primer for ORF amplification
aattacatgactcgagttatgcagtttttttttcccattc

SEQ ID NO: 24130 - DNA, 40 bp, Artificial Sequence
  PCR primer for ORF amplification
aattacatgactcgagttacttccttgaaaaaatatgtct

SEQ ID NO: 24131 - DNA, 40 bp, Artificial Sequence
  PCR primer for ORF amplification
aattacatgactcgagttaacagaaaaaccgatagatcct

SEQ ID NO: 24132 - DNA, 40 bp, Artificial Sequence
  PCR primer for ORF amplification
aattacatgactcgagttatactttaccgtcacatctttc

SEQ ID NO: 24133 - DNA, 40 bp, Artificial Sequence
  PCR primer for ORF amplification
aattacatgactcgagctacttacgtactaaaatagtctc

SEQ ID NO: 24134 - DNA, 40 bp, Artificial Sequence
  PCR primer for ORF amplification
aattacatgactcgagtcaaacccgccagtataagcaact

SEQ ID NO: 24135 - DNA, 40 bp, Artificial Sequence
  PCR primer for ORF amplification
aattacatgactcgagtcaatagtccaattccacagccgg

SEQ ID NO: 24136 - DNA, 40 bp, Artificial Sequence
  PCR primer for ORF amplification
aattacatgactcgagttatttgacgaggtagattctacc

SEQ ID NO: 24137 - DNA, 40 bp, Artificial Sequence
  PCR primer for ORF amplification
aattacatgactcgagtcattgttcttcattttcctcatc

SEQ ID NO: 24138 - DNA, 40 bp, Artificial Sequence
  PCR primer for ORF amplification
aattacatgactcgagctatatatcctctataatctcttg

SEQ ID NO: 24139 - DNA, 40 bp, Artificial Sequence
  PCR primer for ORF amplification
aattacatgactcgagttaaagggtataaggattatatcc

SEQ ID NO: 24140 - DNA, 40 bp, Artificial Sequence
  PCR primer for ORF amplification
aattacatgactcgagttacaaggcgctttgaaccccctt

SEQ ID NO: 24141 - DNA, 40 bp, Artificial Sequence
  PCR primer for ORF amplification
aattacatgactcgagtcatattcgccctccattactcgt

SEQ ID NO: 24142 - DNA, 40 bp, Artificial Sequence
  PCR primer for ORF amplification
aattacatgactcgagctaaatctgtaagtcgtatgcctt

SEQ ID NO: 24143 - DNA, 40 bp, Artificial Sequence
  PCR primer for ORF amplification
aattacatgactcgagctacttcatacttgattcaagaat

SEQ ID NO: 24144 - DNA, 40 bp, Artificial Sequence
  PCR primer for ORF amplification
aattacatgactcgagtcattggcttatgtgctcatctgg

SEQ ID NO: 24145 - DNA, 40 bp, Artificial Sequence
  PCR primer for ORF amplification
aattacatgactcgagctagtcatcctgaaagaaagccgc

SEQ ID NO: 24146 - DNA, 40 bp, Artificial Sequence
  PCR primer for ORF amplification
aattacatgactcgagtcatttccctgcttttttattttt

SEQ ID NO: 24147 - DNA, 40 bp, Artificial Sequence
  PCR primer for ORF amplification
aattacatgactcgagtcaagcatctaaaacacaaccgtt

SEQ ID NO: 24148 - DNA, 40 bp, Artificial Sequence
  PCR primer for ORF amplification
aattacatgactcgagttatacattaggtaacgtaaaaac

SEQ ID NO: 24149 - DNA, 40 bp, Artificial Sequence
  PCR primer for ORF amplification
aattacatgactcgagtcaacatgttcctctatagtttct

SEQ ID NO: 24150 - DNA, 40 bp, Artificial Sequence
  PCR primer for ORF amplification
aattacatgactcgagctatatctgcatggtttcatcacc

SEQ ID NO: 24151 - DNA, 40 bp, Artificial Sequence
  PCR primer for ORF amplification
aattacatgactcgagttagtttttctcccccatagcttc

SEQ ID NO: 24152 - DNA, 40 bp, Artificial Sequence
  PCR primer for ORF amplification
aattacatgactcgagttagcagatgcgcgcacctgcgtt

SEQ ID NO: 24153 - DNA, 40 bp, Artificial Sequence
  PCR primer for ORF amplification
aattacatgactcgagttacacaccgtctctcaaattgac

SEQ ID NO: 24154 - DNA, 40 bp, Artificial Sequence
  PCR primer for ORF amplification
aattacatgactcgagttaattatgattatcgttctggtc

SEQ ID NO: 24155 - DNA, 40 bp, Artificial Sequence
  PCR primer for ORF amplification
aattacatgactcgagttaagcggcgtaagcatacttgga

SEQ ID NO: 24156 - DNA, 40 bp, Artificial Sequence
  PCR primer for ORF amplification
aattacatgactcgagttaatgaatagagttcctgggatt

SEQ ID NO: 24157 - DNA, 40 bp, Artificial Sequence
  PCR primer for ORF amplification
aattacatgactcgagtcagtcatcgtcgcagtaagcggg

SEQ ID NO: 24158 - DNA, 40 bp, Artificial Sequence
  PCR primer for ORF amplification
aattacatgactcgagttaattgtcatcaaattcaaacaa

SEQ ID NO: 24159 - DNA, 40 bp, Artificial Sequence
  PCR primer for ORF amplification
aattacatgactcgagttagtttgaatacttctccctaat

SEQ ID NO: 24160 - DNA, 40 bp, Artificial Sequence
  PCR primer for ORF amplification
aattacatgactcgagctaaccctgatatgactgtctcaa

SEQ ID NO: 24161 - DNA, 40 bp, Artificial Sequence
  PCR primer for ORF amplification
aattacatgactcgagttatgcttcatgttgaagttgaga

SEQ ID NO: 24162 - DNA, 40 bp, Artificial Sequence
  PCR primer for ORF amplification
aattacatgactcgagttaattaccggcgataattttcct

SEQ ID NO: 24163 - DNA, 40 bp, Artificial Sequence
  PCR primer for ORF amplification
aattacatgactcgagtcaagaagattcgtcatccaagag

SEQ ID NO: 24164 - DNA, 40 bp, Artificial Sequence
  PCR primer for ORF amplification
aattacatgactcgagctaacaccaaaatctgtagatttt

SEQ ID NO: 24165 - DNA, 40 bp, Artificial Sequence
  PCR primer for ORF amplification
aattacatgactcgagtcatctgattgcttgttgaacaat

SEQ ID NO: 24166 - DNA, 40 bp, Artificial Sequence
  PCR primer for ORF amplification
aattacatgactcgagttaatatgttggtttacagacatt

SEQ ID NO: 24167 - DNA, 40 bp, Artificial Sequence
  PCR primer for ORF amplification
aattacatgactcgagtcacctgtaatcattagcgggctc

SEQ ID NO: 24168 - DNA, 40 bp, Artificial Sequence
  PCR primer for ORF amplification
aattacatgactcgagttattttatcttttcagaattggg

SEQ ID NO: 24169 - DNA, 40 bp, Artificial Sequence
  PCR primer for ORF amplification
aattacatgactcgagttacataacttccagcgttgttcc

SEQ ID NO: 24170 - DNA, 40 bp, Artificial Sequence
  PCR primer for ORF amplification
aattacatgactcgagttaatatataatctcattactgag

SEQ ID NO: 24171 - DNA, 40 bp, Artificial Sequence
  PCR primer for ORF amplification
aattacatgactcgagttattcttcataaaattgcacgcc

SEQ ID NO: 24172 - DNA, 40 bp, Artificial Sequence
  PCR primer for ORF amplification
aattacatgactcgagtcaattctctactgtctcagttat

SEQ ID NO: 24173 - DNA, 40 bp, Artificial Sequence
  PCR primer for ORF amplification
aattacatgactcgagtcattcagatatgtaaattctgcc

SEQ ID NO: 24174 - DNA, 40 bp, Artificial Sequence
  PCR primer for ORF amplification
aattacatgactcgagtcattcgctgatatatattcttcc

SEQ ID NO: 24175 - DNA, 40 bp, Artificial Sequence
  PCR primer for ORF amplification
aattacatgactcgagctacttggtggcggtatcctctcc

SEQ ID NO: 24176 - DNA, 40 bp, Artificial Sequence
  PCR primer for ORF amplification
aattacatgactcgagttagcggccagtccggatgatacc

SEQ ID NO: 24177 - DNA, 40 bp, Artificial Sequence
  PCR primer for ORF amplification
aattacatgactcgagctataatttagaagattgacttga

SEQ ID NO: 24178 - DNA, 40 bp, Artificial Sequence
  PCR primer for ORF amplification
aattacatgactcgagctatattcttttggtcttgacttt

SEQ ID NO: 24179 - DNA, 40 bp, Artificial Sequence
  PCR primer for ORF amplification
aattacatgactcgagctatgctacaacattccaaaattt

SEQ ID NO: 24180 - DNA, 40 bp, Artificial Sequence
  PCR primer for ORF amplification
aattacatgactcgagctatatggaagaagaagaatttag

SEQ ID NO: 24181 - DNA, 40 bp, Artificial Sequence
  PCR primer for ORF amplification
aattacatgactcgagtcattttttggtgcgatatgtttt

SEQ ID NO: 24182 - DNA, 40 bp, Artificial Sequence
  PCR primer for ORF amplification
aattacatgactcgagttactcatcaccctctgcaccaaa

SEQ ID NO: 24183 - DNA, 40 bp, Artificial Sequence
  PCR primer for ORF amplification
aattacatgactcgagttactttttctggtggcctttatg

SEQ ID NO: 24184 - DNA, 40 bp, Artificial Sequence
  PCR primer for ORF amplification
aattacatgactcgagtcatgcatcctcaaattctgttaa

SEQ ID NO: 24185 - DNA, 40 bp, Artificial Sequence
  PCR primer for ORF amplification
aattacatgactcgagctaagctttgtcgtcactattatc

SEQ ID NO: 24186 - DNA, 40 bp, Artificial Sequence
  PCR primer for ORF amplification
aattacatgactcgagttagtggtggaataaacgaattgg

SEQ ID NO: 24187 - DNA, 40 bp, Artificial Sequence
  PCR primer for ORF amplification
aattacatgactcgagttaattttcttcttcctttttgac

SEQ ID NO: 24188 - DNA, 40 bp, Artificial Sequence
  PCR primer for ORF amplification
aattacatgactcgagctagtacccagcagctgtaacaaa

SEQ ID NO: 24189 - DNA, 40 bp, Artificial Sequence
  PCR primer for ORF amplification
aattacatgactcgagttaacaccagaaatggaactgtct

SEQ ID NO: 24190 - DNA, 40 bp, Artificial Sequence
  PCR primer for ORF amplification
aattacatgactcgagctaatggtggaacaaacggattgg

SEQ ID NO: 24191 - DNA, 40 bp, Artificial Sequence
  PCR primer for ORF amplification
aattacatgactcgagctagttgcccaaagacacataatt

SEQ ID NO: 24192 - DNA, 40 bp, Artificial Sequence
  PCR primer for ORF amplification
aattacatgactcgagttatttttctttagtgaacatcct

SEQ ID NO: 24193 - DNA, 40 bp, Artificial Sequence
  PCR primer for ORF amplification
aattacatgactcgagtcagtcacggtattggtcaaaaaa

SEQ ID NO: 24194 - DNA, 40 bp, Artificial Sequence
  PCR primer for ORF amplification
aattacatgactcgagctacgaggaccgctttaaatagta

SEQ ID NO: 24195 - DNA, 40 bp, Artificial Sequence
  PCR primer for ORF amplification
aattacatgactcgagctacattttcatggtttcttcaac

SEQ ID NO: 24196 - DNA, 40 bp, Artificial Sequence
  PCR primer for ORF amplification
aattacatgactcgagttagtataacttaaatagactatc

SEQ ID NO: 24197 - DNA, 40 bp, Artificial Sequence
  PCR primer for ORF amplification
aattacatgactcgagttatttttcatcagatactgataa

SEQ ID NO: 24198 - DNA, 40 bp, Artificial Sequence
  PCR primer for ORF amplification
aattacatgactcgagtcaaagttttatatttgtgctatc

SEQ ID NO: 24199 - DNA, 40 bp, Artificial Sequence
  PCR primer for ORF amplification
aattacatgactcgagttaatctagctgaggtaatgttat

SEQ ID NO: 24200 - DNA, 40 bp, Artificial Sequence
  PCR primer for ORF amplification
aattacatgactcgagttagtagtggtttaatttccagag

SEQ ID NO: 24201 - DNA, 40 bp, Artificial Sequence
  PCR primer for ORF amplification
aattacatgactcgagtcatttgaagttcttcaacgggtc

SEQ ID NO: 24202 - DNA, 40 bp, Artificial Sequence
  PCR primer for ORF amplification
aattacatgactcgagttattgatcaatctcaggctcttc

SEQ ID NO: 24203 - DNA, 40 bp, Artificial Sequence
  PCR primer for ORF amplification
aattacatgactcgagttaatggataaattcctgtttcac

SEQ ID NO: 24204 - DNA, 40 bp, Artificial Sequence
  PCR primer for ORF amplification
aattacatgactcgagttataggaagacttcggcattaac

SEQ ID NO: 24205 - DNA, 40 bp, Artificial Sequence
  PCR primer for ORF amplification
aattacatgactcgagtcaaatgtgatgaaaaatagctgt

SEQ ID NO: 24206 - DNA, 40 bp, Artificial Sequence
  PCR primer for ORF amplification
aattacatgactcgagttatgctttgctataatattgaaa

SEQ ID NO: 24207 - DNA, 40 bp, Artificial Sequence
  PCR primer for ORF amplification
aattacatgactcgagtcaaagaacaataagtatcgagaa

SEQ ID NO: 24208 - DNA, 40 bp, Artificial Sequence
  PCR primer for ORF amplification
aattacatgactcgagttacctaaacaaaccgtcaatggc

SEQ ID NO: 24209 - DNA, 40 bp, Artificial Sequence
  PCR primer for ORF amplification
aattacatgactcgagttattcattttttatgatcgaacc

SEQ ID NO: 24210 - DNA, 40 bp, Artificial Sequence
  PCR primer for ORF amplification
aattacatgactcgagttatttaccggcaatcgccttatc

SEQ ID NO: 24211 - DNA, 40 bp, Artificial Sequence
  PCR primer for ORF amplification
aattacatgactcgagctataaattatgtaaaggctgttc

SEQ ID NO: 24212 - DNA, 40 bp, Artificial Sequence
  PCR primer for ORF amplification
aattacatgactcgagtcagacaacttgttgagtggtact

SEQ ID NO: 24213 - DNA, 40 bp, Artificial Sequence
  PCR primer for ORF amplification
aattacatgactcgagctaagcagctttttcactggcggt

SEQ ID NO: 24214 - DNA, 40 bp, Artificial Sequence
  PCR primer for ORF amplification
aattacatgactcgagtcacaaagacgatgaaggtgcaga

SEQ ID NO: 24215 - DNA, 40 bp, Artificial Sequence
  PCR primer for ORF amplification
aattacatgactcgagttagaactgcacaaatgcttctct

SEQ ID NO: 24216 - DNA, 40 bp, Artificial Sequence
  PCR primer for ORF amplification
aattacatgactcgagttaggcaatttgtttttcactgga

SEQ ID NO: 24217 - DNA, 40 bp, Artificial Sequence
  PCR primer for ORF amplification
aattacatgactcgagttaccacctttgtttcatttcatt

SEQ ID NO: 24218 - DNA, 40 bp, Artificial Sequence
  PCR primer for ORF amplification
aattacatgactcgagttaacgaccaaataggcccaagaa

SEQ ID NO: 24219 - DNA, 40 bp, Artificial Sequence
  PCR primer for ORF amplification
aattacatgactcgagttataggcttagtaggatggaatg

SEQ ID NO: 24220 - DNA, 40 bp, Artificial Sequence
  PCR primer for ORF amplification
aattacatgactcgagttactgagcaaaatataggttatt

SEQ ID NO: 24221 - DNA, 40 bp, Artificial Sequence
  PCR primer for ORF amplification
aattacatgactcgagttagatgagagtcttttccagttc

SEQ ID NO: 24222 - DNA, 40 bp, Artificial Sequence
  PCR primer for ORF amplification
aattacatgactcgagctaatatttggtggtggatcttag

SEQ ID NO: 24223 - DNA, 40 bp, Artificial Sequence
  PCR primer for ORF amplification
aattacatgactcgagtcacttccgcgctgcgctcagctt

SEQ ID NO: 24224 - DNA, 40 bp, Artificial Sequence
  PCR primer for ORF amplification
aattacatgactcgagctattcctctgcaatggaagcttc

SEQ ID NO: 24225 - DNA, 40 bp, Artificial Sequence
  PCR primer for ORF amplification
aattacatgactcgagttaacgagtaaaaaaacgagttaa

SEQ ID NO: 24226 - DNA, 40 bp, Artificial Sequence
  PCR primer for ORF amplification
aattacatgactcgagttaacaccagaaattccagattct

SEQ ID NO: 24227 - DNA, 40 bp, Artificial Sequence
  PCR primer for ORF amplification
aattacatgactcgagctaaaattgagaaaagtaatcccg

SEQ ID NO: 24228 - DNA, 40 bp, Artificial Sequence
  PCR primer for ORF amplification
aattacatgactcgagttatgaaataattgcagcaccaac

SEQ ID NO: 24229 - DNA, 40 bp, Artificial Sequence
  PCR primer for ORF amplification
aattacatgactcgagttatatattgaatttcggcttttt

SEQ ID NO: 24230 - DNA, 40 bp, Artificial Sequence
  PCR primer for ORF amplification
aattacatgactcgagctattctaagtctatatcgtaaat

SEQ ID NO: 24231 - DNA, 40 bp, Artificial Sequence
  PCR primer for ORF amplification
aattacatgactcgagttatttcaatgcgcgcccattatg

SEQ ID NO: 24232 - DNA, 40 bp, Artificial Sequence
  PCR primer for ORF amplification
aattacatgactcgagttattcacgtgttatacccacacc

SEQ ID NO: 24233 - DNA, 40 bp, Artificial Sequence
  PCR primer for ORF amplification
aattacatgactcgagtcaacaccagaaatgtaaaaatct

SEQ ID NO: 24234 - DNA, 40 bp, Artificial Sequence
  PCR primer for ORF amplification
aattacatgactcgagtcatatctccatttcacctacaaa

SEQ ID NO: 24235 - DNA, 40 bp, Artificial Sequence
  PCR primer for ORF amplification
aattacatgactcgagttatgacattgtagtagaagaggg

SEQ ID NO: 24236 - DNA, 40 bp, Artificial Sequence
  PCR primer for ORF amplification
aattacatgactcgagtcaatcttgttgttttgatttgtg

SEQ ID NO: 24237 - DNA, 40 bp, Artificial Sequence
  PCR primer for ORF amplification
aattacatgactcgagtcatattctgacatttctgagatc

SEQ ID NO: 24238 - DNA, 40 bp, Artificial Sequence
  PCR primer for ORF amplification
aattacatgactcgagtcaccaccaagaagagttgtttga

SEQ ID NO: 24239 - DNA, 40 bp, Artificial Sequence
  PCR primer for ORF amplification
aattacatgactcgagttactctgccagtagaacatcccc

SEQ ID NO: 24240 - DNA, 40 bp, Artificial Sequence
  PCR primer for ORF amplification
aattacatgactcgagttattgtggcaattgcttaacggc

SEQ ID NO: 24241 - DNA, 40 bp, Artificial Sequence
  PCR primer for ORF amplification
aattacatgactcgagctaacaccaaaatttgtagactct

SEQ ID NO: 24242 - DNA, 40 bp, Artificial Sequence
  PCR primer for ORF amplification
aattacatgactcgagctatttgctatcattctttgcatc

SEQ ID NO: 24243 - DNA, 40 bp, Artificial Sequence
  PCR primer for ORF amplification
aattacatgactcgagctatttcttggaatctagtttatt

SEQ ID NO: 24244 - DNA, 40 bp, Artificial Sequence
  PCR primer for ORF amplification
aattacatgactcgagttattcgttcattagccgcagaac

SEQ ID NO: 24245 - DNA, 40 bp, Artificial Sequence
  PCR primer for ORF amplification
aattacatgactcgagttatattcggtctatgtctattgt

SEQ ID NO: 24246 - DNA, 40 bp, Artificial Sequence
  PCR primer for ORF amplification
aattacatgactcgagtcaaacaatatatgcgtactcttc

SEQ ID NO: 24247 - DNA, 40 bp, Artificial Sequence
  PCR primer for ORF amplification
aattacatgactcgagctaccagttacttttcaaagtctt

SEQ ID NO: 24248 - DNA, 40 bp, Artificial Sequence
  PCR primer for ORF amplification
aattacatgactcgagtcaaacctccccaactattctcct

SEQ ID NO: 24249 - DNA, 40 bp, Artificial Sequence
  PCR primer for ORF amplification
aattacatgactcgagtcaatatccaattacacgacggag

SEQ ID NO: 24250 - DNA, 40 bp, Artificial Sequence
  PCR primer for ORF amplification
aattacatgactcgagttacaaagacggggttggcatatt

SEQ ID NO: 24251 - DNA, 40 bp, Artificial Sequence
  PCR primer for ORF amplification
aattacatgactcgagttataagtcgtcaaaattgccttg

SEQ ID NO: 24252 - DNA, 40 bp, Artificial Sequence
  PCR primer for ORF amplification
aattacatgactcgagtcaacaccaggtgaatacgggggt

SEQ ID NO: 24253 - DNA, 40 bp, Artificial Sequence
  PCR primer for ORF amplification
aattacatgactcgagttagtaaagtatgcgaccccaaaa

SEQ ID NO: 24254 - DNA, 40 bp, Artificial Sequence
  PCR primer for ORF amplification
aattacatgactcgagctaggagtatatatatttagaggc

SEQ ID NO: 24255 - DNA, 40 bp, Artificial Sequence
  PCR primer for ORF amplification
aattacatgactcgagttacattctttctacgggagttaa

SEQ ID NO: 24256 - DNA, 40 bp, Artificial Sequence
  PCR primer for ORF amplification
aattacatgactcgagctagaagatattacccaaaaattt

SEQ ID NO: 24257 - DNA, 40 bp, Artificial Sequence
  PCR primer for ORF amplification
aattacatgactcgagttacatgagcaaccagtagaagat

SEQ ID NO: 24258 - DNA, 40 bp, Artificial Sequence
  PCR primer for ORF amplification
aattacatgactcgagttaaataccggtgttatccaagaa

SEQ ID NO: 24259 - DNA, 40 bp, Artificial Sequence
  PCR primer for ORF amplification
aattacatgactcgagtcacgtgaccaaagtgtcaccctc

SEQ ID NO: 24260 - DNA, 40 bp, Artificial Sequence
  PCR primer for ORF amplification
aattacatgactcgagttaggaaagtatgtcagaaatgtt

SEQ ID NO: 24261 - DNA, 40 bp, Artificial Sequence
  PCR primer for ORF amplification
aattacatgactcgagtcataggtgatgggatacattgct

SEQ ID NO: 24262 - DNA, 40 bp, Artificial Sequence
  PCR primer for ORF amplification
aattacatgactcgagctaactttctacaatttcctgtgt

SEQ ID NO: 24263 - DNA, 40 bp, Artificial Sequence
  PCR primer for ORF amplification
aattacatgactcgagtcagtatccaacttgatttttttt

SEQ ID NO: 24264 - DNA, 40 bp, Artificial Sequence
  PCR primer for ORF amplification
aattacatgactcgagttatgcctgaatagtcagcctttt

SEQ ID NO: 24265 - DNA, 40 bp, Artificial Sequence
  PCR primer for ORF amplification
aattacatgactcgagttaacaccagaaatgataagcttt

SEQ ID NO: 24266 - DNA, 40 bp, Artificial Sequence
  PCR primer for ORF amplification
aattacatgactcgagtcacttgatggagtgcggaacttg

SEQ ID NO: 24267 - DNA, 40 bp, Artificial Sequence
  PCR primer for ORF amplification
aattacatgactcgagttaagatgttaaggtggaggcgcc

SEQ ID NO: 24268 - DNA, 40 bp, Artificial Sequence
  PCR primer for ORF amplification
aattacatgactcgagtcaacatttcaagttgatgccatg

SEQ ID NO: 24269 - DNA, 40 bp, Artificial Sequence
  PCR primer for ORF amplification
aattacatgactcgagtcataaggtcaggtacaacgtcat

SEQ ID NO: 24270 - DNA, 40 bp, Artificial Sequence
  PCR primer for ORF amplification
aattacatgactcgagttattgtgatgatcgttgctcatt

SEQ ID NO: 24271 - DNA, 40 bp, Artificial Sequence
  PCR primer for ORF amplification
aattacatgactcgagttagtctgttttagtctttttttt

SEQ ID NO: 24272 - DNA, 40 bp, Artificial Sequence
  PCR primer for ORF amplification
aattacatgactcgagttacaaaacaacgttcttggccaa

SEQ ID NO: 24273 - DNA, 40 bp, Artificial Sequence
  PCR primer for ORF amplification
aattacatgactcgagtcacctgatcaaatattggctggt

SEQ ID NO: 24274 - DNA, 40 bp, Artificial Sequence
  PCR primer for ORF amplification
aattacatgactcgagctattccctgatagtggcgcttat

SEQ ID NO: 24275 - DNA, 40 bp, Artificial Sequence
  PCR primer for ORF amplification
aattacatgactcgagttaattcttgaatttaacagacct

SEQ ID NO: 24276 - DNA, 40 bp, Artificial Sequence
  PCR primer for ORF amplification
aattacatgactcgagttatattttttgacgaatattact

SEQ ID NO: 24277 - DNA, 40 bp, Artificial Sequence
  PCR primer for ORF amplification
aattacatgactcgagtcatgtggtacagcgttggttact

SEQ ID NO: 24278 - DNA, 40 bp, Artificial Sequence
  PCR primer for ORF amplification
aattacatgactcgagctactgagttatttcggatatttt

SEQ ID NO: 24279 - DNA, 40 bp, Artificial Sequence
  PCR primer for ORF amplification
aattacatgactcgagctatgcaacagcagcccagaattt

SEQ ID NO: 24280 - DNA, 40 bp, Artificial Sequence
  PCR primer for ORF amplification
aattacatgactcgagtcatcttttaaatcctaacgagct

SEQ ID NO: 24281 - DNA, 40 bp, Artificial Sequence
  PCR primer for ORF amplification
aattacatgactcgagtcactgatgtacaaaagttgagag

SEQ ID NO: 24282 - DNA, 40 bp, Artificial Sequence
  PCR primer for ORF amplification
aattacatgactcgagctattgattgtttgttccacggac

SEQ ID NO: 24283 - DNA, 40 bp, Artificial Sequence
  PCR primer for ORF amplification
aattacatgactcgagtcaaaacgaaaattctcctttaaa

SEQ ID NO: 24284 - DNA, 40 bp, Artificial Sequence
  PCR primer for ORF amplification
aattacatgactcgagtcattgcatcatcttttgatatat

SEQ ID NO: 24285 - DNA, 40 bp, Artificial Sequence
  PCR primer for ORF amplification
aattacatgactcgagttaacgtgattggtgggggacgtt

SEQ ID NO: 24286 - DNA, 40 bp, Artificial Sequence
  PCR primer for ORF amplification
aattacatgactcgagttagtcaaatataccccttggctt

SEQ ID NO: 24287 - DNA, 40 bp, Artificial Sequence
  PCR primer for ORF amplification
aattacatgactcgagttaacgagaagacatggccttggt

SEQ ID NO: 24288 - DNA, 40 bp, Artificial Sequence; identical to SEQ ID NO: 24287
  PCR primer for ORF amplification

SEQ ID NO: 24289 - DNA, 40 bp, Artificial Sequence
  PCR primer for ORF amplification
aattacatgactcgagttatctcaggcttgctgtgacttt

SEQ ID NO: 24290 - DNA, 40 bp, Artificial Sequence
  PCR primer for ORF amplification
aattacatgactcgagttataatttcatttgaactttgat

SEQ ID NO: 24291 - DNA, 40 bp, Artificial Sequence
  PCR primer for ORF amplification
aattacatgactcgagtcaaagatcaattaagcttacacc

SEQ ID NO: 24292 - DNA, 40 bp, Artificial Sequence
  PCR primer for ORF amplification
aattacatgactcgagtcatttgttcacaacagatgaggt

SEQ ID NO: 24293 - DNA, 40 bp, Artificial Sequence
  PCR primer for ORF amplification
aattacatgactcgagttacatctcaacactgtcgatgga

SEQ ID NO: 24294 - DNA, 40 bp, Artificial Sequence
  PCR primer for ORF amplification
aattacatgactcgagctaactttgcttttctttcgacct

SEQ ID NO: 24295 - DNA, 40 bp, Artificial Sequence
  PCR primer for ORF amplification
aattacatgactcgagtcaacatcctgatttcttgttact

SEQ ID NO: 24296 - DNA, 40 bp, Artificial Sequence
  PCR primer for ORF amplification
aattacatgactcgagtcaacatcctaatttcttgttact

SEQ ID NO: 24297 - DNA, 40 bp, Artificial Sequence
  PCR primer for ORF amplification
aattacatgactcgagtcacgacgagctattgtggtctac

SEQ ID NO: 24298 - DNA, 40 bp, Artificial Sequence
  PCR primer for ORF amplification
aattacatgactcgagtcagctattaattaccttaaattc

SEQ ID NO: 24299 - DNA, 40 bp, Artificial Sequence
  PCR primer for ORF amplification
aattacatgactcgagtcactcgaggacaacattccacct

SEQ ID NO: 24300 - DNA, 40 bp, Artificial Sequence
  PCR primer for ORF amplification
aattacatgactcgagttaacatttatcagctgcatttaa

SEQ ID NO: 24301 - DNA, 40 bp, Artificial Sequence
  PCR primer for ORF amplification
aattacatgactcgagctaaattcctctccagacacattt

SEQ ID NO: 24302 - DNA, 40 bp, Artificial Sequence
  PCR primer for ORF amplification
aattacatgactcgagctaatggattaaaaacctgccata

SEQ ID NO: 24303 - DNA, 40 bp, Artificial Sequence
  PCR primer for ORF amplification
aattacatgactcgagttaaatatctgccgctggaatatc

SEQ ID NO: 24304 - DNA, 40 bp, Artificial Sequence
  PCR primer for ORF amplification
aattacatgactcgagttactctactgcatactcaaaaat

SEQ ID NO: 24305 - DNA, 40 bp, Artificial Sequence
  PCR primer for ORF amplification
aattacatgactcgagttaaacggtctcaatatgctcctc

SEQ ID NO: 24306 - DNA, 40 bp, Artificial Sequence
  PCR primer for ORF amplification
aattacatgactcgagttacattaaaccctgttcgcgtaa

SEQ ID NO: 24307 - DNA, 40 bp, Artificial Sequence
  PCR primer for ORF amplification
aattacatgactcgagttaccaccatgaagcgttgctatt

SEQ ID NO: 24308 - DNA, 40 bp, Artificial Sequence
  PCR primer for ORF amplification
aattacatgactcgagtcagtccatttcaaaaattggtaa

SEQ ID NO: 24309 - DNA, 40 bp, Artificial Sequence
  PCR primer for ORF amplification
aattacatgactcgagtcatatatcatatctacgatcatc

SEQ ID NO: 24310 - DNA, 40 bp, Artificial Sequence
  PCR primer for ORF amplification
aattacatgactcgagttatatcttaacaggcgacagtcc

SEQ ID NO: 24311 - DNA, 40 bp, Artificial Sequence
  PCR primer for ORF amplification
aattacatgactcgagttatttttcgttagaaggtctttt

SEQ ID NO: 24312 - DNA, 40 bp, Artificial Sequence
  PCR primer for ORF amplification
aattacatgactcgagttaatcactattttcgtaattata

SEQ ID NO: 24313 - DNA, 40 bp, Artificial Sequence
  PCR primer for ORF amplification
aattacatgactcgagctagaagtaaacctccttcaacct

SEQ ID NO: 24314 - DNA, 40 bp, Artificial Sequence
  PCR primer for ORF amplification
aattacatgactcgagttagcaccagaaattggtcatcct

SEQ ID NO: 24315 - DNA, 40 bp, Artificial Sequence
  PCR primer for ORF amplification
aattacatgactcgagttatgcagagccagatgccgcagc

SEQ ID NO: 24316 - DNA, 40 bp, Artificial Sequence
  PCR primer for ORF amplification
aattacatgactcgagctactcttccttttttgaaatagg

SEQ ID NO: 24317 - DNA, 40 bp, Artificial Sequence
  PCR primer for ORF amplification
aattacatgactcgagttactcaggtatgctattttcatc

SEQ ID NO: 24318 - DNA, 40 bp, Artificial Sequence
  PCR primer for ORF amplification
aattacatgactcgagtcaggtccccaagcgaaattcttt

SEQ ID NO: 24319 - DNA, 40 bp, Artificial Sequence
  PCR primer for ORF amplification
aattacatgactcgagttatgacctgcctaaggcctttgc

SEQ ID NO: 24320 - DNA, 40 bp, Artificial Sequence
  PCR primer for ORF amplification
aattacatgactcgagctagtagccaaaactctcgctgtg

SEQ ID NO: 24321 - DNA, 40 bp, Artificial Sequence
  PCR primer for ORF amplification
aattacatgactcgagttatagagtatttaaaacggtttt

SEQ ID NO: 24322 - DNA, 40 bp, Artificial Sequence
  PCR primer for ORF amplification
aattacatgactcgagtcaaattaaataatgtgtaaagca

SEQ ID NO: 24323 - DNA, 40 bp, Artificial Sequence
  PCR primer for ORF amplification
aattacatgactcgagctattggttagtagaattttcatt

SEQ ID NO: 24324 - DNA, 40 bp, Artificial Sequence
  PCR primer for ORF amplification
aattacatgactcgagttaatttgaatctttattcccgtg

SEQ ID NO: 24325 - DNA, 40 bp, Artificial Sequence
  PCR primer for ORF amplification
aattacatgactcgagttaagctaacaaagccttggataa

SEQ ID NO: 24326 - DNA, 40 bp, Artificial Sequence
  PCR primer for ORF amplification
aattacatgactcgagctattttaaagcgtcggttaaaat

SEQ ID NO: 24327 - DNA, 40 bp, Artificial Sequence
  PCR primer for ORF amplification
aattacatgactcgagttaagacattaatgtattaacagc

SEQ ID NO: 24328 - DNA, 40 bp, Artificial Sequence
  PCR primer for ORF amplification
aattacatgactcgagttattcaatactatctatggaata

SEQ ID NO: 24329 - DNA, 40 bp, Artificial Sequence
  PCR primer for ORF amplification
aattacatgactcgagttattgcttccccttatagatgta

SEQ ID NO: 24330 - DNA, 40 bp, Artificial Sequence
  PCR primer for ORF amplification
aattacatgactcgagttatgatagctggttttcttgaag

SEQ ID NO: 24331 - DNA, 40 bp, Artificial Sequence
  PCR primer for ORF amplification
aattacatgactcgagtcaaaccatggcaccaaacccaaa

SEQ ID NO: 24332 - DNA, 40 bp, Artificial Sequence
  PCR primer for ORF amplification
aattacatgactcgagttagggattgttgattgataggtt

SEQ ID NO: 24333 - DNA, 40 bp, Artificial Sequence
  PCR primer for ORF amplification
aattacatgactcgagttaaagctctattagcagttcctc

SEQ ID NO: 24334 - DNA, 40 bp, Artificial Sequence
  PCR primer for ORF amplification
aattacatgactcgagtcaaaattttgtaactatattcat

SEQ ID NO: 24335 - DNA, 40 bp, Artificial Sequence
  PCR primer for ORF amplification
aattacatgactcgagttagccgcgagaaacctctatttc

SEQ ID NO: 24336 - DNA, 40 bp, Artificial Sequence
  PCR primer for ORF amplification
aattacatgactcgagttatacatgtacattctcgtacgg

SEQ ID NO: 24337 - DNA, 40 bp, Artificial Sequence
  PCR primer for ORF amplification
aattacatgactcgagttaatctctttttaaaggatccgg

SEQ ID NO: 24338 - DNA, 40 bp, Artificial Sequence
  PCR primer for ORF amplification
aattacatgactcgagctatctcactaattggttaagaac

SEQ ID NO: 24339 - DNA, 40 bp, Artificial Sequence
  PCR primer for ORF amplification
aattacatgactcgagtcaattattcatagctacttcgtt

SEQ ID NO: 24340 - DNA, 40 bp, Artificial Sequence
  PCR primer for ORF amplification
aattacatgactcgagttaatttgtcaaacttcgaagagc

SEQ ID NO: 24341 - DNA, 40 bp, Artificial Sequence
  PCR primer for ORF amplification
aattacatgactcgagctaccaagtttcctggatatatct

SEQ ID NO: 24342 - DNA, 40 bp, Artificial Sequence
  PCR primer for ORF amplification
aattacatgactcgagtcactctccaacttctctgctcga

SEQ ID NO: 24343 - DNA, 40 bp, Artificial Sequence
  PCR primer for ORF amplification
aattacatgactcgagttatttactatctgaaacaggatg

SEQ ID NO: 24344 - DNA, 40 bp, Artificial Sequence; identical to SEQ ID NO: 20344
  PCR primer for ORF amplification

SEQ ID NO: 24345 - DNA, 40 bp, Artificial Sequence
  PCR primer for ORF amplification
aattacatgactcgagttattgtttgacactggtgatttg

SEQ ID NO: 24346 - DNA, 40 bp, Artificial Sequence
  PCR primer for ORF amplification
aattacatgactcgagttaccttattcttttgttatgtgt

SEQ ID NO: 24347 - DNA, 40 bp, Artificial Sequence
  PCR primer for ORF amplification
aattacatgactcgagctacatggattcaaactctgtatc

SEQ ID NO: 24348 - DNA, 40 bp, Artificial Sequence
  PCR primer for ORF amplification
aattacatgactcgagtcaaatagcgttatttcccgcacg

SEQ ID NO: 24349 - DNA, 40 bp, Artificial Sequence
  PCR primer for ORF amplification
aattacatgactcgagttatcttttgtgtcttctgcttct

SEQ ID NO: 24350 - DNA, 40 bp, Artificial Sequence
  PCR primer for ORF amplification
aattacatgactcgagttatagggcctcgtcgatttgtaa

SEQ ID NO: 24351 - DNA, 40 bp, Artificial Sequence
  PCR primer for ORF amplification
aattacatgactcgagtcatggtaagacatttatccagaa

SEQ ID NO: 24352 - DNA, 40 bp, Artificial Sequence
  PCR primer for ORF amplification
aattacatgactcgagtcataccaaaattttgggatactt

SEQ ID NO: 24353 - DNA, 40 bp, Artificial Sequence
  PCR primer for ORF amplification
aattacatgactcgagctacatatgccttctgcactcccg

SEQ ID NO: 24354 - DNA, 40 bp, Artificial Sequence
  PCR primer for ORF amplification
aattacatgactcgagttattttgtgaccaatttctttaa

SEQ ID NO: 24355 - DNA, 40 bp, Artificial Sequence
  PCR primer for ORF amplification
aattacatgactcgagttaatacttatagaaactatcttc

SEQ ID NO: 24356 - DNA, 40 bp, Artificial Sequence
  PCR primer for ORF amplification
aattacatgactcgagttagaactgctgccgttgattttc

SEQ ID NO: 24357 - DNA, 40 bp, Artificial Sequence
  PCR primer for ORF amplification
aattacatgactcgagttagtcatccgacccatcactttc

SEQ ID NO: 24358 - DNA, 40 bp, Artificial Sequence
  PCR primer for ORF amplification
aattacatgactcgagttatttggtagcttcaggttgctt

SEQ ID NO: 24359 - DNA, 40 bp, Artificial Sequence
  PCR primer for ORF amplification
aattacatgactcgagttattcccgtttaaaagtgaattt

SEQ ID NO: 24360 - DNA, 40 bp, Artificial Sequence
  PCR primer for ORF amplification
aattacatgactcgagttacaacaaggcgtccaagaactt

SEQ ID NO: 24361 - DNA, 40 bp, Artificial Sequence
  PCR primer for ORF amplification
aattacatgactcgagtcataactggggggatgtgtgacg

SEQ ID NO: 24362 - DNA, 40 bp, Artificial Sequence
  PCR primer for ORF amplification
aattacatgactcgagctattttctatttacatgttgtaa

SEQ ID NO: 24363 - DNA, 40 bp, Artificial Sequence
  PCR primer for ORF amplification
aattacatgactcgagttaatctttcctatctttactgct

SEQ ID NO: 24364 - DNA, 40 bp, Artificial Sequence
  PCR primer for ORF amplification
aattacatgactcgagttagccgaacaaaaccttcaccaa

SEQ ID NO: 24365 - DNA, 40 bp, Artificial Sequence
  PCR primer for ORF amplification
aattacatgactcgagttaaacctttaccttcttggatga

SEQ ID NO: 24366 - DNA, 40 bp, Artificial Sequence
  PCR primer for ORF amplification
aattacatgactcgagctattgaggaacgtcaaacacagc

SEQ ID NO: 24367 - DNA, 40 bp, Artificial Sequence
  PCR primer for ORF amplification
aattacatgactcgagtcatttaccttccttaagaaattc

SEQ ID NO: 24368 - DNA, 40 bp, Artificial Sequence
  PCR primer for ORF amplification
aattacatgactcgagtcactgatcatcgattaatctttt

SEQ ID NO: 24369 - DNA, 40 bp, Artificial Sequence
  PCR primer for ORF amplification
aattacatgactcgagttaattattgctattgtttggact

SEQ ID NO: 24370 - DNA, 40 bp, Artificial Sequence
  PCR primer for ORF amplification
aattacatgactcgagttaagcttgtgcggtgttattgtg

SEQ ID NO: 24371 - DNA, 40 bp, Artificial Sequence
  PCR primer for ORF amplification
aattacatgactcgagtcaaaaatcaccgtgctttttgtg

SEQ ID NO: 24372 - DNA, 40 bp, Artificial Sequence
  PCR primer for ORF amplification
aattacatgactcgagtcaatcatatagcctactgtcctt

SEQ ID NO: 24373 - DNA, 40 bp, Artificial Sequence
  PCR primer for ORF amplification
aattacatgactcgagtcaattagcattccaggttcgaga

SEQ ID NO: 24374 - DNA, 40 bp, Artificial Sequence
  PCR primer for ORF amplification
aattacatgactcgagttaatgttcttcatcatttgataa

SEQ ID NO: 24375 - DNA, 40 bp, Artificial Sequence
  PCR primer for ORF amplification
aattacatgactcgagttaagcaatctcatcagattcatc

SEQ ID NO: 24376 - DNA, 40 bp, Artificial Sequence
  PCR primer for ORF amplification
aattacatgactcgagttatttgcttccacttagatcggt

SEQ ID NO: 24377 - DNA, 40 bp, Artificial Sequence
  PCR primer for ORF amplification
aattacatgactcgagttaagttagcgtgtactttggtcc

SEQ ID NO: 24378 - DNA, 40 bp, Artificial Sequence
  PCR primer for ORF amplification
aattacatgactcgagttaaagactggttttcctggtttt

SEQ ID NO: 24379 - DNA, 40 bp, Artificial Sequence
  PCR primer for ORF amplification
aattacatgactcgagtcagtatttctttttcatcctttc

SEQ ID NO: 24380 - DNA, 40 bp, Artificial Sequence
  PCR primer for ORF amplification
aattacatgactcgagtcattttatattctttttagagtt

SEQ ID NO: 24381 - DNA, 40 bp, Artificial Sequence
  PCR primer for ORF amplification
aattacatgactcgagctaaagtttaccaaaagcatcata

SEQ ID NO: 24382 - DNA, 40 bp, Artificial Sequence
  PCR primer for ORF amplification
aattacatgactcgagctatcttttcatgaattggccacg

SEQ ID NO: 24383 - DNA, 40 bp, Artificial Sequence
  PCR primer for ORF amplification
aattacatgactcgagtcatttttttcttgtaaaaaatga

SEQ ID NO: 24384 - DNA, 40 bp, Artificial Sequence
  PCR primer for ORF amplification
aattacatgactcgagtcaattgctttgactgttaacggc

SEQ ID NO: 24385 - DNA, 40 bp, Artificial Sequence
  PCR primer for ORF amplification
aattacatgactcgagtcatttacagtaacttgtaggaaa

SEQ ID NO: 24386 - DNA, 40 bp, Artificial Sequence
  PCR primer for ORF amplification
aattacatgactcgagttagtcacccttgtcttttttctt

SEQ ID NO: 24387 - DNA, 40 bp, Artificial Sequence
  PCR primer for ORF amplification
aattacatgactcgagttaaatgaaagtcttttcgtgttc

SEQ ID NO: 24388 - DNA, 40 bp, Artificial Sequence
  PCR primer for ORF amplification
aattacatgactcgagctagtggttttgggaagagaaatc

SEQ ID NO: 24389 - DNA, 40 bp, Artificial Sequence
  PCR primer for ORF amplification
aattacatgactcgagctaaaagaacgattttgcaagcgc

SEQ ID NO: 24390 - DNA, 40 bp, Artificial Sequence
  PCR primer for ORF amplification
aattacatgactcgagttaccaatcatcaccattgtccat

SEQ ID NO: 24391 - DNA, 40 bp, Artificial Sequence
  PCR primer for ORF amplification
aattacatgactcgagttaatcgctttctttcttgttcgt

SEQ ID NO: 24392 - DNA, 40 bp, Artificial Sequence
  PCR primer for ORF amplification
aattacatgactcgagttaacaccagaaggcaacgaccct

SEQ ID NO: 24393 - DNA, 40 bp, Artificial Sequence
  PCR primer for ORF amplification
aattacatgactcgagttaataggatctgacagctggagg

SEQ ID NO: 24394 - DNA, 40 bp, Artificial Sequence
  PCR primer for ORF amplification
aattacatgactcgagttaaataatattcaatttatcaag

SEQ ID NO: 24395 - DNA, 40 bp, Artificial Sequence
  PCR primer for ORF amplification
aattacatgactcgagtcagaaactactccaattccagtt

SEQ ID NO: 24396 - DNA, 40 bp, Artificial Sequence
  PCR primer for ORF amplification
aattacatgactcgagctattttttatttcttttaagtgc

SEQ ID NO: 24397 - DNA, 40 bp, Artificial Sequence
  PCR primer for ORF amplification
aattacatgactcgagttagtaaactatcttttcctcggt

SEQ ID NO: 24398 - DNA, 40 bp, Artificial Sequence
  PCR primer for ORF amplification
aattacatgactcgagtcaattttttaaaagttcttgaca

SEQ ID NO: 24399 - DNA, 40 bp, Artificial Sequence
  PCR primer for ORF amplification
aattacatgactcgagtcatataatttccctcaagaaccc

SEQ ID NO: 24400 - DNA, 40 bp, Artificial Sequence
  PCR primer for ORF amplification
aattacatgactcgagttagaagaaccgtttggctttagt

SEQ ID NO: 24401 - DNA, 40 bp, Artificial Sequence
  PCR primer for ORF amplification
aattacatgactcgagttagtctaattcaacaatatcaga

SEQ ID NO: 24402 - DNA, 40 bp, Artificial Sequence
  PCR primer for ORF amplification
aattacatgactcgagtcagtgacaaactcctttgtgcga

SEQ ID NO: 24403 - DNA, 40 bp, Artificial Sequence
  PCR primer for ORF amplification
aattacatgactcgagttacatatcaattaaattgaggtt

SEQ ID NO: 24404 - DNA, 40 bp, Artificial Sequence
  PCR primer for ORF amplification
aattacatgactcgagtcaatgcttcttgatgattaatgc

SEQ ID NO: 24405 - DNA, 40 bp, Artificial Sequence
  PCR primer for ORF amplification
aattacatgactcgagttacagccagtgcgacgtagcatc

SEQ ID NO: 24406 - DNA, 40 bp, Artificial Sequence
  PCR primer for ORF amplification
aattacatgactcgagtcacttatccaaggataactttcg

SEQ ID NO: 24407 - DNA, 40 bp, Artificial Sequence
  PCR primer for ORF amplification
aattacatgactcgagttaatcactgtcactgtcgctact

SEQ ID NO: 24408 - DNA, 40 bp, Artificial Sequence
  PCR primer for ORF amplification
aattacatgactcgagctatacaccaatgtggaataacag

SEQ ID NO: 24409 - DNA, 40 bp, Artificial Sequence
  PCR primer for ORF amplification
aattacatgactcgagttattcccctaaagctttctcaat

SEQ ID NO: 24410 - DNA, 40 bp, Artificial Sequence
  PCR primer for ORF amplification
aattacatgactcgagttagatatatcgtatcttttcata

SEQ ID NO: 24411 - DNA, 40 bp, Artificial Sequence
  PCR primer for ORF amplification
aattacatgactcgagtcaaaaaacatcctcatcaagcga

SEQ ID NO: 24412 - DNA, 40 bp, Artificial Sequence
  PCR primer for ORF amplification
aattacatgactcgagctaaagcatgcctttagccctata

SEQ ID NO: 24413 - DNA, 40 bp, Artificial Sequence
  PCR primer for ORF amplification
aattacatgactcgagttagattctcttcattatacacac

SEQ ID NO: 24414 - DNA, 40 bp, Artificial Sequence
  PCR primer for ORF amplification
aattacatgactcgagttaatcaacttcttcgacagttgg

SEQ ID NO: 24415 - DNA, 40 bp, Artificial Sequence
  PCR primer for ORF amplification
aattacatgactcgagtcaaagtaaaggctggaaaaccgg

SEQ ID NO: 24416 - DNA, 40 bp, Artificial Sequence
  PCR primer for ORF amplification
aattacatgactcgagctaatcattgagatcgaatttgta

SEQ ID NO: 24417 - DNA, 40 bp, Artificial Sequence
  PCR primer for ORF amplification
aattacatgactcgagctaattattttcaatgctaaaaac

SEQ ID NO: 24418 - DNA, 40 bp, Artificial Sequence
  PCR primer for ORF amplification
aattacatgactcgagttaataataaatattagaattgtg

SEQ ID NO: 24419 - DNA, 40 bp, Artificial Sequence
  PCR primer for ORF amplification
aattacatgactcgagttagtaggctcttacagttggagg

SEQ ID NO: 24420 - DNA, 40 bp, Artificial Sequence
  PCR primer for ORF amplification
aattacatgactcgagctatttacggcccttcttcttgtt

SEQ ID NO: 24421 - DNA, 40 bp, Artificial Sequence
  PCR primer for ORF amplification
aattacatgactcgagctatatttgaccattatctgcaaa

SEQ ID NO: 24422 - DNA, 40 bp, Artificial Sequence
  PCR primer for ORF amplification
aattacatgactcgagctatgcaaaatcttgatgtctttt

SEQ ID NO: 24423 - DNA, 40 bp, Artificial Sequence
  PCR primer for ORF amplification
aattacatgactcgagtcaatttctggtgaaagcttcaac

SEQ ID NO: 24424 - DNA, 40 bp, Artificial Sequence
  PCR primer for ORF amplification
aattacatgactcgagttacgagcgtatgttcatctcttc

SEQ ID NO: 24425 - DNA, 40 bp, Artificial Sequence
  PCR primer for ORF amplification
aattacatgactcgagctacctactccgtcttgctcttat

SEQ ID NO: 24426 - DNA, 40 bp, Artificial Sequence
  PCR primer for ORF amplification
aattacatgactcgagttaaagagcctggcctttagagag

SEQ ID NO: 24427 - DNA, 40 bp, Artificial Sequence
  PCR primer for ORF amplification
aattacatgactcgagttaggtaagccttggaaccttagc

SEQ ID NO: 24428 - DNA, 40 bp, Artificial Sequence
  PCR primer for ORF amplification
aattacatgactcgagttagaatgtcaagtacaacgtaca

SEQ ID NO: 24429 - DNA, 40 bp, Artificial Sequence
  PCR primer for ORF amplification
aattacatgactcgagctaaaggttcatctgtactttcag

SEQ ID NO: 24430 - DNA, 40 bp, Artificial Sequence
  PCR primer for ORF amplification
aattacatgactcgagttaatcaacttcttcaacggttgg

SEQ ID NO: 24431 - DNA, 40 bp, Artificial Sequence
  PCR primer for ORF amplification
aattacatgactcgagctaatcaacctcttcaaccgttgg

SEQ ID NO: 24432 - DNA, 40 bp, Artificial Sequence
  PCR primer for ORF amplification
aattacatgactcgagctagttcgaattgttgttatattc

SEQ ID NO: 24433 - DNA, 40 bp, Artificial Sequence
  PCR primer for ORF amplification
aattacatgactcgagttattcatccttccaacccaactt

SEQ ID NO: 24434 - DNA, 40 bp, Artificial Sequence
  PCR primer for ORF amplification
aattacatgactcgagctattccatctcaacgtcactata

SEQ ID NO: 24435 - DNA, 40 bp, Artificial Sequence
  PCR primer for ORF amplification
aattacatgactcgagctaaagtgtccatacattgatgtc

SEQ ID NO: 24436 - DNA, 40 bp, Artificial Sequence
  PCR primer for ORF amplification
aattacatgactcgagttaaaagcttaaaacatcattgat

SEQ ID NO: 24437 - DNA, 40 bp, Artificial Sequence
  PCR primer for ORF amplification
aattacatgactcgagttacattctatcaaccgggactag

SEQ ID NO: 24438 - DNA, 40 bp, Artificial Sequence
  PCR primer for ORF amplification
aattacatgactcgagttacgcttcatcttcctgaccatc

SEQ ID NO: 24439 - DNA, 40 bp, Artificial Sequence
  PCR primer for ORF amplification
aattacatgactcgagttaatcctcggttagtttgccaag

SEQ ID NO: 24440 - DNA, 40 bp, Artificial Sequence
  PCR primer for ORF amplification
aattacatgactcgagttaaaacacggccccatcacttat

SEQ ID NO: 24441 - DNA, 40 bp, Artificial Sequence
  PCR primer for ORF amplification
aattacatgactcgagtcaataagttggggttttatctaa

SEQ ID NO: 24442 - DNA, 40 bp, Artificial Sequence
  PCR primer for ORF amplification
aattacatgactcgagctagctggcttctttagctaaaga

SEQ ID NO: 24443 - DNA, 40 bp, Artificial Sequence
  PCR primer for ORF amplification
aattacatgactcgagttatttattttctctcccgttctt

SEQ ID NO: 24444 - DNA, 40 bp, Artificial Sequence
  PCR primer for ORF amplification
aattacatgactcgagtcaaagcccaaaattcattttaaa

SEQ ID NO: 24445 - DNA, 40 bp, Artificial Sequence
  PCR primer for ORF amplification
aattacatgactcgagctaacggcgcaaaaaagcctgata

SEQ ID NO: 24446 - DNA, 40 bp, Artificial Sequence
  PCR primer for ORF amplification
aattacatgactcgagttagaaggttacatttccaaaatg

SEQ ID NO: 24447 - DNA, 40 bp, Artificial Sequence
  PCR primer for ORF amplification
aattacatgactcgagctattccagattgttagaggccag

SEQ ID NO: 24448 - DNA, 40 bp, Artificial Sequence
  PCR primer for ORF amplification
aattacatgactcgagttatgacgaagtaggcacagattt

SEQ ID NO: 24449 - DNA, 40 bp, Artificial Sequence
  PCR primer for ORF amplification
aattacatgactcgagctattgctccttagcaataaagct

SEQ ID NO: 24450 - DNA, 40 bp, Artificial Sequence
  PCR primer for ORF amplification
aattacatgactcgagtcaagtgcttccccccataggctc

SEQ ID NO: 24451 - DNA, 40 bp, Artificial Sequence
  PCR primer for ORF amplification
aattacatgactcgagttattgttttgagtttgttttaaa

SEQ ID NO: 24452 - DNA, 40 bp, Artificial Sequence
  PCR primer for ORF amplification
aattacatgactcgagttatattgtaattctttcactcgt

SEQ ID NO: 24453 - DNA, 40 bp, Artificial Sequence
  PCR primer for ORF amplification
aattacatgactcgagtcaacggaaatctgtcttaccgac

SEQ ID NO: 24454 - DNA, 40 bp, Artificial Sequence
  PCR primer for ORF amplification
aattacatgactcgagtcaatctgtcacagaggaatgctt

SEQ ID NO: 24455 - DNA, 40 bp, Artificial Sequence
  PCR primer for ORF amplification
aattacatgactcgagttaagtgagctttttctttctttt

SEQ ID NO: 24456 - DNA, 40 bp, Artificial Sequence
  PCR primer for ORF amplification
aattacatgactcgagtcaattattgtgaggtagagtgga

SEQ ID NO: 24457 - DNA, 40 bp, Artificial Sequence
  PCR primer for ORF amplification
aattacatgactcgagttacttcgacaaaccatcattggt

SEQ ID NO: 24458 - DNA, 40 bp, Artificial Sequence
  PCR primer for ORF amplification
aattacatgactcgagttagggtgacggcgacttataaaa

SEQ ID NO: 24459 - DNA, 40 bp, Artificial Sequence
  PCR primer for ORF amplification
aattacatgactcgagttacagatcgacttcatcaacaaa

SEQ ID NO: 24460 - DNA, 40 bp, Artificial Sequence
  PCR primer for ORF amplification
aattacatgactcgagtcatatttctaccgttttatcaat

SEQ ID NO: 24461 - DNA, 40 bp, Artificial Sequence
  PCR primer for ORF amplification
aattacatgactcgagtcatgatttcccgtaacttccatt

SEQ ID NO: 24462 - DNA, 40 bp, Artificial Sequence
  PCR primer for ORF amplification
aattacatgactcgagtcaatcaacctcttccactgttgg

SEQ ID NO: 24463 - DNA, 40 bp, Artificial Sequence
  PCR primer for ORF amplification
aattacatgactcgagttagacaccaaacgtcttgatgaa

SEQ ID NO: 24464 - DNA, 40 bp, Artificial Sequence
  PCR primer for ORF amplification
aattacatgactcgagttagttcatatgcttattcaaagc

SEQ ID NO: 24465 - DNA, 40 bp, Artificial Sequence
  PCR primer for ORF amplification
aattacatgactcgagttataacaatccactcaaggtcag

SEQ ID NO: 24466 - DNA, 40 bp, Artificial Sequence
  PCR primer for ORF amplification
aattacatgactcgagttagaatagcaggtacgacaaaag

SEQ ID NO: 24467 - DNA, 40 bp, Artificial Sequence
  PCR primer for ORF amplification
aattacatgactcgagttatgcggaacctttgtactctct

SEQ ID NO: 24468 - DNA, 40 bp, Artificial Sequence
  PCR primer for ORF amplification
aattacatgactcgagtcattttgacagttcgccaatttt

SEQ ID NO: 24469 - DNA, 40 bp, Artificial Sequence
  PCR primer for ORF amplification
aattacatgactcgagttaccttcttttggaaggtttagt

SEQ ID NO: 24470 - DNA, 40 bp, Artificial Sequence
  PCR primer for ORF amplification
aattacatgactcgagctatctgatacctgccaacctgtt

SEQ ID NO: 24471 - DNA, 40 bp, Artificial Sequence
  PCR primer for ORF amplification
aattacatgactcgagtcaaacattttgtttttcttttgg

SEQ ID NO: 24472 - DNA, 40 bp, Artificial Sequence
  PCR primer for ORF amplification
aattacatgactcgagttatttatttttaacaccacctct

SEQ ID NO: 24473 - DNA, 40 bp, Artificial Sequence
  PCR primer for ORF amplification
aattacatgactcgagtcaagccctgttagcagagcctga

SEQ ID NO: 24474 - DNA, 40 bp, Artificial Sequence
  PCR primer for ORF amplification
aattacatgactcgagttaatcgttacagtttcccatata

SEQ ID NO: 24475 - DNA, 40 bp, Artificial Sequence
  PCR primer for ORF amplification
aattacatgactcgagttactgcttagtttcaccagattc

SEQ ID NO: 24476 - DNA, 40 bp, Artificial Sequence
  PCR primer for ORF amplification
aattacatgactcgagtcatgccatttggaaaacttccca

SEQ ID NO: 24477 - DNA, 40 bp, Artificial Sequence
  PCR primer for ORF amplification
aattacatgactcgagtcatcttaagtaacgtttgacagc

SEQ ID NO: 24478 - DNA, 40 bp, Artificial Sequence
  PCR primer for ORF amplification
aattacatgactcgagtcaatgccactttaaggatacttt

SEQ ID NO: 24479 - DNA, 40 bp, Artificial Sequence
  PCR primer for ORF amplification
aattacatgactcgagttacgtagcattagggttgcctga

SEQ ID NO: 24480 - DNA, 40 bp, Artificial Sequence
  PCR primer for ORF amplification
aattacatgactcgagttatacatttcctggtttttttgc

SEQ ID NO: 24481 - DNA, 40 bp, Artificial Sequence
  PCR primer for ORF amplification
aattacatgactcgagttacatggatgccttgacacggtc

SEQ ID NO: 24482 - DNA, 40 bp, Artificial Sequence
  PCR primer for ORF amplification
aattacatgactcgagttacaactttaatattataaatat

SEQ ID NO: 24483 - DNA, 40 bp, Artificial Sequence
  PCR primer for ORF amplification
aattacatgactcgagtcatgaagaagttcgtgttcgaga

SEQ ID NO: 24484 - DNA, 40 bp, Artificial Sequence
  PCR primer for ORF amplification
aattacatgactcgagtcagcttccagaagagggactttt

SEQ ID NO: 24485 - DNA, 40 bp, Artificial Sequence
  PCR primer for ORF amplification
aattacatgactcgagttattttaacaatttagccaaaag

SEQ ID NO: 24486 - DNA, 40 bp, Artificial Sequence
  PCR primer for ORF amplification
aattacatgactcgagtcacagctgattgctttttctagg

SEQ ID NO: 24487 - DNA, 40 bp, Artificial Sequence
  PCR primer for ORF amplification
aattacatgactcgagttaatttattctgccattgtaggg

SEQ ID NO: 24488 - DNA, 40 bp, Artificial Sequence
  PCR primer for ORF amplification
aattacatgactcgagctaatatagatctgcaatatcact

SEQ ID NO: 24489 - DNA, 40 bp, Artificial Sequence
  PCR primer for ORF amplification
aattacatgactcgagttatttaccttgattctgctggtt

SEQ ID NO: 24490 - DNA, 40 bp, Artificial Sequence
  PCR primer for ORF amplification
aattacatgactcgagttaggcttggtcgagtaacatttc

SEQ ID NO: 24491 - DNA, 40 bp, Artificial Sequence
  PCR primer for ORF amplification
aattacatgactcgagtcatttttttgaattactatactt

SEQ ID NO: 24492 - DNA, 40 bp, Artificial Sequence
  PCR primer for ORF amplification
aattacatgactcgagttatgagtaacagtagtctttaaa

SEQ ID NO: 24493 - DNA, 40 bp, Artificial Sequence
  PCR primer for ORF amplification
aattacatgactcgagtcaaactgtaaatccgaggctttc

SEQ ID NO: 24494 - DNA, 40 bp, Artificial Sequence
  PCR primer for ORF amplification
aattacatgactcgagtcaaaccattctggcggaagcatc

SEQ ID NO: 24495 - DNA, 40 bp, Artificial Sequence
  PCR primer for ORF amplification
aattacatgactcgagttagagtatttccagatctgaatc

SEQ ID NO: 24496 - DNA, 40 bp, Artificial Sequence
  PCR primer for ORF amplification
aattacatgactcgagctagtcatgagggagataaggagg

SEQ ID NO: 24497 - DNA, 40 bp, Artificial Sequence
  PCR primer for ORF amplification
aattacatgactcgagtcaattgtatagacgtttttcata

SEQ ID NO: 24498 - DNA, 40 bp, Artificial Sequence
  PCR primer for ORF amplification
aattacatgactcgagttagtatacggaggagattcctct

SEQ ID NO: 24499 - DNA, 40 bp, Artificial Sequence
  PCR primer for ORF amplification
aattacatgactcgagtcagtcaaaggtggctttgcgaag

SEQ ID NO: 24500 - DNA, 40 bp, Artificial Sequence
  PCR primer for ORF amplification
aattacatgactcgagtcattggtcttcaaatgtcaaact

SEQ ID NO: 24501 - DNA, 40 bp, Artificial Sequence
  PCR primer for ORF amplification
aattacatgactcgagttagttttttatatgaccaacatt

SEQ ID NO: 24502 - DNA, 40 bp, Artificial Sequence
  PCR primer for ORF amplification
aattacatgactcgagttacattgggaagggcatctgaga

SEQ ID NO: 24503 - DNA, 40 bp, Artificial Sequence
  PCR primer for ORF amplification
aattacatgactcgagttatttagccgcccgcgttttcct

SEQ ID NO: 24504 - DNA, 40 bp, Artificial Sequence
  PCR primer for ORF amplification
aattacatgactcgagttactttgcaaggcaatctaacga

SEQ ID NO: 24505 - DNA, 40 bp, Artificial Sequence
  PCR primer for ORF amplification
aattacatgactcgagctaggtcgaagccggaacttgaga

SEQ ID NO: 24506 - DNA, 40 bp, Artificial Sequence
  PCR primer for ORF amplification
aattacatgactcgagttattttgagaattttgatgattt

SEQ ID NO: 24507 - DNA, 40 bp, Artificial Sequence
  PCR primer for ORF amplification
aattacatgactcgagctatgtagaagtatgacgatgaat

SEQ ID NO: 24508 - DNA, 40 bp, Artificial Sequence
  PCR primer for ORF amplification
aattacatgactcgagttatttttgttgcatttgcttaga

SEQ ID NO: 24509 - DNA, 40 bp, Artificial Sequence
  PCR primer for ORF amplification
aattacatgactcgagttaacaccagaaatcaagaactct

SEQ ID NO: 24510 - DNA, 40 bp, Artificial Sequence
  PCR primer for ORF amplification
aattacatgactcgagttacataacagtggctattcttgc

SEQ ID NO: 24511 - DNA, 40 bp, Artificial Sequence
  PCR primer for ORF amplification
aattacatgactcgagctattctggtgattcatcatcttc

SEQ ID NO: 24512 - DNA, 40 bp, Artificial Sequence
  PCR primer for ORF amplification
aattacatgactcgagttaccatcccatgaaatcttcgga

SEQ ID NO: 24513 - DNA, 40 bp, Artificial Sequence
  PCR primer for ORF amplification
aattacatgactcgagtcattctttccattcccaacatgt

SEQ ID NO: 24514 - DNA, 40 bp, Artificial Sequence
  PCR primer for ORF amplification
aattacatgactcgagctatttagaacactctttagatct

SEQ ID NO: 24515 - DNA, 40 bp, Artificial Sequence
  PCR primer for ORF amplification
aattacatgactcgagctatgccgtcttctcaacttcttt

SEQ ID NO: 24516 - DNA, 40 bp, Artificial Sequence
  PCR primer for ORF amplification
aattacatgactcgagctaaattagaccgaagacggcact

SEQ ID NO: 24517 - DNA, 40 bp, Artificial Sequence
  PCR primer for ORF amplification
aattacatgactcgagtcagagtcgatatttcaaaccatt

SEQ ID NO: 24518 - DNA, 40 bp, Artificial Sequence
  PCR primer for ORF amplification
aattacatgactcgagctaatatatgttgctgtttctact

SEQ ID NO: 24519 - DNA, 40 bp, Artificial Sequence
  PCR primer for ORF amplification
aattacatgactcgagttaatcaaaataaaaattttgggt

SEQ ID NO: 24520 - DNA, 40 bp, Artificial Sequence
  PCR primer for ORF amplification
aattacatgactcgagttattcaggctcaaaagcttgatc

SEQ ID NO: 24521 - DNA, 40 bp, Artificial Sequence
  PCR primer for ORF amplification
aattacatgactcgagttattgtgtagtagttgaagtgtt

SEQ ID NO: 24522 - DNA, 40 bp, Artificial Sequence
  PCR primer for ORF amplification
aattacatgactcgagttatgcatcgttgttgctgctatt

SEQ ID NO: 24523 - DNA, 40 bp, Artificial Sequence
  PCR primer for ORF amplification
aattacatgactcgagttatctatagtgcttttgcttttt

SEQ ID NO: 24524 - DNA, 40 bp, Artificial Sequence
  PCR primer for ORF amplification
aattacatgactcgagttagtcagtttcagcttcagcttc

SEQ ID NO: 24525 - DNA, 40 bp, Artificial Sequence
  PCR primer for ORF amplification
aattacatgactcgagttagtatatgtattttttgcatgc

SEQ ID NO: 24526 - DNA, 40 bp, Artificial Sequence
  PCR primer for ORF amplification
aattacatgactcgagctagtcaactttaatggatgagta

SEQ ID NO: 24527 - DNA, 40 bp, Artificial Sequence
  PCR primer for ORF amplification
aattacatgactcgagctatgtggattctggagcaaataa

SEQ ID NO: 24528 - DNA, 40 bp, Artificial Sequence
  PCR primer for ORF amplification
aattacatgactcgagctataaaccacccatatgtaatgc

SEQ ID NO: 24529 - DNA, 40 bp, Artificial Sequence
  PCR primer for ORF amplification
aattacatgactcgagttaccatagattcttcttgttttg

SEQ ID NO: 24530 - DNA, 40 bp, Artificial Sequence
  PCR primer for ORF amplification
aattacatgactcgagttaggaatctctgtttgcataaga

SEQ ID NO: 24531 - DNA, 40 bp, Artificial Sequence
  PCR primer for ORF amplification
aattacatgactcgagtcaattgatttcactcaatgacaa

SEQ ID NO: 24532 - DNA, 40 bp, Artificial Sequence
  PCR primer for ORF amplification
aattacatgactcgagtcagttaatgtcattctgcagttt

SEQ ID NO: 24533 - DNA, 40 bp, Artificial Sequence
  PCR primer for ORF amplification
aattacatgactcgagtcaaagaccttgatgcagtagctg

SEQ ID NO: 24534 - DNA, 40 bp, Artificial Sequence
  PCR primer for ORF amplification
aattacatgactcgagtcatgttaccttcttagcattacc

SEQ ID NO: 24535 - DNA, 40 bp, Artificial Sequence
  PCR primer for ORF amplification
aattacatgactcgagttacatgactggttggcttggctt

SEQ ID NO: 24536 - DNA, 40 bp, Artificial Sequence
  PCR primer for ORF amplification
aattacatgactcgagctacaattggttggtgtgcaccga

SEQ ID NO: 24537 - DNA, 40 bp, Artificial Sequence
  PCR primer for ORF amplification
aattacatgactcgagtcataatttaattgtttgtgcatc

SEQ ID NO: 24538 - DNA, 40 bp, Artificial Sequence
  PCR primer for ORF amplification
aattacatgactcgagtcataactttgcttttcgtttatt

SEQ ID NO: 24539 - DNA, 40 bp, Artificial Sequence
  PCR primer for ORF amplification
aattacatgactcgagctaacccaaggcttgatgattgct

SEQ ID NO: 24540 - DNA, 40 bp, Artificial Sequence
  PCR primer for ORF amplification
aattacatgactcgagtcacagcatatccttgaagatagt

SEQ ID NO: 24541 - DNA, 40 bp, Artificial Sequence
  PCR primer for ORF amplification
aattacatgactcgagctaattatcagaatcgatgtcatc

SEQ ID NO: 24542 - DNA, 40 bp, Artificial Sequence
  PCR primer for ORF amplification
aattacatgactcgagtcatttctttttccctttcttctt

SEQ ID NO: 24543 - DNA, 40 bp, Artificial Sequence
  PCR primer for ORF amplification
aattacatgactcgagtcaaagacctaaatcttgtttcac

SEQ ID NO: 24544 - DNA, 40 bp, Artificial Sequence
  PCR primer for ORF amplification
aattacatgactcgagtcactcaactttaatggcagagta

SEQ ID NO: 24545 - DNA, 40 bp, Artificial Sequence
  PCR primer for ORF amplification
aattacatgactcgagttattctttctgaaccttctcaaa

SEQ ID NO: 24546 - DNA, 40 bp, Artificial Sequence
  PCR primer for ORF amplification
aattacatgactcgagtcaatgtagaagagaaggatgaat

SEQ ID NO: 24547 - DNA, 40 bp, Artificial Sequence
  PCR primer for ORF amplification
aattacatgactcgagtcatgacaggtattcgagtgttaa

SEQ ID NO: 24548 - DNA, 40 bp, Artificial Sequence
  PCR primer for ORF amplification
aattacatgactcgagctagaccttcattggatataccat

SEQ ID NO: 24549 - DNA, 40 bp, Artificial Sequence
  PCR primer for ORF amplification
aattacatgactcgagttaagatcgctgtagccctccttt

SEQ ID NO: 24550 - DNA, 40 bp, Artificial Sequence
  PCR primer for ORF amplification
aattacatgactcgagtcatgtgtaattaggggtattgga

SEQ ID NO: 24551 - DNA, 40 bp, Artificial Sequence
  PCR primer for ORF amplification
aattacatgactcgagtcattttataccagtaaaatagtc

SEQ ID NO: 24552 - DNA, 40 bp, Artificial Sequence
  PCR primer for ORF amplification
aattacatgactcgagttaatcatctttatatccagaaga

SEQ ID NO: 24553 - DNA, 40 bp, Artificial Sequence
  PCR primer for ORF amplification
aattacatgactcgagtcacaacttcagttctaccaattg

SEQ ID NO: 24554 - DNA, 40 bp, Artificial Sequence
  PCR primer for ORF amplification
aattacatgactcgagttaccttgcaaagtttttttcagc

SEQ ID NO: 24555 - DNA, 40 bp, Artificial Sequence
  PCR primer for ORF amplification
aattacatgactcgagctaaagattggtttggtagaatgt

SEQ ID NO: 24556 - DNA, 40 bp, Artificial Sequence
  PCR primer for ORF amplification
aattacatgactcgagttactctttcttatcctttatgtc

SEQ ID NO: 24557 - DNA, 40 bp, Artificial Sequence
  PCR primer for ORF amplification
aattacatgactcgagttactgcattatttctcccttcaa

SEQ ID NO: 24558 - DNA, 40 bp, Artificial Sequence
  PCR primer for ORF amplification
aattacatgactcgagttacaagtaacgaggaactcgcac

SEQ ID NO: 24559 - DNA, 40 bp, Artificial Sequence
  PCR primer for ORF amplification
aattacatgactcgagttatattttgcttgaatttttttc

SEQ ID NO: 24560 - DNA, 40 bp, Artificial Sequence
  PCR primer for ORF amplification
aattacatgactcgagctagactatattcaacttactgta

SEQ ID NO: 24561 - DNA, 40 bp, Artificial Sequence
  PCR primer for ORF amplification
aattacatgactcgagttagatattctccttaacatcaca

SEQ ID NO: 24562 - DNA, 40 bp, Artificial Sequence
  PCR primer for ORF amplification
aattacatgactcgagctaactaatgcttctcccctgcga

SEQ ID NO: 24563 - DNA, 40 bp, Artificial Sequence
  PCR primer for ORF amplification
aattacatgactcgagttaacctgacttggtgctctcaac

SEQ ID NO: 24564 - DNA, 40 bp, Artificial Sequence
  PCR primer for ORF amplification
aattacatgactcgagttaaagttcgaaaagttttctgac

SEQ ID NO: 24565 - DNA, 40 bp, Artificial Sequence
  PCR primer for ORF amplification
aattacatgactcgagttatttgtggaatatttgcttaca

SEQ ID NO: 24566 - DNA, 40 bp, Artificial Sequence
  PCR primer for ORF amplification
aattacatgactcgagttaacatttgctttctattgaagg

SEQ ID NO: 24567 - DNA, 40 bp, Artificial Sequence
  PCR primer for ORF amplification
aattacatgactcgagttatgatacgcctggttcaggctt

SEQ ID NO: 24568 - DNA, 40 bp, Artificial Sequence
  PCR primer for ORF amplification
aattacatgactcgagttaactctcttgtcccgatttctc

SEQ ID NO: 24569 - DNA, 40 bp, Artificial Sequence
  PCR primer for ORF amplification
aattacatgactcgagtcatttgttcaaagtcattaacga

SEQ ID NO: 24570 - DNA, 40 bp, Artificial Sequence
  PCR primer for ORF amplification
aattacatgactcgagtcaaagagagctttcctctaactc

SEQ ID NO: 24571 - DNA, 40 bp, Artificial Sequence
  PCR primer for ORF amplification
aattacatgactcgagctaaagggagtgaaaagacgcttc

SEQ ID NO: 24572 - DNA, 40 bp, Artificial Sequence
  PCR primer for ORF amplification
aattacatgactcgagttattgggtgatggatcgaaaggt

SEQ ID NO: 24573 - DNA, 40 bp, Artificial Sequence
  PCR primer for ORF amplification
aattacatgactcgagctatcgatttatgccatgaactga

SEQ ID NO: 24574 - DNA, 40 bp, Artificial Sequence
  PCR primer for ORF amplification
aattacatgactcgagttataaataattacctaatttata

SEQ ID NO: 24575 - DNA, 40 bp, Artificial Sequence
  PCR primer for ORF amplification
aattacatgactcgagttagaaagcttttttcaaaggaga

SEQ ID NO: 24576 - DNA, 40 bp, Artificial Sequence
  PCR primer for ORF amplification
aattacatgactcgagtcaggcatatacaattatttcgtc

SEQ ID NO: 24577 - DNA, 40 bp, Artificial Sequence
  PCR primer for ORF amplification
aattacatgactcgagctatctaatgcttctaccttgcac

SEQ ID NO: 24578 - DNA, 40 bp, Artificial Sequence
  PCR primer for ORF amplification
aattacatgactcgagttagaaagctcttcccataggaga

SEQ ID NO: 24579 - DNA, 40 bp, Artificial Sequence
  PCR primer for ORF amplification
aattacatgactcgagttattgatctagctcatcttggcc

SEQ ID NO: 24580 - DNA, 40 bp, Artificial Sequence
  PCR primer for ORF amplification
aattacatgactcgagctaaagcgattcatcttgctgtag

SEQ ID NO: 24581 - DNA, 40 bp, Artificial Sequence
  PCR primer for ORF amplification
aattacatgactcgagctacaattcgtcgtgttcgaaata

SEQ ID NO: 24582 - DNA, 40 bp, Artificial Sequence
  PCR primer for ORF amplification
aattacatgactcgagttacaaataatcgtcaatgttggg

SEQ ID NO: 24583 - DNA, 40 bp, Artificial Sequence
  PCR primer for ORF amplification
aattacatgactcgagttatttctttttttgagagaaaaa

SEQ ID NO: 24584 - DNA, 40 bp, Artificial Sequence
  PCR primer for ORF amplification
aattacatgactcgagttagtgagtggagtggcccctgtg

SEQ ID NO: 24585 - DNA, 40 bp, Artificial Sequence
  PCR primer for ORF amplification
aattacatgactcgagctattcggattggttttcgggatt

SEQ ID NO: 24586 - DNA, 40 bp, Artificial Sequence
  PCR primer for ORF amplification
aattacatgactcgagtcaattagcagcgctaggagcttc

SEQ ID NO: 24587 - DNA, 40 bp, Artificial Sequence
  PCR primer for ORF amplification
aattacatgactcgagttaatttagacttttcaacgtctc

SEQ ID NO: 24588 - DNA, 40 bp, Artificial Sequence
  PCR primer for ORF amplification
aattacatgactcgagttaggaacgaatatgcaacccaaa

SEQ ID NO: 24589 - DNA, 40 bp, Artificial Sequence
  PCR primer for ORF amplification
aattacatgactcgagtcaagtcatctgaacatccctatc

SEQ ID NO: 24590 - DNA, 40 bp, Artificial Sequence
  PCR primer for ORF amplification
aattacatgactcgagctatttttttgcgtgctttctctt

SEQ ID NO: 24591 - DNA, 40 bp, Artificial Sequence
  PCR primer for ORF amplification
aattacatgactcgagttactcggcaattttaacaatttt

SEQ ID NO: 24592 - DNA, 40 bp, Artificial Sequence
  PCR primer for ORF amplification
aattacatgactcgagtcattgtaccaaatcactattcat

SEQ ID NO: 24593 - DNA, 40 bp, Artificial Sequence
  PCR primer for ORF amplification
aattacatgactcgagttataatgcaaaactttctccgtg

SEQ ID NO: 24594 - DNA, 40 bp, Artificial Sequence
  PCR primer for ORF amplification
aattacatgactcgagtcactcttcttcactttcgctgct

SEQ ID NO: 24595 - DNA, 40 bp, Artificial Sequence
  PCR primer for ORF amplification
aattacatgactcgagttatactgctccggtaaacatcaa

SEQ ID NO: 24596 - DNA, 40 bp, Artificial Sequence
  PCR primer for ORF amplification
aattacatgactcgagttaccatgtaaaactttcttcttc

SEQ ID NO: 24597 - DNA, 40 bp, Artificial Sequence
  PCR primer for ORF amplification
aattacatgactcgagttatgatttgaaatcgtttattgg

SEQ ID NO: 24598 - DNA, 40 bp, Artificial Sequence
  PCR primer for ORF amplification
aattacatgactcgagctaggcaactgccatgtctccagg

SEQ ID NO: 24599 - DNA, 40 bp, Artificial Sequence
  PCR primer for ORF amplification
aattacatgactcgagttacaccttcttttgctggatgta

SEQ ID NO: 24600 - DNA, 40 bp, Artificial Sequence
  PCR primer for ORF amplification
aattacatgactcgagtcacatagaatcgaaatctgtgtc

SEQ ID NO: 24601 - DNA, 40 bp, Artificial Sequence
  PCR primer for ORF amplification
aattacatgactcgagtcagtgcttaccgcctgtacgctt

SEQ ID NO: 24602 - DNA, 40 bp, Artificial Sequence
  PCR primer for ORF amplification
aattacatgactcgagtcaaccggacacgctcacgtcgaa

SEQ ID NO: 24603 - DNA, 40 bp, Artificial Sequence
  PCR primer for ORF amplification
aattacatgactcgagtcatgtggcattctccgcgccctt

SEQ ID NO: 24604 - DNA, 40 bp, Artificial Sequence
  PCR primer for ORF amplification
aattacatgactcgagtcaaagtgcctgttcctgtttcca

SEQ ID NO: 24605 - DNA, 40 bp, Artificial Sequence
  PCR primer for ORF amplification
aattacatgactcgagttagaactgaacagaacccatggc

SEQ ID NO: 24606 - DNA, 40 bp, Artificial Sequence
  PCR primer for ORF amplification
aattacatgactcgagtcaggttgcatctggaaggttttt

SEQ ID NO: 24607 - DNA, 40 bp, Artificial Sequence
  PCR primer for ORF amplification
aattacatgactcgagctaataagaacgaccgaacataca

SEQ ID NO: 24608 - DNA, 40 bp, Artificial Sequence
  PCR primer for ORF amplification
aattacatgactcgagtcactttctattaaacatatcaaa

SEQ ID NO: 24609 - DNA, 40 bp, Artificial Sequence
  PCR primer for ORF amplification
aattacatgactcgagttagctactgcaggaagcttgcat

SEQ ID NO: 24610 - DNA, 40 bp, Artificial Sequence
  PCR primer for ORF amplification
aattacatgactcgagttaaaacttgtcatagctggtttc

SEQ ID NO: 24611 - DNA, 40 bp, Artificial Sequence
  PCR primer for ORF amplification
aattacatgactcgagctaacctttattgagagaaattcc

SEQ ID NO: 24612 - DNA, 40 bp, Artificial Sequence
  PCR primer for ORF amplification
aattacatgactcgagttaaattaaccttattaatgatgt

SEQ ID NO: 24613 - DNA, 40 bp, Artificial Sequence
  PCR primer for ORF amplification
aattacatgactcgagtcactttataaaagatcttctttt

SEQ ID NO: 24614 - DNA, 40 bp, Artificial Sequence
  PCR primer for ORF amplification
aattacatgactcgagttaatcaattttgtcgtacaattt

SEQ ID NO: 24615 - DNA, 40 bp, Artificial Sequence
  PCR primer for ORF amplification
aattacatgactcgagttagatatatatctcttcttgtat

SEQ ID NO: 24616 - DNA, 40 bp, Artificial Sequence
  PCR primer for ORF amplification
aattacatgactcgagttaactctgaacctttttagcaat

SEQ ID NO: 24617 - DNA, 40 bp, Artificial Sequence
  PCR primer for ORF amplification
aattacatgactcgagtcatagttcttgctggtcttttag

SEQ ID NO: 24618 - DNA, 40 bp, Artificial Sequence
  PCR primer for ORF amplification
aattacatgactcgagctaatcttctggcttcacatactt

SEQ ID NO: 24619 - DNA, 40 bp, Artificial Sequence
  PCR primer for ORF amplification
aattacatgactcgagttaagatatagagttcatgatcct

SEQ ID NO: 24620 - DNA, 40 bp, Artificial Sequence
  PCR primer for ORF amplification
aattacatgactcgagtcaaagtgtctttctatgctcacc

SEQ ID NO: 24621 - DNA, 40 bp, Artificial Sequence
  PCR primer for ORF amplification
aattacatgactcgagtcattcaatagtatcatttggatc

SEQ ID NO: 24622 - DNA, 40 bp, Artificial Sequence
  PCR primer for ORF amplification
aattacatgactcgagttaatttgttacgttatgttcagt

SEQ ID NO: 24623 - DNA, 40 bp, Artificial Sequence
  PCR primer for ORF amplification
aattacatgactcgagttaccagacatcttcttggtatct

SEQ ID NO: 24624 - DNA, 40 bp, Artificial Sequence
  PCR primer for ORF amplification
aattacatgactcgagttactggctccacattttaatcgt

SEQ ID NO: 24625 - DNA, 40 bp, Artificial Sequence
  PCR primer for ORF amplification
aattacatgactcgagttaagtcaacttttctggaacagt

SEQ ID NO: 24626 - DNA, 40 bp, Artificial Sequence
  PCR primer for ORF amplification
aattacatgactcgagctattttcttttcttagcaaggag

SEQ ID NO: 24627 - DNA, 40 bp, Artificial Sequence
  PCR primer for ORF amplification
aattacatgactcgagtcaatggtcgtccaacgtttcttc

SEQ ID NO: 24628 - DNA, 40 bp, Artificial Sequence
  PCR primer for ORF amplification
aattacatgactcgagtcactccagcttaaacatggcggt

SEQ ID NO: 24629 - DNA, 40 bp, Artificial Sequence
  PCR primer for ORF amplification
aattacatgactcgagttactgttgagattcgttatcatt

SEQ ID NO: 24630 - DNA, 40 bp, Artificial Sequence
  PCR primer for ORF amplification
aattacatgactcgagttaatcaaggtccatgttttcatc

SEQ ID NO: 24631 - DNA, 40 bp, Artificial Sequence
  PCR primer for ORF amplification
aattacatgactcgagttagtccatgtcaacatcaccttc

SEQ ID NO: 24632 - DNA, 40 bp, Artificial Sequence
  PCR primer for ORF amplification
aattacatgactcgagttatagttgggatttgacccaacc

SEQ ID NO: 24633 - DNA, 40 bp, Artificial Sequence
  PCR primer for ORF amplification
aattacatgactcgagttacaacacgtctccccttcttgg

SEQ ID NO: 24634 - DNA, 40 bp, Artificial Sequence
  PCR primer for ORF amplification
aattacatgactcgagttaagtgttttctttataaactct

SEQ ID NO: 24635 - DNA, 40 bp, Artificial Sequence
  PCR primer for ORF amplification
aattacatgactcgagttaccacagcaatgccttaatgat

SEQ ID NO: 24636 - DNA, 40 bp, Artificial Sequence
  PCR primer for ORF amplification
aattacatgactcgagctaccaattctggaattcctccac

SEQ ID NO: 24637 - DNA, 40 bp, Artificial Sequence
  PCR primer for ORF amplification
aattacatgactcgagtcataacgaagacatgaaattatc

SEQ ID NO: 24638 - DNA, 40 bp, Artificial Sequence
  PCR primer for ORF amplification
aattacatgactcgagctaagaattttctttgtaaaccct

SEQ ID NO: 24639 - DNA, 40 bp, Artificial Sequence
  PCR primer for ORF amplification
aattacatgactcgagttatttcgcgattgctatgagctt

SEQ ID NO: 24640 - DNA, 40 bp, Artificial Sequence
  PCR primer for ORF amplification
aattacatgactcgagtcaggggctgtctggcgtgaagag

SEQ ID NO: 24641 - DNA, 40 bp, Artificial Sequence
  PCR primer for ORF amplification
aattacatgactcgagttatacttcccgggcaacactatt

SEQ ID NO: 24642 - DNA, 40 bp, Artificial Sequence
  PCR primer for ORF amplification
aattacatgactcgagttaagcccctaagagggctgtgtt

SEQ ID NO: 24643 - DNA, 40 bp, Artificial Sequence
  PCR primer for ORF amplification
aattacatgactcgagttacataattacacagtctttttt

SEQ ID NO: 24644 - DNA, 40 bp, Artificial Sequence
  PCR primer for ORF amplification
aattacatgactcgagctataaagctccgtaaataattcc

SEQ ID NO: 24645 - DNA, 40 bp, Artificial Sequence
  PCR primer for ORF amplification
aattacatgactcgagtcaccatcttccaccacttcttgt

SEQ ID NO: 24646 - DNA, 40 bp, Artificial Sequence
  PCR primer for ORF amplification
aattacatgactcgagtcaagaccttttgggcacaatttg

SEQ ID NO: 24647 - DNA, 40 bp, Artificial Sequence
  PCR primer for ORF amplification
aattacatgactcgagttagcacttttcttggatttctat

SEQ ID NO: 24648 - DNA, 40 bp, Artificial Sequence
  PCR primer for ORF amplification
aattacatgactcgagtcatccaataaagctaacacttgt

SEQ ID NO: 24649 - DNA, 40 bp, Artificial Sequence
  PCR primer for ORF amplification
aattacatgactcgagctaaatgaaagctagaggaagagc

SEQ ID NO: 24650 - DNA, 40 bp, Artificial Sequence
  PCR primer for ORF amplification
aattacatgactcgagtcaggaaaatctgtagacaatctt

SEQ ID NO: 24651 - DNA, 40 bp, Artificial Sequence
  PCR primer for ORF amplification
aattacatgactcgagtcaagtaggagtatctggcacttg

SEQ ID NO: 24652 - DNA, 40 bp, Artificial Sequence
  PCR primer for ORF amplification
aattacatgactcgagtcatccatctagttgtggatcaat

SEQ ID NO: 24653 - DNA, 40 bp, Artificial Sequence
  PCR primer for ORF amplification
aattacatgactcgagttacgttcgctgatgcaggccgcc

SEQ ID NO: 24654 - DNA, 40 bp, Artificial Sequence; identical to SEQ ID NO: 24402
  PCR primer for ORF amplification

SEQ ID NO: 24655 - DNA, 40 bp, Artificial Sequence
  PCR primer for ORF amplification
aattacatgactcgagttacaagtgcactgtcaataaatc

SEQ ID NO: 24656 - DNA, 40 bp, Artificial Sequence
  PCR primer for ORF amplification
aattacatgactcgagttaagacgaactataaacggcgtc

SEQ ID NO: 24657 - DNA, 40 bp, Artificial Sequence
  PCR primer for ORF amplification
aattacatgactcgagtcacgaaaagggccgtttcataga

SEQ ID NO: 24658 - DNA, 40 bp, Artificial Sequence
  PCR primer for ORF amplification
aattacatgactcgagttaatcttgatttttttttttctc

SEQ ID NO: 24659 - DNA, 40 bp, Artificial Sequence
  PCR primer for ORF amplification
aattacatgactcgagctataatatgttaccatatataat

SEQ ID NO: 24660 - DNA, 40 bp, Artificial Sequence
  PCR primer for ORF amplification
aattacatgactcgagctatgtgatattcagatgtttgat

SEQ ID NO: 24661 - DNA, 40 bp, Artificial Sequence
  PCR primer for ORF amplification
aattacatgactcgagttataaatcgaaatgatattgttt

SEQ ID NO: 24662 - DNA, 40 bp, Artificial Sequence
  PCR primer for ORF amplification
aattacatgactcgagttaatttagttccacgtccttatt

SEQ ID NO: 24663 - DNA, 40 bp, Artificial Sequence
  PCR primer for ORF amplification
aattacatgactcgagttatttacctttataaacaaattg

SEQ ID NO: 24664 - DNA, 40 bp, Artificial Sequence
  PCR primer for ORF amplification
aattacatgactcgagtcattcacttaaattgaacttagg

SEQ ID NO: 24665 - DNA, 40 bp, Artificial Sequence
  PCR primer for ORF amplification
aattacatgactcgagtcacatatacagatattcacagtt

SEQ ID NO: 24666 - DNA, 40 bp, Artificial Sequence
  PCR primer for ORF amplification
aattacatgactcgagttaaatgtctccatgttttttatg

SEQ ID NO: 24667 - DNA, 40 bp, Artificial Sequence
  PCR primer for ORF amplification
aattacatgactcgagttaaatttccctggattcccacca

SEQ ID NO: 24668 - DNA, 40 bp, Artificial Sequence
  PCR primer for ORF amplification
aattacatgactcgagttaccattctaaggttaataactt

SEQ ID NO: 24669 - DNA, 40 bp, Artificial Sequence
  PCR primer for ORF amplification
aattacatgactcgagctaaacagaggagacgatttgact

SEQ ID NO: 24670 - DNA, 40 bp, Artificial Sequence
  PCR primer for ORF amplification
aattacatgactcgagctatatttgaaatctgagattttc

SEQ ID NO: 24671 - DNA, 40 bp, Artificial Sequence
  PCR primer for ORF amplification
aattacatgactcgagtcattcttttaaggcaagcaccaa

SEQ ID NO: 24672 - DNA, 40 bp, Artificial Sequence
  PCR primer for ORF amplification
aattacatgactcgagctatctggaaaagaagtcctcaaa

SEQ ID NO: 24673 - DNA, 40 bp, Artificial Sequence
  PCR primer for ORF amplification
aattacatgactcgagtcatgaatcatttcctagtaatcc

SEQ ID NO: 24674 - DNA, 40 bp, Artificial Sequence
  PCR primer for ORF amplification
aattacatgactcgagtcaactagcaatcaagtcaactct

SEQ ID NO: 24675 - DNA, 40 bp, Artificial Sequence
  PCR primer for ORF amplification
aattacatgactcgagttaatcaacttcttccatctcggt

SEQ ID NO: 24676 - DNA, 40 bp, Artificial Sequence
  PCR primer for ORF amplification
aattacatgactcgagttaactgtcatcagcatatgggcc

SEQ ID NO: 24677 - DNA, 40 bp, Artificial Sequence
  PCR primer for ORF amplification
aattacatgactcgagttaatctacggtaacaattgtgga

SEQ ID NO: 24678 - DNA, 40 bp, Artificial Sequence
  PCR primer for ORF amplification
aattacatgactcgagttacaggttgactttctggtggta

SEQ ID NO: 24679 - DNA, 40 bp, Artificial Sequence
  PCR primer for ORF amplification
aattacatgactcgagtcatttatcgttatccacgacagg

SEQ ID NO: 24680 - DNA, 40 bp, Artificial Sequence
  PCR primer for ORF amplification
aattacatgactcgagctaaattagtccaaataatgctgt

SEQ ID NO: 24681 - DNA, 40 bp, Artificial Sequence
  PCR primer for ORF amplification
aattacatgactcgagctatatacgtctgaaaacgctctt

SEQ ID NO: 24682 - DNA, 40 bp, Artificial Sequence
  PCR primer for ORF amplification
aattacatgactcgagtcattcttcatcactccattcttc

SEQ ID NO: 24683 - DNA, 40 bp, Artificial Sequence
  PCR primer for ORF amplification
aattacatgactcgagctagttgaagttgatgagcctcgt

SEQ ID NO: 24684 - DNA, 40 bp, Artificial Sequence
  PCR primer for ORF amplification
aattacatgactcgagtcatctttttatggtcgacgagga

SEQ ID NO: 24685 - DNA, 40 bp, Artificial Sequence
  PCR primer for ORF amplification
aattacatgactcgagttatctcatttttccttgcatttc

SEQ ID NO: 24686 - DNA, 40 bp, Artificial Sequence
  PCR primer for ORF amplification
aattacatgactcgagctacataccacggaacgcattttt

SEQ ID NO: 24687 - DNA, 40 bp, Artificial Sequence
  PCR primer for ORF amplification
aattacatgactcgagttaggcagatgggtcttcttcgaa

SEQ ID NO: 24688 - DNA, 40 bp, Artificial Sequence
  PCR primer for ORF amplification
aattacatgactcgagttaataattaggacacaattgatc

SEQ ID NO: 24689 - DNA, 40 bp, Artificial Sequence
  PCR primer for ORF amplification
aattacatgactcgagttatttctttgcaccatacttgtt

SEQ ID NO: 24690 - DNA, 40 bp, Artificial Sequence
  PCR primer for ORF amplification
aattacatgactcgagctagaggtcaagggcccataaata

SEQ ID NO: 24691 - DNA, 40 bp, Artificial Sequence
  PCR primer for ORF amplification
aattacatgactcgagttagtctctttttacctttttcac

SEQ ID NO: 24692 - DNA, 40 bp, Artificial Sequence
  PCR primer for ORF amplification
aattacatgactcgagttaattatcctcgtagtatgcaga

SEQ ID NO: 24693 - DNA, 40 bp, Artificial Sequence
  PCR primer for ORF amplification
aattacatgactcgagtcatttacgaataatttcatccaa

SEQ ID NO: 24694 - DNA, 40 bp, Artificial Sequence
  PCR primer for ORF amplification
aattacatgactcgagttacctttgattagttttcattgg

SEQ ID NO: 24695 - DNA, 40 bp, Artificial Sequence
  PCR primer for ORF amplification
aattacatgactcgagctaatctacctcttccatttcggt

SEQ ID NO: 24696 - DNA, 40 bp, Artificial Sequence
  PCR primer for ORF amplification
aattacatgactcgagtcagaaattagtcacgttgtggaa

SEQ ID NO: 24697 - DNA, 40 bp, Artificial Sequence
  PCR primer for ORF amplification
aattacatgactcgagttattggaagttttctagaacctg

SEQ ID NO: 24698 - DNA, 40 bp, Artificial Sequence
  PCR primer for ORF amplification
aattacatgactcgagttaagcgtctgacatttcaacatc

SEQ ID NO: 24699 - DNA, 40 bp, Artificial Sequence
  PCR primer for ORF amplification
aattacatgactcgagtcagcgattggctaatttacgttc

SEQ ID NO: 24700 - DNA, 40 bp, Artificial Sequence
  PCR primer for ORF amplification
aattacatgactcgagtcataattctctatcaaggaaaga

SEQ ID NO: 24701 - DNA, 40 bp, Artificial Sequence
  PCR primer for ORF amplification
aattacatgactcgagtcaccagcattgatactcttcaaa

SEQ ID NO: 24702 - DNA, 40 bp, Artificial Sequence
  PCR primer for ORF amplification
aattacatgactcgagttaccaactttggtattcttcaaa

SEQ ID NO: 24703 - DNA, 40 bp, Artificial Sequence
  PCR primer for ORF amplification
aattacatgactcgagttaccaacactgatattcctcgaa

SEQ ID NO: 24704 - DNA, 40 bp, Artificial Sequence
  PCR primer for ORF amplification
aattacatgactcgagttagttctgtaagcccagctcctt

SEQ ID NO: 24705 - DNA, 40 bp, Artificial Sequence
  PCR primer for ORF amplification
aattacatgactcgagtcacaattctatttgagtgggcga

SEQ ID NO: 24706 - DNA, 40 bp, Artificial Sequence
  PCR primer for ORF amplification
aattacatgactcgagttattcctcttctgaggaagattc

SEQ ID NO: 24707 - DNA, 40 bp, Artificial Sequence
  PCR primer for ORF amplification
aattacatgactcgagttagtaatctaaactataagcttt

SEQ ID NO: 24708 - DNA, 40 bp, Artificial Sequence
  PCR primer for ORF amplification
aattacatgactcgagttaatttggcgctatttttttata

SEQ ID NO: 24709 - DNA, 40 bp, Artificial Sequence
  PCR primer for ORF amplification
aattacatgactcgagtcaaatgtccaagtattccatggt

SEQ ID NO: 24710 - DNA, 40 bp, Artificial Sequence
  PCR primer for ORF amplification
aattacatgactcgagctagacaccgaatatactctggta

SEQ ID NO: 24711 - DNA, 40 bp, Artificial Sequence
  PCR primer for ORF amplification
aattacatgactcgagtcattgagttttagtagtaaattc

SEQ ID NO: 24712 - DNA, 40 bp, Artificial Sequence
  PCR primer for ORF amplification
aattacatgactcgagttacaacttgaccgaatcaattag

SEQ ID NO: 24713 - DNA, 40 bp, Artificial Sequence
  PCR primer for ORF amplification
aattacatgactcgagtcataaaggcatgtctgttgttct

SEQ ID NO: 24714 - DNA, 40 bp, Artificial Sequence
  PCR primer for ORF amplification
aattacatgactcgagctatagaccttttctggcattacg

SEQ ID NO: 24715 - DNA, 40 bp, Artificial Sequence
  PCR primer for ORF amplification
aattacatgactcgagctaattttttgaattttgcctttt

SEQ ID NO: 24716 - DNA, 40 bp, Artificial Sequence
  PCR primer for ORF amplification
aattacatgactcgagctaatcaatagacataatgtcaag

SEQ ID NO: 24717 - DNA, 40 bp, Artificial Sequence
  PCR primer for ORF amplification
aattacatgactcgagtcatacggcccaaatatttacgtc

SEQ ID NO: 24718 - DNA, 40 bp, Artificial Sequence
  PCR primer for ORF amplification
aattacatgactcgagttatctactaaaggacccttctac

SEQ ID NO: 24719 - DNA, 40 bp, Artificial Sequence
  PCR primer for ORF amplification
aattacatgactcgagttacttcaattctgcaatgggtac

SEQ ID NO: 24720 - DNA, 40 bp, Artificial Sequence
  PCR primer for ORF amplification
aattacatgactcgagtcaaccagtctttctttttacata

SEQ ID NO: 24721 - DNA, 40 bp, Artificial Sequence
  PCR primer for ORF amplification
aattacatgactcgagttaggagagatcgtcgaaaatatc

SEQ ID NO: 24722 - DNA, 40 bp, Artificial Sequence
  PCR primer for ORF amplification
aattacatgactcgagtcaaattatgtgtgcatccagcca

SEQ ID NO: 24723 - DNA, 40 bp, Artificial Sequence
  PCR primer for ORF amplification
aattacatgactcgagttattcgacggtaacagatttagc

SEQ ID NO: 24724 - DNA, 40 bp, Artificial Sequence
  PCR primer for ORF amplification
aattacatgactcgagttaacagaattcttcttcatagtt

SEQ ID NO: 24725 - DNA, 40 bp, Artificial Sequence
  PCR primer for ORF amplification
aattacatgactcgagttagactctcaagcctaattcagg

SEQ ID NO: 24726 - DNA, 40 bp, Artificial Sequence
  PCR primer for ORF amplification
aattacatgactcgagctaccaacgtattgaactattaaa

SEQ ID NO: 24727 - DNA, 40 bp, Artificial Sequence
  PCR primer for ORF amplification
aattacatgactcgagctatattccagcaaggctctcttg

SEQ ID NO: 24728 - DNA, 40 bp, Artificial Sequence
  PCR primer for ORF amplification
aattacatgactcgagtcaccaggcttggtattcctccaa

SEQ ID NO: 24729 - DNA, 40 bp, Artificial Sequence
  PCR primer for ORF amplification
aattacatgactcgagctatttaaaaacctttttaaatcc

SEQ ID NO: 24730 - DNA, 40 bp, Artificial Sequence
  PCR primer for ORF amplification
aattacatgactcgagttatagttcaggtatgatgtcttt

SEQ ID NO: 24731 - DNA, 40 bp, Artificial Sequence
  PCR primer for ORF amplification
aattacatgactcgagttaagaggataacttgaacttcga

SEQ ID NO: 24732 - DNA, 40 bp, Artificial Sequence
  PCR primer for ORF amplification
aattacatgactcgagttatttcatttcttttttagcatc

SEQ ID NO: 24733 - DNA, 40 bp, Artificial Sequence
  PCR primer for ORF amplification
aattacatgactcgagtcatttagcaactaggttgcagaa

SEQ ID NO: 24734 - DNA, 40 bp, Artificial Sequence
  PCR primer for ORF amplification
aattacatgactcgagttatttaaattcataaatttcctt

SEQ ID NO: 24735 - DNA, 40 bp, Artificial Sequence
  PCR primer for ORF amplification
aattacatgactcgagctatttatggccactggtactact

SEQ ID NO: 24736 - DNA, 40 bp, Artificial Sequence
  PCR primer for ORF amplification
aattacatgactcgagttaaccctcattttcatttgactc

SEQ ID NO: 24737 - DNA, 40 bp, Artificial Sequence
  PCR primer for ORF amplification
aattacatgactcgagtcatttcaaagtttctaaacgttt

SEQ ID NO: 24738 - DNA, 40 bp, Artificial Sequence
  PCR primer for ORF amplification
aattacatgactcgagtcaatttgctataggctgtagcgg

SEQ ID NO: 24739 - DNA, 40 bp, Artificial Sequence
  PCR primer for ORF amplification
aattacatgactcgagttatgtggaatcatatattaggca

SEQ ID NO: 24740 - DNA, 40 bp, Artificial Sequence
  PCR primer for ORF amplification
aattacatgactcgagtcatttatcatggtgagattttct

SEQ ID NO: 24741 - DNA, 40 bp, Artificial Sequence
  PCR primer for ORF amplification
aattacatgactcgagctaattatcgaaagtgtcattcgt

SEQ ID NO: 24742 - DNA, 40 bp, Artificial Sequence
  PCR primer for ORF amplification
aattacatgactcgagttaactgaaaattacattgcaagc

SEQ ID NO: 24743 - DNA, 40 bp, Artificial Sequence
  PCR primer for ORF amplification
aattacatgactcgagctaatagtgagggacatttaagca

SEQ ID NO: 24744 - DNA, 40 bp, Artificial Sequence
  PCR primer for ORF amplification
aattacatgactcgagttagctaaacagttctagaagtat

SEQ ID NO: 24745 - DNA, 40 bp, Artificial Sequence
  PCR primer for ORF amplification
aattacatgactcgagttacaatgaatggtcaacgcggtc

SEQ ID NO: 24746 - DNA, 40 bp, Artificial Sequence
  PCR primer for ORF amplification
aattacatgactcgagtcagaataaatcgaggagatcctg

SEQ ID NO: 24747 - DNA, 40 bp, Artificial Sequence
  PCR primer for ORF amplification
aattacatgactcgagtcagttcgaaagggttgctgtgcg

SEQ ID NO: 24748 - DNA, 40 bp, Artificial Sequence
  PCR primer for ORF amplification
aattacatgactcgagtcaatctgatgttaaatcgaccac

SEQ ID NO: 24749 - DNA, 40 bp, Artificial Sequence
  PCR primer for ORF amplification
aattacatgactcgagttattttggtatcacatcatcgga

SEQ ID NO: 24750 - DNA, 40 bp, Artificial Sequence
  PCR primer for ORF amplification
aattacatgactcgagctatctatctaacttaacaccaac

SEQ ID NO: 24751 - DNA, 40 bp, Artificial Sequence
  PCR primer for ORF amplification
aattacatgactcgagctaacggctgctttttttcttgaa

SEQ ID NO: 24752 - DNA, 40 bp, Artificial Sequence
  PCR primer for ORF amplification
aattacatgactcgagtcattttctactaaccaatctggt

SEQ ID NO: 24753 - DNA, 40 bp, Artificial Sequence
  PCR primer for ORF amplification
aattacatgactcgagttaaaaatcagtcatctcaaaaga

SEQ ID NO: 24754 - DNA, 40 bp, Artificial Sequence
  PCR primer for ORF amplification
aattacatgactcgagtcaacataagtcataactagagaa

SEQ ID NO: 24755 - DNA, 40 bp, Artificial Sequence
  PCR primer for ORF amplification
aattacatgactcgagtcatattttgccgaataagaacaa

SEQ ID NO: 24756 - DNA, 40 bp, Artificial Sequence
  PCR primer for ORF amplification
aattacatgactcgagtcatataccaaattttaaccaatc

SEQ ID NO: 24757 - DNA, 40 bp, Artificial Sequence
  PCR primer for ORF amplification
aattacatgactcgagttaaagcgtatgtgtttcatatgc

SEQ ID NO: 24758 - DNA, 40 bp, Artificial Sequence
  PCR primer for ORF amplification
aattacatgactcgagttaaacacacgttggcttcaaatt

SEQ ID NO: 24759 - DNA, 40 bp, Artificial Sequence
  PCR primer for ORF amplification
aattacatgactcgagctattgacctcttaattctggttg

SEQ ID NO: 24760 - DNA, 40 bp, Artificial Sequence
  PCR primer for ORF amplification
aattacatgactcgagttaagcaagcgcgttttcaactct

SEQ ID NO: 24761 - DNA, 40 bp, Artificial Sequence
  PCR primer for ORF amplification
aattacatgactcgagctaatcatccagcatatccatcaa

SEQ ID NO: 24762 - DNA, 40 bp, Artificial Sequence
  PCR primer for ORF amplification
aattacatgactcgagctatgagtatgaatatgaattaat

SEQ ID NO: 24763 - DNA, 40 bp, Artificial Sequence
  PCR primer for ORF amplification
aattacatgactcgagtcaccttttaaatgacagattctt

SEQ ID NO: 24764 - DNA, 40 bp, Artificial Sequence
  PCR primer for ORF amplification
aattacatgactcgagctaagaattttgaacgctatactt

SEQ ID NO: 24765 - DNA, 40 bp, Artificial Sequence
  PCR primer for ORF amplification
aattacatgactcgagttatttatagcggtcttgctttat

SEQ ID NO: 24766 - DNA, 40 bp, Artificial Sequence
  PCR primer for ORF amplification
aattacatgactcgagctatcgtttgttaccctttgatag

SEQ ID NO: 24767 - DNA, 40 bp, Artificial Sequence
  PCR primer for ORF amplification
aattacatgactcgagttatgatgatgttgaaggtggagg

SEQ ID NO: 24768 - DNA, 40 bp, Artificial Sequence
  PCR primer for ORF amplification
aattacatgactcgagttaagctaagacgttgtcacctct

SEQ ID NO: 24769 - DNA, 40 bp, Artificial Sequence
  PCR primer for ORF amplification
aattacatgactcgagtcagttgacggtataattatgtga

SEQ ID NO: 24770 - DNA, 40 bp, Artificial Sequence
  PCR primer for ORF amplification
aattacatgactcgagttattttgaatcagaaactttttg

SEQ ID NO: 24771 - DNA, 40 bp, Artificial Sequence
  PCR primer for ORF amplification
aattacatgactcgagctaaattatttcatcaacttgtcc

SEQ ID NO: 24772 - DNA, 40 bp, Artificial Sequence
  PCR primer for ORF amplification
aattacatgactcgagctactctttctttaattccatgtg

SEQ ID NO: 24773 - DNA, 40 bp, Artificial Sequence
  PCR primer for ORF amplification
aattacatgactcgagttatttcggaccttgtttcatgta

SEQ ID NO: 24774 - DNA, 40 bp, Artificial Sequence
  PCR primer for ORF amplification
aattacatgactcgagttaaacacattcttgaagaacgct

SEQ ID NO: 24775 - DNA, 40 bp, Artificial Sequence
  PCR primer for ORF amplification
aattacatgactcgagttatgtacgcaatcttcttctcga

SEQ ID NO: 24776 - DNA, 40 bp, Artificial Sequence
  PCR primer for ORF amplification
aattacatgactcgagctatccttgggtattattataagt

SEQ ID NO: 24777 - DNA, 40 bp, Artificial Sequence
  PCR primer for ORF amplification
aattacatgactcgagttaaccttctttagaaaggttcat

SEQ ID NO: 24778 - DNA, 40 bp, Artificial Sequence
  PCR primer for ORF amplification
aattacatgactcgagttagtagaaacctcttgaattttt

SEQ ID NO: 24779 - DNA, 40 bp, Artificial Sequence
  PCR primer for ORF amplification
aattacatgactcgagtcagtgttttctacccttcttctt

SEQ ID NO: 24780 - DNA, 40 bp, Artificial Sequence
  PCR primer for ORF amplification
aattacatgactcgagtcataaattcgtaaggtcgttagt

SEQ ID NO: 24781 - DNA, 40 bp, Artificial Sequence
  PCR primer for ORF amplification
aattacatgactcgagttattcccacaggttattccaagt

SEQ ID NO: 24782 - DNA, 40 bp, Artificial Sequence
  PCR primer for ORF amplification
aattacatgactcgagttagtagttaaactcacttgctat

SEQ ID NO: 24783 - DNA, 40 bp, Artificial Sequence
  PCR primer for ORF amplification
aattacatgactcgagttaggtatcagaatcgactaaatc

SEQ ID NO: 24784 - DNA, 40 bp, Artificial Sequence
  PCR primer for ORF amplification
aattacatgactcgagtcaatgtcttttatgatcgcggac

SEQ ID NO: 24785 - DNA, 40 bp, Artificial Sequence
  PCR primer for ORF amplification
aattacatgactcgagtcatgattcagcgtttaattcata

SEQ ID NO: 24786 - DNA, 40 bp, Artificial Sequence
  PCR primer for ORF amplification
aattacatgactcgagtcatacaagtttatcaacccaaga

SEQ ID NO: 24787 - DNA, 40 bp, Artificial Sequence
  PCR primer for ORF amplification
aattacatgactcgagtcattctttcttttcgtgttctct

SEQ ID NO: 24788 - DNA, 40 bp, Artificial Sequence
  PCR primer for ORF amplification
aattacatgactcgagttacatgaacgcttgacataattt

SEQ ID NO: 24789 - DNA, 40 bp, Artificial Sequence
  PCR primer for ORF amplification
aattacatgactcgagttaggaaaggtaatggtaataaga

SEQ ID NO: 24790 - DNA, 40 bp, Artificial Sequence
  PCR primer for ORF amplification
aattacatgactcgagctaaagcttttctgtcttgactag

SEQ ID NO: 24791 - DNA, 40 bp, Artificial Sequence
  PCR primer for ORF amplification
aattacatgactcgagtcacatatttctcagttgccttac

SEQ ID NO: 24792 - DNA, 40 bp, Artificial Sequence
  PCR primer for ORF amplification
aattacatgactcgagttaatttcttgaaattttccagat

SEQ ID NO: 24793 - DNA, 40 bp, Artificial Sequence
  PCR primer for ORF amplification
aattacatgactcgagtcaaggttgtactgtgtgatctag

SEQ ID NO: 24794 - DNA, 40 bp, Artificial Sequence
  PCR primer for ORF amplification
aattacatgactcgagctatttaacggaatttttgctcct

SEQ ID NO: 24795 - DNA, 40 bp, Artificial Sequence
  PCR primer for ORF amplification
aattacatgactcgagttatgcatcgtagcatccaatggt

SEQ ID NO: 24796 - DNA, 40 bp, Artificial Sequence
  PCR primer for ORF amplification
aattacatgactcgagtcatgcatttaacattgtaggaat

SEQ ID NO: 24797 - DNA, 40 bp, Artificial Sequence
  PCR primer for ORF amplification
aattacatgactcgagttacagtcccattgagatatataa

SEQ ID NO: 24798 - DNA, 40 bp, Artificial Sequence
  PCR primer for ORF amplification
aattacatgactcgagtcagcttttcctaaaactaaacat

SEQ ID NO: 24799 - DNA, 40 bp, Artificial Sequence
  PCR primer for ORF amplification
aattacatgactcgagttactggcatgcaattctgccaac

SEQ ID NO: 24800 - DNA, 40 bp, Artificial Sequence
  PCR primer for ORF amplification
aattacatgactcgagttatccgctgttaaggattagctt

SEQ ID NO: 24801 - DNA, 40 bp, Artificial Sequence
  PCR primer for ORF amplification
aattacatgactcgagtcacttgtttattttcgataaaat

SEQ ID NO: 24802 - DNA, 40 bp, Artificial Sequence
  PCR primer for ORF amplification
aattacatgactcgagctactttttatcgtttctcagaca

SEQ ID NO: 24803 - DNA, 40 bp, Artificial Sequence
  PCR primer for ORF amplification
aattacatgactcgagttagtttggacgtaatacttctcc

SEQ ID NO: 24804 - DNA, 40 bp, Artificial Sequence
  PCR primer for ORF amplification
aattacatgactcgagtcatagtgggcttgtttctctttt

SEQ ID NO: 24805 - DNA, 40 bp, Artificial Sequence
  PCR primer for ORF amplification
aattacatgactcgagttatttggcttgtcgctgttccca

SEQ ID NO: 24806 - DNA, 40 bp, Artificial Sequence
  PCR primer for ORF amplification
aattacatgactcgagtcaattttgaaaaatgtctgaatt

SEQ ID NO: 24807 - DNA, 40 bp, Artificial Sequence
  PCR primer for ORF amplification
aattacatgactcgagttatgctaccaaatgtgcattatt

SEQ ID NO: 24808 - DNA, 40 bp, Artificial Sequence
  PCR primer for ORF amplification
aattacatgactcgagttaaagtaccaggattctaccggt

SEQ ID NO: 24809 - DNA, 40 bp, Artificial Sequence
  PCR primer for ORF amplification
aattacatgactcgagttaacaaggtaacgcgttctttat

SEQ ID NO: 24810 - DNA, 40 bp, Artificial Sequence
  PCR primer for ORF amplification
aattacatgactcgagctatagtccatagaggtttctttc

SEQ ID NO: 24811 - DNA, 40 bp, Artificial Sequence
  PCR primer for ORF amplification
aattacatgactcgagttatttcagtagtttttttctgta

SEQ ID NO: 24812 - DNA, 40 bp, Artificial Sequence
  PCR primer for ORF amplification
aattacatgactcgagttacacttgttgaccaccatattt

SEQ ID NO: 24813 - DNA, 40 bp, Artificial Sequence
  PCR primer for ORF amplification
aattacatgactcgagtcaatgctttttaaccacacctgc

SEQ ID NO: 24814 - DNA, 40 bp, Artificial Sequence
  PCR primer for ORF amplification
aattacatgactcgagttacctacggcttttgaagccctt

SEQ ID NO: 24815 - DNA, 40 bp, Artificial Sequence
  PCR primer for ORF amplification
aattacatgactcgagttatttcatatcttgggtagatga

SEQ ID NO: 24816 - DNA, 40 bp, Artificial Sequence
  PCR primer for ORF amplification
aattacatgactcgagctatgtgttacgtatatcttcaac

SEQ ID NO: 24817 - DNA, 40 bp, Artificial Sequence
  PCR primer for ORF amplification
aattacatgactcgagtcaccaaccgtttgaagtgtaatc

SEQ ID NO: 24818 - DNA, 40 bp, Artificial Sequence
  PCR primer for ORF amplification
aattacatgactcgagttaatgactccggtggtcgtgatt

SEQ ID NO: 24819 - DNA, 40 bp, Artificial Sequence
  PCR primer for ORF amplification
aattacatgactcgagttagcgaattttatcactgttctt

SEQ ID NO: 24820 - DNA, 40 bp, Artificial Sequence
  PCR primer for ORF amplification
aattacatgactcgagtcagtctgattcctctgacatctc

SEQ ID NO: 24821 - DNA, 40 bp, Artificial Sequence
  PCR primer for ORF amplification
aattacatgactcgagttacactagacttgaattaaataa

SEQ ID NO: 24822 - DNA, 40 bp, Artificial Sequence
  PCR primer for ORF amplification
aattacatgactcgagctatgacgctgcctgtgttgtcgc

SEQ ID NO: 24823 - DNA, 40 bp, Artificial Sequence
  PCR primer for ORF amplification
aattacatgactcgagttatttgatgaagctcaatattct

SEQ ID NO: 24824 - DNA, 40 bp, Artificial Sequence
  PCR primer for ORF amplification
aattacatgactcgagttaatcatctagagcagtgcctct

SEQ ID NO: 24825 - DNA, 40 bp, Artificial Sequence
  PCR primer for ORF amplification
aattacatgactcgagtcaggaaccattactaccgaattt

SEQ ID NO: 24826 - DNA, 40 bp, Artificial Sequence
  PCR primer for ORF amplification
aattacatgactcgagctaattttgcatgtgggattggtt

SEQ ID NO: 24827 - DNA, 40 bp, Artificial Sequence
  PCR primer for ORF amplification
aattacatgactcgagttagtcttcaaaatacttcgtatt

SEQ ID NO: 24828 - DNA, 40 bp, Artificial Sequence
  PCR primer for ORF amplification
aattacatgactcgagctacaacgcattttttcttgtcaa

SEQ ID NO: 24829 - DNA, 40 bp, Artificial Sequence
  PCR primer for ORF amplification
aattacatgactcgagtcactgtatctcgctgtcacaatc

SEQ ID NO: 24830 - DNA, 40 bp, Artificial Sequence
  PCR primer for ORF amplification
aattacatgactcgagttacagaatattactaataagggt

SEQ ID NO: 24831 - DNA, 40 bp, Artificial Sequence
  PCR primer for ORF amplification
aattacatgactcgagtcaatttactgttgggtcagagct

SEQ ID NO: 24832 - DNA, 40 bp, Artificial Sequence
  PCR primer for ORF amplification
aattacatgactcgagttaaattttcataccgacaggaag

SEQ ID NO: 24833 - DNA, 40 bp, Artificial Sequence
  PCR primer for ORF amplification
aattacatgactcgagctacaacggaggtaatggtgacct

SEQ ID NO: 24834 - DNA, 40 bp, Artificial Sequence
  PCR primer for ORF amplification
aattacatgactcgagttagctatccattagatcaggaga

SEQ ID NO: 24835 - DNA, 40 bp, Artificial Sequence
  PCR primer for ORF amplification
aattacatgactcgagttattcttgcatatgacatttttg

SEQ ID NO: 24836 - DNA, 40 bp, Artificial Sequence
  PCR primer for ORF amplification
aattacatgactcgagtcagtgttttattgactgaaattc

SEQ ID NO: 24837 - DNA, 40 bp, Artificial Sequence
  PCR primer for ORF amplification
aattacatgactcgagttatgcggattgggtcatcaactc

SEQ ID NO: 24838 - DNA, 40 bp, Artificial Sequence
  PCR primer for ORF amplification
aattacatgactcgagtcagagtttttgaggtgtgcccac

SEQ ID NO: 24839 - DNA, 40 bp, Artificial Sequence
  PCR primer for ORF amplification
aattacatgactcgagctaaggtgcgatatcccaagtaga

SEQ ID NO: 24840 - DNA, 40 bp, Artificial Sequence
  PCR primer for ORF amplification
aattacatgactcgagttaaaccttgtaggtctctaagtg

SEQ ID NO: 24841 - DNA, 40 bp, Artificial Sequence
  PCR primer for ORF amplification
aattacatgactcgagctacgcatctccttctttcccttc

SEQ ID NO: 24842 - DNA, 40 bp, Artificial Sequence
  PCR primer for ORF amplification
aattacatgactcgagttattgctgttcctgggcatcatc

SEQ ID NO: 24843 - DNA, 40 bp, Artificial Sequence
  PCR primer for ORF amplification
aattacatgactcgagtcattcaatagtgctactgctatc

SEQ ID NO: 24844 - DNA, 40 bp, Artificial Sequence
  PCR primer for ORF amplification
aattacatgactcgagtcatgcttcttgcttgtcggcaat

SEQ ID NO: 24845 - DNA, 40 bp, Artificial Sequence
  PCR primer for ORF amplification
aattacatgactcgagctatttaattagccattgggattt

SEQ ID NO: 24846 - DNA, 40 bp, Artificial Sequence
  PCR primer for ORF amplification
aattacatgactcgagttatttataaagttttagtaaatc

SEQ ID NO: 24847 - DNA, 40 bp, Artificial Sequence
  PCR primer for ORF amplification
aattacatgactcgagttatctcaatttgcttctgatttt

SEQ ID NO: 24848 - DNA, 40 bp, Artificial Sequence
  PCR primer for ORF amplification
aattacatgactcgagtcaccaattcgtatcccaggagtc

SEQ ID NO: 24849 - DNA, 40 bp, Artificial Sequence
  PCR primer for ORF amplification
aattacatgactcgagctatttcttcgcttgcttcttttg

SEQ ID NO: 24850 - DNA, 40 bp, Artificial Sequence
  PCR primer for ORF amplification
aattacatgactcgagttaatttgttgctgcaggtgcctc

SEQ ID NO: 24851 - DNA, 40 bp, Artificial Sequence
  PCR primer for ORF amplification
aattacatgactcgagtcatgggttgttcaactttccacg

SEQ ID NO: 24852 - DNA, 40 bp, Artificial Sequence
  PCR primer for ORF amplification
aattacatgactcgagttacacttggtgaacttctaaaaa

SEQ ID NO: 24853 - DNA, 40 bp, Artificial Sequence
  PCR primer for ORF amplification
aattacatgactcgagttacttggagaaatttaattctat

SEQ ID NO: 24854 - DNA, 40 bp, Artificial Sequence
  PCR primer for ORF amplification
aattacatgactcgagctagctttgttcgtgtctagaatt

SEQ ID NO: 24855 - DNA, 40 bp, Artificial Sequence
  PCR primer for ORF amplification
aattacatgactcgagttattcgaccttttcctttgtttc

SEQ ID NO: 24856 - DNA, 40 bp, Artificial Sequence
  PCR primer for ORF amplification
aattacatgactcgagttatttttgcccgtaagaataaag

SEQ ID NO: 24857 - DNA, 40 bp, Artificial Sequence
  PCR primer for ORF amplification
aattacatgactcgagttattggggggaagtgtattggct

SEQ ID NO: 24858 - DNA, 40 bp, Artificial Sequence
  PCR primer for ORF amplification
aattacatgactcgagttattcttcttcttcctcctcctc

SEQ ID NO: 24859 - DNA, 40 bp, Artificial Sequence
  PCR primer for ORF amplification
aattacatgactcgagtcaagaatctaattcctttgtctg

SEQ ID NO: 24860 - DNA, 40 bp, Artificial Sequence
  PCR primer for ORF amplification
aattacatgactcgagttagctgataacgcattccgctgg

SEQ ID NO: 24861 - DNA, 40 bp, Artificial Sequence
  PCR primer for ORF amplification
aattacatgactcgagtcataatttttcctcatcctgcac

SEQ ID NO: 24862 - DNA, 40 bp, Artificial Sequence
  PCR primer for ORF amplification
aattacatgactcgagtcataccatatcatttccttgttc

SEQ ID NO: 24863 - DNA, 40 bp, Artificial Sequence
  PCR primer for ORF amplification
aattacatgactcgagctaaattttgtaatctgcaaattt

SEQ ID NO: 24864 - DNA, 40 bp, Artificial Sequence
  PCR primer for ORF amplification
aattacatgactcgagttagtctgccagaggtttgatagt

SEQ ID NO: 24865 - DNA, 40 bp, Artificial Sequence
  PCR primer for ORF amplification
aattacatgactcgagtcacatcttaacctttttgagtgc

SEQ ID NO: 24866 - DNA, 40 bp, Artificial Sequence
  PCR primer for ORF amplification
aattacatgactcgagtcatagtgtatctttctccttatt

SEQ ID NO: 24867 - DNA, 40 bp, Artificial Sequence
  PCR primer for ORF amplification
aattacatgactcgagtcatttttcatctgtccgtgtcat

SEQ ID NO: 24868 - DNA, 40 bp, Artificial Sequence
  PCR primer for ORF amplification
aattacatgactcgagctatttgtcttcaccaaagtactc

SEQ ID NO: 24869 - DNA, 40 bp, Artificial Sequence
  PCR primer for ORF amplification
aattacatgactcgagttaactttcactgtgtcttaaacc

SEQ ID NO: 24870 - DNA, 40 bp, Artificial Sequence
  PCR primer for ORF amplification
aattacatgactcgagctaataccccttcttcttttgttt

SEQ ID NO: 24871 - DNA, 40 bp, Artificial Sequence
  PCR primer for ORF amplification
aattacatgactcgagctatttcttggagtgcttactctt

SEQ ID NO: 24872 - DNA, 40 bp, Artificial Sequence
  PCR primer for ORF amplification
aattacatgactcgagttaattcttgtattgttcacggaa

SEQ ID NO: 24873 - DNA, 40 bp, Artificial Sequence
  PCR primer for ORF amplification
aattacatgactcgagctatgcctgaccagagacggctac

SEQ ID NO: 24874 - DNA, 40 bp, Artificial Sequence
  PCR primer for ORF amplification
aattacatgactcgagtcaagatagtgacaaacaattttg

SEQ ID NO: 24875 - DNA, 40 bp, Artificial Sequence
  PCR primer for ORF amplification
aattacatgactcgagttaaaacctccaattttcatctac

SEQ ID NO: 24876 - DNA, 40 bp, Artificial Sequence
  PCR primer for ORF amplification
aattacatgactcgagttaacacctctcaaaaactttgta

SEQ ID NO: 24877 - DNA, 40 bp, Artificial Sequence
  PCR primer for ORF amplification
aattacatgactcgagtcagagagcatcagtttcgtttga

SEQ ID NO: 24878 - DNA, 40 bp, Artificial Sequence
  PCR primer for ORF amplification
aattacatgactcgagttaaccctggattaatttagctgt

SEQ ID NO: 24879 - DNA, 40 bp, Artificial Sequence
  PCR primer for ORF amplification
aattacatgactcgagtcacagtttgggctctcgctgttc

SEQ ID NO: 24880 - DNA, 40 bp, Artificial Sequence
  PCR primer for ORF amplification
aattacatgactcgagttactggtcgtcttcatcactttc

SEQ ID NO: 24881 - DNA, 40 bp, Artificial Sequence
  PCR primer for ORF amplification
aattacatgactcgagtcaggataatgagaattttgaact

SEQ ID NO: 24882 - DNA, 40 bp, Artificial Sequence
  PCR primer for ORF amplification
aattacatgactcgagctaagacttgtgagactgtgctat

SEQ ID NO: 24883 - DNA, 40 bp, Artificial Sequence
  PCR primer for ORF amplification
aattacatgactcgagttaagtagtttgttcagtcttctt

SEQ ID NO: 24884 - DNA, 40 bp, Artificial Sequence
  PCR primer for ORF amplification
aattacatgactcgagttaattatttctctttttcttttt

SEQ ID NO: 24885 - DNA, 40 bp, Artificial Sequence
  PCR primer for ORF amplification
aattacatgactcgagtcacggttgtggtgtgatcttaat

SEQ ID NO: 24886 - DNA, 40 bp, Artificial Sequence
  PCR primer for ORF amplification
aattacatgactcgagttacatgatggcacaacgctgaga

SEQ ID NO: 24887 - DNA, 40 bp, Artificial Sequence
  PCR primer for ORF amplification
aattacatgactcgagtcatacaccacttctgtaaatatt

SEQ ID NO: 24888 - DNA, 40 bp, Artificial Sequence
  PCR primer for ORF amplification
aattacatgactcgagtcaaaacactaactttggttgaat

SEQ ID NO: 24889 - DNA, 40 bp, Artificial Sequence
  PCR primer for ORF amplification
aattacatgactcgagtcatttttctttttgctcgttttt

SEQ ID NO: 24890 - DNA, 40 bp, Artificial Sequence
  PCR primer for ORF amplification
aattacatgactcgagtcactgcatttctatatcttcatc

SEQ ID NO: 24891 - DNA, 40 bp, Artificial Sequence
  PCR primer for ORF amplification
aattacatgactcgagttatttcttctcatcggccttaat

SEQ ID NO: 24892 - DNA, 40 bp, Artificial Sequence
  PCR primer for ORF amplification
aattacatgactcgagtcatataacgttaccatttcgatt

SEQ ID NO: 24893 - DNA, 40 bp, Artificial Sequence
  PCR primer for ORF amplification
aattacatgactcgagttaacatagcggtgtgaccaaatt

SEQ ID NO: 24894 - DNA, 40 bp, Artificial Sequence
  PCR primer for ORF amplification
aattacatgactcgagtcatggtattatagttgtcctcgt

SEQ ID NO: 24895 - DNA, 40 bp, Artificial Sequence
  PCR primer for ORF amplification
aattacatgactcgagctaccaatcctggtggactttatc

SEQ ID NO: 24896 - DNA, 40 bp, Artificial Sequence
  PCR primer for ORF amplification
aattacatgactcgagtcagtctttataatttttctggtt

SEQ ID NO: 24897 - DNA, 40 bp, Artificial Sequence
  PCR primer for ORF amplification
aattacatgactcgagctaagaaaaagcacctgaataagc

SEQ ID NO: 24898 - DNA, 40 bp, Artificial Sequence
  PCR primer for ORF amplification
aattacatgactcgagttacgaagatgaaccgcttcttag

SEQ ID NO: 24899 - DNA, 40 bp, Artificial Sequence
  PCR primer for ORF amplification
aattacatgactcgagttataggtaatacaattttttctc

SEQ ID NO: 24900 - DNA, 40 bp, Artificial Sequence
  PCR primer for ORF amplification
aattacatgactcgagctagtagtccatagaataatcacc

SEQ ID NO: 24901 - DNA, 40 bp, Artificial Sequence
  PCR primer for ORF amplification
aattacatgactcgagttagcatcttgtatagaaataaat

SEQ ID NO: 24902 - DNA, 40 bp, Artificial Sequence
  PCR primer for ORF amplification
aattacatgactcgagttagccataaaaatcttggaggga

SEQ ID NO: 24903 - DNA, 40 bp, Artificial Sequence
  PCR primer for ORF amplification
aattacatgactcgagtcaatccaacatcggaccctctaa

SEQ ID NO: 24904 - DNA, 40 bp, Artificial Sequence
  PCR primer for ORF amplification
aattacatgactcgagtcaagtggaggagaaaattttacc

SEQ ID NO: 24905 - DNA, 40 bp, Artificial Sequence
  PCR primer for ORF amplification
aattacatgactcgagttacaaatatgggttgttgttgcg

SEQ ID NO: 24906 - DNA, 40 bp, Artificial Sequence
  PCR primer for ORF amplification
aattacatgactcgagctaaaattcgttcgtgtttattcc

SEQ ID NO: 24907 - DNA, 40 bp, Artificial Sequence
  PCR primer for ORF amplification
aattacatgactcgagctatttttcttgtttttttgtatc

SEQ ID NO: 24908 - DNA, 40 bp, Artificial Sequence
  PCR primer for ORF amplification
aattacatgactcgagtcatccgaaaacttttttgaagat

SEQ ID NO: 24909 - DNA, 40 bp, Artificial Sequence
  PCR primer for ORF amplification
aattacatgactcgagtcattttagcctgtcaagcagtga

SEQ ID NO: 24910 - DNA, 40 bp, Artificial Sequence
  PCR primer for ORF amplification
aattacatgactcgagttatgtagaagggacatcgttgac

SEQ ID NO: 24911 - DNA, 40 bp, Artificial Sequence
  PCR primer for ORF amplification
aattacatgactcgagctactgcgtatcaaataaatattt

SEQ ID NO: 24912 - DNA, 40 bp, Artificial Sequence
  PCR primer for ORF amplification
aattacatgactcgagctacatgaaaatttgtaagttgct

SEQ ID NO: 24913 - DNA, 40 bp, Artificial Sequence
  PCR primer for ORF amplification
aattacatgactcgagctaagtgcgctgccttttaactct

SEQ ID NO: 24914 - DNA, 40 bp, Artificial Sequence
  PCR primer for ORF amplification
aattacatgactcgagtcattctgggtctgaatcagggtt

SEQ ID NO: 24915 - DNA, 40 bp, Artificial Sequence
  PCR primer for ORF amplification
aattacatgactcgagttaagtaaaccccggcccaaaata

SEQ ID NO: 24916 - DNA, 40 bp, Artificial Sequence
  PCR primer for ORF amplification
aattacatgactcgagttacataccattccaaggtaacga

SEQ ID NO: 24917 - DNA, 40 bp, Artificial Sequence
  PCR primer for ORF amplification
aattacatgactcgagctattcatatgctaatgagtatat

SEQ ID NO: 24918 - DNA, 40 bp, Artificial Sequence
  PCR primer for ORF amplification
aattacatgactcgagttagactttaattttagcaaggat

SEQ ID NO: 24919 - DNA, 40 bp, Artificial Sequence
  PCR primer for ORF amplification
aattacatgactcgagttattcgtttcttcgtatattacc

SEQ ID NO: 24920 - DNA, 40 bp, Artificial Sequence
  PCR primer for ORF amplification
aattacatgactcgagctaagaaaagaaatatttaaacaa

SEQ ID NO: 24921 - DNA, 40 bp, Artificial Sequence
  PCR primer for ORF amplification
aattacatgactcgagttagttattgaataagaactgtaa

SEQ ID NO: 24922 - DNA, 40 bp, Artificial Sequence
  PCR primer for ORF amplification
aattacatgactcgagttattgattattttgctttttctt

SEQ ID NO: 24923 - DNA, 40 bp, Artificial Sequence
  PCR primer for ORF amplification
aattacatgactcgagctaccatgttaaaacgtcttgttc

SEQ ID NO: 24924 - DNA, 40 bp, Artificial Sequence
  PCR primer for ORF amplification
aattacatgactcgagttatttgttctttgaaaagcctga

SEQ ID NO: 24925 - DNA, 40 bp, Artificial Sequence
  PCR primer for ORF amplification
aattacatgactcgagttactccggagagttggcgcttac

SEQ ID NO: 24926 - DNA, 40 bp, Artificial Sequence; identical to SEQ ID NO: 24342
  PCR primer for ORF amplification

SEQ ID NO: 24927 - DNA, 40 bp, Artificial Sequence
  PCR primer for ORF amplification
aattacatgactcgagtcatttggtgaacttccttttttt

SEQ ID NO: 24928 - DNA, 40 bp, Artificial Sequence
  PCR primer for ORF amplification
aattacatgactcgagttacaaataatcaggatccaggat

SEQ ID NO: 24929 - DNA, 40 bp, Artificial Sequence
  PCR primer for ORF amplification
aattacatgactcgagtcaaagtcgccatcgatcaacctc

SEQ ID NO: 24930 - DNA, 40 bp, Artificial Sequence
  PCR primer for ORF amplification
aattacatgactcgagttactctccgaggttttctttagt

SEQ ID NO: 24931 - DNA, 40 bp, Artificial Sequence
  PCR primer for ORF amplification
aattacatgactcgagttaaaatccttcaggaacaccttt

SEQ ID NO: 24932 - DNA, 40 bp, Artificial Sequence
  PCR primer for ORF amplification
aattacatgactcgagtcagtttaaaggtgtactctgttg

SEQ ID NO: 24933 - DNA, 40 bp, Artificial Sequence
  PCR primer for ORF amplification
aattacatgactcgagttatggtttactgtccatatggag

SEQ ID NO: 24934 - DNA, 40 bp, Artificial Sequence
  PCR primer for ORF amplification
aattacatgactcgagtcatacaataaataagttgatgat

SEQ ID NO: 24935 - DNA, 40 bp, Artificial Sequence
  PCR primer for ORF amplification
aattacatgactcgagtcataaatttcttacacttttttg

SEQ ID NO: 24936 - DNA, 40 bp, Artificial Sequence
  PCR primer for ORF amplification
aattacatgactcgagttactttagttctgatatttcacc

SEQ ID NO: 24937 - DNA, 40 bp, Artificial Sequence
  PCR primer for ORF amplification
aattacatgactcgagtcacgcaattatgagtcgccactc

SEQ ID NO: 24938 - DNA, 40 bp, Artificial Sequence
  PCR primer for ORF amplification
aattacatgactcgagctatatcctgctcatagtttcatt

SEQ ID NO: 24939 - DNA, 40 bp, Artificial Sequence
  PCR primer for ORF amplification
aattacatgactcgagttatggcctgaaagcacctcctgc

SEQ ID NO: 24940 - DNA, 40 bp, Artificial Sequence
  PCR primer for ORF amplification
aattacatgactcgagttaccaccatttatcataaccaaa

SEQ ID NO: 24941 - DNA, 40 bp, Artificial Sequence
  PCR primer for ORF amplification
aattacatgactcgagtcagccttcccaattaataaaatt

SEQ ID NO: 24942 - DNA, 40 bp, Artificial Sequence
  PCR primer for ORF amplification
aattacatgactcgagtcacctttgttgtggctgtgtatg

SEQ ID NO: 24943 - DNA, 40 bp, Artificial Sequence
  PCR primer for ORF amplification
aattacatgactcgagctactggaaatcctttgggatcaa

SEQ ID NO: 24944 - DNA, 40 bp, Artificial Sequence
  PCR primer for ORF amplification
aattacatgactcgagtcaaaccctcatgctccttctttt

SEQ ID NO: 24945 - DNA, 40 bp, Artificial Sequence
  PCR primer for ORF amplification
aattacatgactcgagctagatatggaacttgttactcct

SEQ ID NO: 24946 - DNA, 40 bp, Artificial Sequence
  PCR primer for ORF amplification
aattacatgactcgagttactcctcctcctttttattctc

SEQ ID NO: 24947 - DNA, 40 bp, Artificial Sequence
  PCR primer for ORF amplification
aattacatgactcgagttatttcgttatggtatcaatatc

SEQ ID NO: 24948 - DNA, 40 bp, Artificial Sequence
  PCR primer for ORF amplification
aattacatgactcgagtcacataaatccttcatcgaagaa

SEQ ID NO: 24949 - DNA, 40 bp, Artificial Sequence
  PCR primer for ORF amplification
aattacatgactcgagttagtaaagcttagttccgttttc

SEQ ID NO: 24950 - DNA, 40 bp, Artificial Sequence
  PCR primer for ORF amplification
aattacatgactcgagctatttttgtagttttgctaaact

SEQ ID NO: 24951 - DNA, 40 bp, Artificial Sequence
  PCR primer for ORF amplification
aattacatgactcgagtcatgaagcatgcttttttaaaaa

SEQ ID NO: 24952 - DNA, 40 bp, Artificial Sequence
  PCR primer for ORF amplification
aattacatgactcgagttatatcaaagatccatatacatt

SEQ ID NO: 24953 - DNA, 40 bp, Artificial Sequence
  PCR primer for ORF amplification
aattacatgactcgagttattttatttggctaaaaatttc

SEQ ID NO: 24954 - DNA, 40 bp, Artificial Sequence
  PCR primer for ORF amplification
aattacatgactcgagttatttcctggcagtggccagtag

SEQ ID NO: 24955 - DNA, 40 bp, Artificial Sequence
  PCR primer for ORF amplification
aattacatgactcgagtcaaaaaattctttcgtaaaataa

SEQ ID NO: 24956 - DNA, 40 bp, Artificial Sequence
  PCR primer for ORF amplification
aattacatgactcgagttattgcttttcgaattctaatac

SEQ ID NO: 24957 - DNA, 40 bp, Artificial Sequence
  PCR primer for ORF amplification
aattacatgactcgagttattcttcgacaatgtgaagttt

SEQ ID NO: 24958 - DNA, 40 bp, Artificial Sequence
  PCR primer for ORF amplification
aattacatgactcgagctaggtggtccataagcgagccgt

SEQ ID NO: 24959 - DNA, 40 bp, Artificial Sequence
  PCR primer for ORF amplification
aattacatgactcgagctatgcttttaaactgtagtatct

SEQ ID NO: 24960 - DNA, 40 bp, Artificial Sequence
  PCR primer for ORF amplification
aattacatgactcgagtcatgtgtacttcatattaacctc

SEQ ID NO: 24961 - DNA, 40 bp, Artificial Sequence
  PCR primer for ORF amplification
aattacatgactcgagttatttatacccgatgtcattagt

SEQ ID NO: 24962 - DNA, 40 bp, Artificial Sequence
  PCR primer for ORF amplification
aattacatgactcgagtcattcttgaccaaaccctatggt

SEQ ID NO: 24963 - DNA, 40 bp, Artificial Sequence
  PCR primer for ORF amplification
aattacatgactcgagttagtttacatctttaccagaaat

SEQ ID NO: 24964 - DNA, 40 bp, Artificial Sequence
  PCR primer for ORF amplification
aattacatgactcgagctaaagctccagatgcgaagaaga

SEQ ID NO: 24965 - DNA, 40 bp, Artificial Sequence
  PCR primer for ORF amplification
aattacatgactcgagtcacttggaagttgcgtccttcaa

SEQ ID NO: 24966 - DNA, 40 bp, Artificial Sequence
  PCR primer for ORF amplification
aattacatgactcgagttaattgtctttgtaatcatcgaa

SEQ ID NO: 24967 - DNA, 40 bp, Artificial Sequence
  PCR primer for ORF amplification
aattacatgactcgagttaaactttgctgggaaacctttt

SEQ ID NO: 24968 - DNA, 40 bp, Artificial Sequence
  PCR primer for ORF amplification
aattacatgactcgagttaattttctgttttcattgaaat

SEQ ID NO: 24969 - DNA, 40 bp, Artificial Sequence
  PCR primer for ORF amplification
aattacatgactcgagtcacttttcttcaatggttctctt

SEQ ID NO: 24970 - DNA, 40 bp, Artificial Sequence
  PCR primer for ORF amplification
aattacatgactcgagttaagcaggaataggagggagagg

SEQ ID NO: 24971 - DNA, 40 bp, Artificial Sequence
  PCR primer for ORF amplification
aattacatgactcgagttatttctttccgccacgtagttt

SEQ ID NO: 24972 - DNA, 40 bp, Artificial Sequence
  PCR primer for ORF amplification
aattacatgactcgagttattgaagtaaatagcgaacgtt

SEQ ID NO: 24973 - DNA, 40 bp, Artificial Sequence
  PCR primer for ORF amplification
aattacatgactcgagttaaacttttaggccattgacgaa

SEQ ID NO: 24974 - DNA, 40 bp, Artificial Sequence
  PCR primer for ORF amplification
aattacatgactcgagtcaactaggattcagtggcaggac

SEQ ID NO: 24975 - DNA, 40 bp, Artificial Sequence
  PCR primer for ORF amplification
aattacatgactcgagttacttttcagcttcctcttcaac

SEQ ID NO: 24976 - DNA, 40 bp, Artificial Sequence
  PCR primer for ORF amplification
aattacatgactcgagctagttggttggtgggaactggaa

SEQ ID NO: 24977 - DNA, 40 bp, Artificial Sequence
  PCR primer for ORF amplification
aattacatgactcgagtcaacgacgatttgatggtgggtt

SEQ ID NO: 24978 - DNA, 40 bp, Artificial Sequence
  PCR primer for ORF amplification
aattacatgactcgagtcacgatcgtccggaagatggagg

SEQ ID NO: 24979 - DNA, 40 bp, Artificial Sequence
  PCR primer for ORF amplification
aattacatgactcgagttacataaaagctgaaaagtttgt

SEQ ID NO: 24980 - DNA, 40 bp, Artificial Sequence
  PCR primer for ORF amplification
aattacatgactcgagctaattactgatctgagacttttg

SEQ ID NO: 24981 - DNA, 40 bp, Artificial Sequence
  PCR primer for ORF amplification
aattacatgactcgagttaagcaaggtaagcatacgattc

SEQ ID NO: 24982 - DNA, 40 bp, Artificial Sequence
  PCR primer for ORF amplification
aattacatgactcgagttaggcatacatgacgtcttcctc

SEQ ID NO: 24983 - DNA, 40 bp, Artificial Sequence
  PCR primer for ORF amplification
aattacatgactcgagctatgtacgtcgaacatcattaat

SEQ ID NO: 24984 - DNA, 40 bp, Artificial Sequence
  PCR primer for ORF amplification
aattacatgactcgagttacagttttttcttacctattga

SEQ ID NO: 24985 - DNA, 40 bp, Artificial Sequence
  PCR primer for ORF amplification
aattacatgactcgagttagtaattgcaataccttaggga

SEQ ID NO: 24986 - DNA, 40 bp, Artificial Sequence
  PCR primer for ORF amplification
aattacatgactcgagctagaatagcttatccatttccac

SEQ ID NO: 24987 - DNA, 40 bp, Artificial Sequence
  PCR primer for ORF amplification
aattacatgactcgagtcacgtaaataatgttaagtccaa

SEQ ID NO: 24988 - DNA, 40 bp, Artificial Sequence
  PCR primer for ORF amplification
aattacatgactcgagttattccaaaacagcccttttttc

SEQ ID NO: 24989 - DNA, 40 bp, Artificial Sequence
  PCR primer for ORF amplification
aattacatgactcgagtcatttgacaaattgcccatcgaa

SEQ ID NO: 24990 - DNA, 40 bp, Artificial Sequence
  PCR primer for ORF amplification
aattacatgactcgagctactgggttattctattggaatc

SEQ ID NO: 24991 - DNA, 40 bp, Artificial Sequence
  PCR primer for ORF amplification
aattacatgactcgagctatcttgagataaaggcgctcac

SEQ ID NO: 24992 - DNA, 40 bp, Artificial Sequence
  PCR primer for ORF amplification
aattacatgactcgagtcaatttaagtcggaatgatgatc

SEQ ID NO: 24993 - DNA, 40 bp, Artificial Sequence
  PCR primer for ORF amplification
aattacatgactcgagtcatataaaaaattttggcttagg

SEQ ID NO: 24994 - DNA, 40 bp, Artificial Sequence
  PCR primer for ORF amplification
aattacatgactcgagctacaagtcgtgaagtattgattg

SEQ ID NO: 24995 - DNA, 40 bp, Artificial Sequence
  PCR primer for ORF amplification
aattacatgactcgagttattttttttcattttctaacaa

SEQ ID NO: 24996 - DNA, 40 bp, Artificial Sequence
  PCR primer for ORF amplification
aattacatgactcgagttacgaaaattgcaaattctcggg

SEQ ID NO: 24997 - DNA, 40 bp, Artificial Sequence
  PCR primer for ORF amplification
aattacatgactcgagtcaagtgcctctgttaaagaacct

SEQ ID NO: 24998 - DNA, 40 bp, Artificial Sequence
  PCR primer for ORF amplification
aattacatgactcgagttatttactgggagagactagttc

SEQ ID NO: 24999 - DNA, 40 bp, Artificial Sequence
  PCR primer for ORF amplification
aattacatgactcgagtcacagcatttctgggatgcgtcc

SEQ ID NO: 25000 - DNA, 40 bp, Artificial Sequence
  PCR primer for ORF amplification
aattacatgactcgagtcatctttgggaagaagcagatgc

SEQ ID NO: 25001 - DNA, 40 bp, Artificial Sequence
  PCR primer for ORF amplification
aattacatgactcgagtcatatttcgaatcttccactgac

SEQ ID NO: 25002 - DNA, 40 bp, Artificial Sequence
  PCR primer for ORF amplification
aattacatgactcgagttattccaaacctttataaatagc

SEQ ID NO: 25003 - DNA, 40 bp, Artificial Sequence
  PCR primer for ORF amplification
aattacatgactcgagttatgccgaccaatacctgtaaaa

SEQ ID NO: 25004 - DNA, 40 bp, Artificial Sequence
  PCR primer for ORF amplification
aattacatgactcgagtcattttctgccattttgatattt

SEQ ID NO: 25005 - DNA, 40 bp, Artificial Sequence
  PCR primer for ORF amplification
aattacatgactcgagttatttctttgatttatttttttt

SEQ ID NO: 25006 - DNA, 40 bp, Artificial Sequence
  PCR primer for ORF amplification
aattacatgactcgagtcagtttgtagatggcttaggctc

SEQ ID NO: 25007 - DNA, 40 bp, Artificial Sequence
  PCR primer for ORF amplification
aattacatgactcgagtcacagaggcagggaaaaggctct

SEQ ID NO: 25008 - DNA, 40 bp, Artificial Sequence
  PCR primer for ORF amplification
aattacatgactcgagctaaaaatttaaatatacactgcc

SEQ ID NO: 25009 - DNA, 40 bp, Artificial Sequence
  PCR primer for ORF amplification
aattacatgactcgagttatctcttgttgttatcaaattt

SEQ ID NO: 25010 - DNA, 40 bp, Artificial Sequence
  PCR primer for ORF amplification
aattacatgactcgagtcataacaggtccttctcaaaaaa

SEQ ID NO: 25011 - DNA, 40 bp, Artificial Sequence
  PCR primer for ORF amplification
aattacatgactcgagttaaacgtgactttggctgcgatt

SEQ ID NO: 25012 - DNA, 40 bp, Artificial Sequence
  PCR primer for ORF amplification
aattacatgactcgagctaatcactgcttggccccattaa

SEQ ID NO: 25013 - DNA, 40 bp, Artificial Sequence
  PCR primer for ORF amplification
aattacatgactcgagttaacctgcattacaataatgaac

SEQ ID NO: 25014 - DNA, 40 bp, Artificial Sequence
  PCR primer for ORF amplification
aattacatgactcgagttagaaggtcgagttcaaaatatt

SEQ ID NO: 25015 - DNA, 40 bp, Artificial Sequence
  PCR primer for ORF amplification
aattacatgactcgagttaatcaagagcgcaaaggagggc

SEQ ID NO: 25016 - DNA, 40 bp, Artificial Sequence
  PCR primer for ORF amplification
aattacatgactcgagctagaggttgggaacttccagggt

SEQ ID NO: 25017 - DNA, 40 bp, Artificial Sequence
  PCR primer for ORF amplification
aattacatgactcgagttactttttcctttttccaaagaa

SEQ ID NO: 25018 - DNA, 40 bp, Artificial Sequence
  PCR primer for ORF amplification
aattacatgactcgagtcagctagatagagctgttgtagt

SEQ ID NO: 25019 - DNA, 40 bp, Artificial Sequence
  PCR primer for ORF amplification
aattacatgactcgagttattcttcgtcatcctctattag

SEQ ID NO: 25020 - DNA, 40 bp, Artificial Sequence
  PCR primer for ORF amplification
aattacatgactcgagtcatgatgaatttttctgggttat

SEQ ID NO: 25021 - DNA, 40 bp, Artificial Sequence
  PCR primer for ORF amplification
aattacatgactcgagtcacaaagaaggcatatcgctcag

SEQ ID NO: 25022 - DNA, 40 bp, Artificial Sequence
  PCR primer for ORF amplification
aattacatgactcgagttatagagtttcatcgaatttgtg

SEQ ID NO: 25023 - DNA, 40 bp, Artificial Sequence
  PCR primer for ORF amplification
aattacatgactcgagctatttcttagctcgtttgggcag

SEQ ID NO: 25024 - DNA, 40 bp, Artificial Sequence
  PCR primer for ORF amplification
aattacatgactcgagtcatatggcgaatatctgaacatt

SEQ ID NO: 25025 - DNA, 40 bp, Artificial Sequence
  PCR primer for ORF amplification
aattacatgactcgagtcagaagcgtccaaggatgttgac

SEQ ID NO: 25026 - DNA, 40 bp, Artificial Sequence
  PCR primer for ORF amplification
aattacatgactcgagttatgcatgactattcgcgtttga

SEQ ID NO: 25027 - DNA, 40 bp, Artificial Sequence
  PCR primer for ORF amplification
aattacatgactcgagttagcggaagttattaactactgt

SEQ ID NO: 25028 - DNA, 40 bp, Artificial Sequence
  PCR primer for ORF amplification
aattacatgactcgagttatataccaggtcctatattttt

SEQ ID NO: 25029 - DNA, 40 bp, Artificial Sequence
  PCR primer for ORF amplification
aattacatgactcgagttattccccaaccaaattgaagat

SEQ ID NO: 25030 - DNA, 40 bp, Artificial Sequence
  PCR primer for ORF amplification
aattacatgactcgagctaactatacaaatcatcatcttc

SEQ ID NO: 25031 - DNA, 40 bp, Artificial Sequence
  PCR primer for ORF amplification
aattacatgactcgagttatttttttttcattgctcttct

SEQ ID NO: 25032 - DNA, 40 bp, Artificial Sequence
  PCR primer for ORF amplification
aattacatgactcgagtcatacactaatttttccctgttt

SEQ ID NO: 25033 - DNA, 40 bp, Artificial Sequence
  PCR primer for ORF amplification
aattacatgactcgagttatactttcttactgcctgtgtt

SEQ ID NO: 25034 - DNA, 40 bp, Artificial Sequence
  PCR primer for ORF amplification
aattacatgactcgagttattgtttcatttcttccgcatc

SEQ ID NO: 25035 - DNA, 40 bp, Artificial Sequence
  PCR primer for ORF amplification
aattacatgactcgagctatgagcgatcccgttttgtgaa

SEQ ID NO: 25036 - DNA, 40 bp, Artificial Sequence
  PCR primer for ORF amplification
aattacatgactcgagttagtcttcatcaggaatgtagag

SEQ ID NO: 25037 - DNA, 40 bp, Artificial Sequence
  PCR primer for ORF amplification
aattacatgactcgagctaatttttcttgtgtttcttaag

SEQ ID NO: 25038 - DNA, 40 bp, Artificial Sequence
  PCR primer for ORF amplification
aattacatgactcgagtcatagagagacgtctatattaat

SEQ ID NO: 25039 - DNA, 40 bp, Artificial Sequence
  PCR primer for ORF amplification
aattacatgactcgagtcagtgatcaatacctatcaacat

SEQ ID NO: 25040 - DNA, 40 bp, Artificial Sequence
  PCR primer for ORF amplification
aattacatgactcgagttatttatataacgaccaacaacc

SEQ ID NO: 25041 - DNA, 40 bp, Artificial Sequence
  PCR primer for ORF amplification
aattacatgactcgagttattccagttccatatctgcgtc

SEQ ID NO: 25042 - DNA, 40 bp, Artificial Sequence
  PCR primer for ORF amplification
aattacatgactcgagttacataatgcagcaatctcgtat

SEQ ID NO: 25043 - DNA, 40 bp, Artificial Sequence
  PCR primer for ORF amplification
aattacatgactcgagttagcttgaagcggaagagcttgc

SEQ ID NO: 25044 - DNA, 40 bp, Artificial Sequence
  PCR primer for ORF amplification
aattacatgactcgagttaatgaaataattcgtgaactaa

SEQ ID NO: 25045 - DNA, 40 bp, Artificial Sequence
  PCR primer for ORF amplification
aattacatgactcgagctactttttcttgtgatgcttctt

SEQ ID NO: 25046 - DNA, 40 bp, Artificial Sequence
  PCR primer for ORF amplification
aattacatgactcgagttacaatttgtcgtaatattcttg

SEQ ID NO: 25047 - DNA, 40 bp, Artificial Sequence
  PCR primer for ORF amplification
aattacatgactcgagttagtacttgtaagttgctgttga

SEQ ID NO: 25048 - DNA, 40 bp, Artificial Sequence
  PCR primer for ORF amplification
aattacatgactcgagtcattccttccactccaacagtga

SEQ ID NO: 25049 - DNA, 40 bp, Artificial Sequence
  PCR primer for ORF amplification
aattacatgactcgagtcacttcttcaaattcttataata

SEQ ID NO: 25050 - DNA, 40 bp, Artificial Sequence
  PCR primer for ORF amplification
aattacatgactcgagtcaaaagttactcaggttagggaa

SEQ ID NO: 25051 - DNA, 40 bp, Artificial Sequence
  PCR primer for ORF amplification
aattacatgactcgagttattttttctcttgattactaat

SEQ ID NO: 25052 - DNA, 40 bp, Artificial Sequence
  PCR primer for ORF amplification
aattacatgactcgagctaactgctgtatttggagtacat

SEQ ID NO: 25053 - DNA, 40 bp, Artificial Sequence
  PCR primer for ORF amplification
aattacatgactcgagtcaagcgtcttgtagatcgatatc

SEQ ID NO: 25054 - DNA, 40 bp, Artificial Sequence
  PCR primer for ORF amplification
aattacatgactcgagttaacggagcgatttgctcaataa

SEQ ID NO: 25055 - DNA, 40 bp, Artificial Sequence
  PCR primer for ORF amplification
aattacatgactcgagtcaaaatctttttcctttcttttt

SEQ ID NO: 25056 - DNA, 40 bp, Artificial Sequence
  PCR primer for ORF amplification
aattacatgactcgagctagtatttagtactcttcaaaga

SEQ ID NO: 25057 - DNA, 40 bp, Artificial Sequence
  PCR primer for ORF amplification
aattacatgactcgagtcatttctttttgattatgtgccc

SEQ ID NO: 25058 - DNA, 40 bp, Artificial Sequence
  PCR primer for ORF amplification
aattacatgactcgagttatgcagtaatctgtccatcatc

SEQ ID NO: 25059 - DNA, 40 bp, Artificial Sequence
  PCR primer for ORF amplification
aattacatgactcgagtcatactcgtattcctctatcgtc

SEQ ID NO: 25060 - DNA, 40 bp, Artificial Sequence
  PCR primer for ORF amplification
aattacatgactcgagtcacttagataggtttttaatttc

SEQ ID NO: 25061 - DNA, 40 bp, Artificial Sequence
  PCR primer for ORF amplification
aattacatgactcgagttagttgctattatcaaaataaaa

SEQ ID NO: 25062 - DNA, 40 bp, Artificial Sequence
  PCR primer for ORF amplification
aattacatgactcgagttacagattcgtggcagttggggc

SEQ ID NO: 25063 - DNA, 40 bp, Artificial Sequence
  PCR primer for ORF amplification
aattacatgactcgagtcaaaacttcttgtagtaatgcgc

SEQ ID NO: 25064 - DNA, 40 bp, Artificial Sequence
  PCR primer for ORF amplification
aattacatgactcgagctaaatcagccaggtaaccaactt

SEQ ID NO: 25065 - DNA, 40 bp, Artificial Sequence
  PCR primer for ORF amplification
aattacatgactcgagctatctgaaattattgaggattgt

SEQ ID NO: 25066 - DNA, 40 bp, Artificial Sequence
  PCR primer for ORF amplification
aattacatgactcgagttaaagaccggaggttgtttcaaa

SEQ ID NO: 25067 - DNA, 40 bp, Artificial Sequence
  PCR primer for ORF amplification
aattacatgactcgagttacctctcctttccttcttcctt

SEQ ID NO: 25068 - DNA, 40 bp, Artificial Sequence
  PCR primer for ORF amplification
aattacatgactcgagtcatgagtttttatgcccattttt

SEQ ID NO: 25069 - DNA, 40 bp, Artificial Sequence
  PCR primer for ORF amplification
aattacatgactcgagtcaatacagacgaatgttcaagaa

SEQ ID NO: 25070 - DNA, 40 bp, Artificial Sequence
  PCR primer for ORF amplification
aattacatgactcgagctacaagtaatactgtagaatttc

SEQ ID NO: 25071 - DNA, 40 bp, Artificial Sequence
  PCR primer for ORF amplification
aattacatgactcgagttatccttttcttcttttgaacgt

SEQ ID NO: 25072 - DNA, 40 bp, Artificial Sequence
  PCR primer for ORF amplification
aattacatgactcgagttatttactaaccttggtatgtaa

SEQ ID NO: 25073 - DNA, 40 bp, Artificial Sequence
  PCR primer for ORF amplification
aattacatgactcgagctaatcgatgtctaaatttatttc

SEQ ID NO: 25074 - DNA, 40 bp, Artificial Sequence
  PCR primer for ORF amplification
aattacatgactcgagctattgatcatactcatgctcacg

SEQ ID NO: 25075 - DNA, 40 bp, Artificial Sequence
  PCR primer for ORF amplification
aattacatgactcgagtcaagtacttgcattcatttggtc

SEQ ID NO: 25076 - DNA, 40 bp, Artificial Sequence
  PCR primer for ORF amplification
aattacatgactcgagttaattgtaacggctatatctact

SEQ ID NO: 25077 - DNA, 40 bp, Artificial Sequence
  PCR primer for ORF amplification
aattacatgactcgagctagatttttgctaacatatccgt

SEQ ID NO: 25078 - DNA, 40 bp, Artificial Sequence
  PCR primer for ORF amplification
aattacatgactcgagttattctaagatgtggtcttcggt

SEQ ID NO: 25079 - DNA, 40 bp, Artificial Sequence
  PCR primer for ORF amplification
aattacatgactcgagctaaacgtcccatttagaaaaatc

SEQ ID NO: 25080 - DNA, 40 bp, Artificial Sequence
  PCR primer for ORF amplification
aattacatgactcgagtcaaatatctagttctatttcatc

SEQ ID NO: 25081 - DNA, 40 bp, Artificial Sequence
  PCR primer for ORF amplification
aattacatgactcgagtcagtcgtagcggctatatctact

SEQ ID NO: 25082 - DNA, 40 bp, Artificial Sequence
  PCR primer for ORF amplification
aattacatgactcgagctagcaagcatcgaaaattgatcc

SEQ ID NO: 25083 - DNA, 40 bp, Artificial Sequence
  PCR primer for ORF amplification
aattacatgactcgagttactgtgttctatcaatcttcat

SEQ ID NO: 25084 - DNA, 40 bp, Artificial Sequence
  PCR primer for ORF amplification
aattacatgactcgagttagcgtgaattcaggctgcgcat

SEQ ID NO: 25085 - DNA, 40 bp, Artificial Sequence
  PCR primer for ORF amplification
aattacatgactcgagtcatgctttcgttttccttttttt

SEQ ID NO: 25086 - DNA, 40 bp, Artificial Sequence
  PCR primer for ORF amplification
aattacatgactcgagttataaggataattgacgcttctg

SEQ ID NO: 25087 - DNA, 40 bp, Artificial Sequence
  PCR primer for ORF amplification
aattacatgactcgagttatgaggtactgacactgcgacc

SEQ ID NO: 25088 - DNA, 40 bp, Artificial Sequence
  PCR primer for ORF amplification
aattacatgactcgagttaatcttcgaattcatcttcgtc

SEQ ID NO: 25089 - DNA, 40 bp, Artificial Sequence
  PCR primer for ORF amplification
aattacatgactcgagttagttgttgataatactgatctt

SEQ ID NO: 25090 - DNA, 43 bp, Artificial Sequence
  PCR primer for ORF amplification
khmaattacatgactcgagtcagacaccaataattttattttc

SEQ ID NO: 25091 - DNA, 40 bp, Artificial Sequence
  PCR primer for ORF amplification
aattacatgactcgagttaaaaaaatgatacgaaatccac

SEQ ID NO: 25092 - DNA, 40 bp, Artificial Sequence
  PCR primer for ORF amplification
aattacatgactcgagtcatttctttatcgagttgatttg

SEQ ID NO: 25093 - DNA, 40 bp, Artificial Sequence
  PCR primer for ORF amplification
aattacatgactcgagctaacgtaattttcggtagtagtg

SEQ ID NO: 25094 - DNA, 40 bp, Artificial Sequence
  PCR primer for ORF amplification
aattacatgactcgagctacatgttaagttcttgttcctc

SEQ ID NO: 25095 - DNA, 40 bp, Artificial Sequence
  PCR primer for ORF amplification
aattacatgactcgagctagattttcatacttcttctttt

SEQ ID NO: 25096 - DNA, 5538 bp, Artificial Sequence
  Artificial sequence: vector, primer or fusion gene
  misc_feature: p416-GAL1 vector (5538 bp single fragment)
ctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctctagtacggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaactataaggatccagctagcaaaatg

SEQ ID NO: 25097 - DNA, 4295 bp, Artificial Sequence
  Artificial sequence: vector, primer or fusion gene
  misc_feature: p416-GAL1 vector (4295 bp B fragment)
ccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctctagtacggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaactataaggatccagctagcaaaatg

SEQ ID NO: 25098 - DNA, 1626 bp, Artificial Sequence
  Artificial sequence: vector, primer or fusion gene
  misc_feature: p416-GAL1 vector (4295 bp B fragment)
ctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcgg

SEQ ID NO: 25099 - DNA, 16 bp, Artificial Sequence
  Artificial sequence: vector, primer or fusion gene
  misc_feature: yeast 5' ORF 5' primer conserved sequence
ggatccagctagcaaa

SEQ ID NO: 25100 - DNA, 16 bp, Artificial Sequence
  Artificial sequence: vector, primer or fusion gene
  misc_feature: yeast 5' ORF 3' primer conserved sequence
caggagctgcacttcc

SEQ ID NO: 25101 - DNA, 16 bp, Artificial Sequence
  Artificial sequence: vector, primer or fusion gene
  misc_feature: yeast 3' ORF 5' primer conserved sequence
tggaagtggttcagga

SEQ ID NO: 25102 - DNA, 16 bp, Artificial Sequence
  Artificial sequence: vector, primer or fusion gene
  misc_feature: yeast 3' ORF 3' primer conserved sequence
aattacatgactcgag

SEQ ID NO: 25103 - DNA, 60 bp, Artificial Sequence
  Artificial sequence: vector, primer or fusion gene
  misc_feature: 60 bp linker DNA sequence
ggaagtgcagctcctggtgcatcagctgctccaggtgctggttctggaagtggttcagga

SEQ ID NO: 25104 - protein, 20 aa, Artificial Sequence
  Artificial sequence: vector, primer or fusion gene
  misc_feature: 60 bp linker protein sequence
GSAAPGASAAPGAGSGSGSG

SEQ ID NO: 25105 - DNA, 26 bp, Artificial Sequence
  Artificial sequence: vector, primer or fusion gene
  misc_feature: PG0085 primer
actataaggatccagctagcaaaatg

SEQ ID NO: 25106 - DNA, 24 bp, Artificial Sequence
  Artificial sequence: vector, primer or fusion gene
  misc_feature: PG0095 primer
tgatgcaccaggagctgcacttcc

SEQ ID NO: 25107 - DNA, 24 bp, Artificial Sequence
  Artificial sequence: vector, primer or fusion gene
  misc_feature: PG0096 primer
ggttctggaagtggttcaggaatg

SEQ ID NO: 25108 - DNA, 27 bp, Artificial Sequence
  Artificial sequence: vector, primer or fusion gene
  misc_feature: PG0088 primer
gtgacataactaattacatgactcgag

SEQ ID NO: 25109 - DNA, 60 bp, Artificial Sequence
  Artificial sequence: vector, primer or fusion gene
  misc_feature: PG0055 primer
atatacctctatactttaacgtcaaggagaaaaaactataaggatccagctagcaaaatg

SEQ ID NO: 25110 - DNA, 60 bp, Artificial Sequence
  Artificial sequence: vector, primer or fusion gene
  misc_feature: PG0003 primer
tcctgaaccacttccagaaccagcacctggagcagctgatgcaccaggagctgcacttcc

SEQ ID NO: 25111 - DNA, 60 bp, Artificial Sequence
  Artificial sequence: vector, primer or fusion gene
  misc_feature: PG0004 primer
agtgcagctcctggtgcatcagctgctccaggtgctggttctggaagtggttcaggaatg

SEQ ID NO: 25112 - DNA, 60 bp, Artificial Sequence
  Artificial sequence: vector, primer or fusion gene
  misc_feature: PG0006 primer
gagcggatgtggggggagggcgtgaatgtaagcgtgacataactaattacatgactcgag

SEQ ID NO: 25113 - DNA, 25 bp, Artificial Sequence
  Artificial sequence: vector, primer or fusion gene
  misc_feature: PG0089 primer
cattttgctagctggatccttatag

SEQ ID NO: 25114 - DNA, 27 bp, Artificial Sequence
  Artificial sequence: vector, primer or fusion gene
  misc_feature: PG0090 primer
ctcgagtcatgtaattagttatgtcac

SEQ ID NO: 25115 - DNA, 24 bp, Artificial Sequence
  Artificial sequence: vector, primer or fusion gene
  misc_feature: PG0097 primer
ccgggtgtcataatcaaccaatcg

SEQ ID NO: 25116 - DNA, 24 bp, Artificial Sequence
  Artificial sequence: vector, primer or fusion gene
  misc_feature: PG0098 primer
ccgctaaaggcattatccgccaag

SEQ ID NO: 25117 - protein, 16 aa, Artificial Sequence
  Artificial sequence: vector, primer or fusion gene
  misc_feature: hypothetical linker peptide 1
GGGGSGGSGGSGGGGS

SEQ ID NO: 25118 - protein, 12 aa, Artificial Sequence
  Artificial sequence: vector, primer or fusion gene
  misc_feature: hypothetical linker peptide 2
SGGSSAAGSGSG

SEQ ID NO: 25119 - protein, 12 aa, Artificial Sequence
  Artificial sequence: vector, primer or fusion gene
  misc_feature: hypothetical linker peptide 3
SAGSSAAGSGSG

SEQ ID NO: 25120 - protein, 8 aa, Artificial Sequence
  Artificial sequence: vector, primer or fusion gene
  misc_feature: hypothetical linker peptide 4
AEAAAAKA

SEQ ID NO: 25121 - protein, 14 aa, Artificial Sequence
  Artificial sequence: vector, primer or fusion gene
  misc_feature: hypothetical linker peptide 5
AEAAAAKEAAAAKA

SEQ ID NO: 25122 - protein, 20 aa, Artificial Sequence
  Artificial sequence: vector, primer or fusion gene
  misc_feature: hypothetical linker peptide 6
AEAAAAKEAAAAKEAAAAKA

SEQ ID NO: 25123 - protein, 26 aa, Artificial Sequence
  Artificial sequence: vector, primer or fusion gene
  misc_feature: hypothetical linker peptide 7
AEAAAAKEAAAAKEAAAAKEAAAAKA

SEQ ID NO: 25124 - DNA, 37 bp, Artificial Sequence
  Artificial sequence: vector, primer or fusion gene
  misc_feature: pUC19 forward primer
ctgcagtctcgagtagttaagccagccccgacacccg

SEQ ID NO: 25125 - DNA, 37 bp, Artificial Sequence
  Artificial sequence: vector, primer or fusion gene
  misc_feature: pUC19 reverse primer
gctagcaggatccagctgtttcctgtgtgaaattgtt

SEQ ID NO: 25126 - DNA, 2391 bp, Artificial Sequence
  Artificial sequence: vector, primer or fusion gene
  misc_feature: pUC19 PCR amplified vector
ctgcagtctcgagtagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctggatcctgctagc

SEQ ID NO: 25127 - DNA, 16 bp, Artificial Sequence
  Artificial sequence: vector, primer or fusion gene
  misc_feature: E. coli 5' ORF 5' primer conserved sequence
gctggatcctgctagc

SEQ ID NO: 25128 - DNA, 16 bp, Artificial Sequence
  Artificial sequence: vector, primer or fusion gene
  misc_feature: E. coli 5' ORF 3' primer conserved sequence
caggagctgcacttcc

SEQ ID NO: 25129 - DNA, 16 bp, Artificial Sequence
  Artificial sequence: vector, primer or fusion gene
  misc_feature: E. coli 3' ORF 5' primer conserved sequence
tggaagtggttcagga

SEQ ID NO: 25130 - DNA, 16 bp, Artificial Sequence
  Artificial sequence: vector, primer or fusion gene
  misc_feature: E. coli 3' ORF 3' primer conserved sequence
ctactcgagactgcag

SEQ ID NO: 25131 - DNA, 1719 bp, Artificial Sequence
  Artificial sequence: vector, primer or fusion gene
  misc_feature: Y1-5A heat tolerance conferring fusion gene
atgcgccgcctatatcgtcatcttgcttcctttttcttactcccttcctgccctggaaacaccatacaatccatcacatcatatcctgccaatgcactattacgcagctttcggcacgtgagtacggaaacaccagttcggaaccgggtacacaatagggatagtcaaagctgtccattttttccgctgatggatgacggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25132 - DNA, 1998 bp, Artificial Sequence
  Artificial sequence: vector, primer or fusion gene
  misc_feature: Y1-7A heat tolerance conferring fusion gene
atgaagtgcactttagtttccacattgtttgccatcaccaatattctagttgcacatgcacaagtaagcaactcctcagacacgttggacgtacaatttgcgaatagtacgaactcgtacatagaaggaaaatttaattcgactgatgaagccttcaacagcagcgcatcttggtccttagcagctcagcagaaaaagatatctaatgcagctgtatatgatgtgggtggttggaatggctcattgtatcgttccaatagaagcgctgttgcagatcatcaacccggcaaaaagcaagatgccgctatttcacagatcagtgatggtcaaatccaagccactgcgtctggacctgagactaccgctgctactaccccaagtagtaccgcaaatgtctctgtctatgaaggtgctggtatgaaggttgaatccaagaacatgggttatatagttggagtagcagcgctattatttttaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25133 - DNA, 3120 bp, Artificial Sequence
  Artificial sequence: vector, primer or fusion gene
  misc_feature: Y1-13A heat tolerance conferring fusion gene
atggagcgattgaagcaactggaggaaaaaaggagacaattgaaagagctgcgtgagaggcgaaaacaagccagcttgttccctgggagcgagacgatgggccaccatcccacagaggtgcacgctaaggcaaccatggtcagcgtttcagtgcagaccgacatggaggaaggctcaaagattcaagagccccaatctgcatatcttcgacgtaaggaggttataacatacgacaaaggcattcaaacagatcaaattgaggaagaacaactgcaagaaaatgaaaatcacaccactactgatgctgtcgccattgaaactactgctgccgacgaaaataataaagacaaagctgaaaacgaccagccaaggttagaactagccaaaccttttcttgttgaagaggcggcggcaacgctgagcaacgctagttttgcgcggctggagacagaggtttctgcgtcaggccagcaggcgccatcgaacatgcaacaggataaagacaacctcatgcaatggaacatggtcagtgagaatttacaatcagagacagactgcgattgtatcgctcaggagtatgacccaggaaaaggcgtcttggttgtggtttatctacgattgccgccggcagacctacagtatgctagcagcgaagcggcgtggtctgtggtgaatgtagtcaagtgcgataatgccagcggacgcaacggcctcttgatagatatggtagagttccgtggtacgcggatcatgacagccacgatcctccgtcggtatcatccggaaagcaatgtaatatcaatcttgttggcgaccttgacgggcaagatcatattgtacgagcttagattgaaacagaaaaagccagaaacaccggtagtgtatgtcgtgcagcgaaatatggtggcaagacactactttcagcacccagtggtggctgtaattgaaacaagcagcgtgcaagatcaagagagagtacttgtggcagctgataatggcaatattatggagttgagctgcctggacttgactgttttgcggaagccacagcagctccgtcctgtaccgctatcacagcttttatctttggagaatgatacttgcacatatacggagcgattgcagcggttggcaaagtttgatgaggtaggtatagcttgcatggcgtacacgagtgaggacccgcagtacgtctggatcggtggcgaagacggtggtatatacaaggttttctgggaccaacctgggccgctgtacctctctttggacaacaatgggttccaacctgcagaaaaccactctacgagggtaaccgggttagagtttcattgggacgatgctcggcggctaatgcttctattatcatgttccacggactggacggtgcggctgtgggacgcgcgagcagggaaagctatcataggggcgccattgttgttaggggggcccgtactacgtgcacgctggctcgaaaaaaacaatggaggggaaaatagtcgcactctacggtgtcaagtgtggtgtgcagatggtcgcctcgttgttgtaaattgggctttcgatgctaagacgtccctctacacggccactgttatctccggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25134 - DNA, 2400 bp, Artificial Sequence
  Artificial sequence: vector, primer or fusion gene
  misc_feature: Y1-17A heat tolerance conferring fusion gene
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcagctgctccaggtgctggttctggaagtggttcaggaatggcatctgtgaacaattaccaggttgattgcgggtcaaggtctgctcgcattcaacccagaattaataacggcattcacgatgaagaatcgctatttgaagtcctggaactctcagaagaggaatttgagctagacttccatagattaaagtcattcaatgatgtaagggttatcaataacccagatttatctccagaatgtacaaatactgccattagtcgcgatgagacactggaatctgcaagtagtgccttcgaagttccttctgacgaaattgctatactgtcgatatccagtgacagcaataaaaattctccgccctcagagcagccggcgcccgctcttcgtaacattcgatcgtctagtaactctgaccggatcgatgagtggtgtttgggcagccatttatttaatgagctgcatcaaaatgtccctcaatcaagcgacggtgtcaatcatggatttcccgtttattcctttaaggaaagagaactttatacctctgcgaaattaaagaaacttacaaatgcccaaagaattgctgtgcagaaactatcaagagacttgtatccaattctaagaacatgctaccgcgagaaaactcgccggcaattattgacataccatcatgaaagaatatttgacgatataccatcttttttcccccagcgtgactttattttcaattactactcgatgcctcttgaattcgacaggttgtcagacgtagatatagattcgtcatcgcggtcacgatttacagatgagagcactggagaaacattaaaccgttcaccaagcgcagcgtcttcgtcgttggaaaacacatcttggtttggctggactttactttctaggtttttggacagagaatggtag

SEQ ID NO: 25135 - DNA, 2142 bp, Artificial Sequence
  Artificial sequence: vector, primer or fusion gene
  misc_feature: Y1-18A heat tolerance conferring fusion gene
atgagtaatgcaaacaatagtgctatgaaccacatcacgttgcctcccatctcgtcatttgacaaccttatcaaggcagccgagagacaatataatggcgaggcttcgtccgcctcgacacatccgacactgcctaatatgaacattagtaacggcagtggcagtgcgggcgcatcatcgtcgatgctgagctatcagttgcttccgcactccaatgatgtgtcccggtcgaactccagctcgagcttccttccctccgtgcagcagcctacggaaggttccgcttctgcatcggaaacttcttcatctgcatcaccttcacgttccatttcaccaattttaaaagtggctggtccttcatctgttggcggtgccggggtgagtaccccccatagcaccaaaatcaataagccaaggaaaaagaagcaatgtccaatttgtcgtaatttttatgccaatctgaccacgcacaaggcaacgcacttgacgccagaggatcggcctcacaagtgtcccatctgccaccgcgggttcgccaggaacaatgacttattgaggcataagaaaagacattggaaggatgagatactgtcccaatcgggagtactttcgaaccataatgatggtaagggaggatccgtttctcccaatgatgatgatacccatgaaaaaatgacaccgatgaattctgtcacagattatgcacaattgaaatcgttgcatcaaatcaagggcacattcaagtgcccattcaactccaccttaatacaattggacatggatatgtacccgtataaactgaaacctttaaattttgagacttccaattgtcaccagacgggggtgttctcacgttgcgacaccttcaaaaaccatttaaaggctttgcattttgaatacccgccaggcacgaagaaaaaggatagaaatgttgttcctggtagatgtaagcattgcggcctgaagttcgagaacgttgacgtttggctcaacgaacacgtaggtaaacaatgcggctataaataccatggaagtgcagctcctggtgcatcagctgctccaggtgctggttctggaagtggttcaggaatgaattggctgtttttggtctcgctggttttcttctgcggcgtgtcaacccatcctgccctggcaatgtccagcaacagactactaaagctggctaataaatctcccaagaaaattatacctctgaaggactcaagttttgaaaacatcttggcaccacctcacgaaaatgcctatatagttgctctgtttactgccacagcgcccgaaattggctgttctctgtgtctcgagctagaatccgaatacgacaccatagtggcctcctggtttgatgatcatccggatgcaaaatcgtccaattccgatacatctattttcttcacaaaggtcaatttggaggacccttctaagaccattcctaaagcgttccagtttttccaactaaacaatgttcctagattgttcatcttcaaaccaaactctccctctattctggaccacagcgtgatcagtatttccactgatactggctcagaaagaatgaagcaaatcatacaagccattaagcagttctcgcaagtaaacgacttctctttacacttacctatggactggactccaattattacctcgacaataattaccttcatcaccgtcttactcttcaaaaagcagtccaaactcatgttctccatcatatcttccaggatcatctgggcaaccttgtcaacttttttcatcatttgcatgatcagtgcctatatgttcaaccaaatcaggaatacccaattggcaggcgttggtcctaagggcgaggttatgtatttcttgcccaatgaattccaacaccaattcgccattgaaactcaagtcatggttcttatttacggaacattggccgcgttggttgtcgtattggtcaagggtatacaattcttgcggtctcatttgtatccagagaccaagaaagcgtacttcattgatgctattttggcctccttttgtgccttattcatttatgtcttctttgctgctttgacaaccgtgttcacgataaagagtcctgcttacccttttcctttactaaggttatcggcaccattcaaataa

SEQ ID NO: 25136 - DNA, 2697 bp, Artificial Sequence
  Artificial sequence: vector, primer or fusion gene
  misc_feature: Y1-19A heat tolerance conferring fusion gene
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcagctgctccaggtgctggttctggaagtggttcaggaatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttacgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcaagttctcatcggaacgaaattagtgactgaaggaattgacattaagcaattgatgatggtgatcatgcttgataatagacttaatattattgagctcattcaaggtgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtgtctgctga

SEQ ID NO: 25137 - DNA, 3336 bp, Artificial Sequence
  Artificial sequence: vector, primer or fusion gene
  misc_feature: Y1-20A heat tolerance conferring fusion gene
atgcagacgtcaatggtgagcgcaaaagttagtatatggctagtatgtagcgttatatgcagtagcctggtacgggctacgcaatctgtgtgttcgtcgcaaaacacagcgaccactgacggtgtacgaaatcaatttcagagtaatggttggtgttcaaataactgtgctggtcatcagtttgccatcgtacaggggttcatgtgctggtgcagtgattcggaaccgagcactcagacatcggtgggagactgcagtggcacttgtcccggttatggctacgaagattgtggtaatgcggataaggatctttttggttatatatatctggggcaaaccccgctaagttctgtacagagtgtggaaacgtcaacagagtccagtgtgtacgtttcaagtagctctatcacgagtagtagtagtacgagtattgtggacacaaccacaatctcgccgactctgacgtcaacgagtacgaccccattgacaaccgcctcaaccagtacaacaccatcaactgatataacatcggcactgcccacgactacaagcacaaagttgtcaacatccattcccacaagcacgacatcgtcaacctctaccaccacaagtacctcatcgtcgacttctacgaccgtaagtgtcacatcatcaacatctaccaccacaagtactacgtcgtcaaccctcatttccacgagcacatcatcatcatcatcatcaactccaaccacaacatcgtcagcccccatttctacaagcacgacgtcgtcaacttccacttcaacaagtacaacatcgccaacttcttcttcagcacctacaagctcgtctaatacaacaccaacgagcacaacgttcactacgacatcacccagtacagccccttcaagcactacggttacttacaccagtaccacagcatctccaataacgtccactataacttctgtaaacctgcagacctccttaaagtattctgtgataacagtgacttcagtgcacaccatggacactaacatttcggaaatcacctcgagatatctcaccatgaaaaaagtaataacgcagatttactcttccaccctcggggctactcctacttctgcagtggctactacgtctgccagcgtaggtggtagaataacaaacaataacaatagtaacaccaccaacagcaatacaccaactaacaagtctacagaaaagaaagggtactgggattcgcccgggaaaatagccgctactttcgtcgtggttggagtggtatgtttggtaattatatgcatactaatatacttaatacatcattatagaacaagacccgctcggaaggctcaagattttgagaatgaatatcagagtaagttttaccagtccaagtacccaaatgaagttaccactaccacgttacacacgccttcaccatcttcaaattcaactttctcgaccccaagattaatatacactgatgaaaagggacaaattatgtctgaatcaccatccccacgtcaatctacgtattccttgactgcaggcagtccaccaaatgacccaagcacgttggcaagcccatttcacgatcccattcttcccagaagaacttctacttttcttcattcgcccattcaaaagcaacacgaaaaaatggaatcaaacgttactctaggtgaagacacggtactggtggatcagaggctagacccaagtaagatgcttaacactttagcaaatgacgatgccacaaaccactctaccatttcgttatcagacaacgtagactactccaggagggttctgcggctaatgaacgaaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25138 - DNA, 2697 bp, Artificial Sequence
  Artificial sequence: vector, primer or fusion gene
  misc_feature: Y1-23A heat tolerance conferring fusion gene
atggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttacgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcaagttctcatcggaacgaaattagtgactgaaggaattgacattaagcaattgatgatggtgatcatgcttgataatagacttaatattattgagctcattcaaggtgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtgtctgcggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25139 - DNA, 2448 bp, Artificial Sequence
  Artificial sequence: vector, primer or fusion gene
  misc_feature: Y1-25A heat tolerance conferring fusion gene
atgtctgccgttttcaacaacgctaccctttcaggtctagtccaagcaagcacctactcacaaactttgcaaaatgtcgcccattaccaacctcaattgaatttcatggagaaatactgggccgcatggtacagttacatgaacaatgatgttttggccaccggtctaatgttctttttattgcatgaatttatgtatttctttagatgtttgccatggttcatcatcgaccaaattccatactttagaagatggaagttacaaccaactaagattccaagtgctaaggaacaactatactgtttgaaatccgttcttctatctcatttcttggtcgaggccatccctatctggaccttccacccaatgtgtgaaaaattaggtattactgtcgaagttccattcccatctttgaaaacaatggctctagaaattggtctattcttcgtcttggaagatacatggcattactgggctcaccgtctattccactacggtgtcttctacaagtacattcacaagcaacatcacagatacgctgctccattcggtctttctgctgaatatgctcatcctgctgaaactttgtctttgggttttggtaccgttggtatgccaattctttacgtcatgtacactggtaaattacacttgttcactctatgtgtatggatcaccctaagattattccaagctgttgactctcattctggttatgacttcccatggtctttgaacaagatcatgccattctgggctggcgctgaacaccacgatttgcatcatcactactttattggtaactacgcttcctctttcagatggtgggattactgtctagacactgaatctggtccagaagctaaggcctccagagaagaaagaatgaagaagagagctgaaaacaatgctcaaaagaagactaacggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25140 - DNA, 2022 bp, Artificial Sequence
  Artificial sequence: vector, primer or fusion gene
  misc_feature: Y1-28A heat tolerance conferring fusion gene
atgaacaacgagactagtggtaaagaaacggcgtctgcacctctgtgttcgcccaagttacctgtagaaaaagtgcagagaatagccaagaatgatccagaatatatggacacttcggatgacgcattcgtagccacagcgtttgctacagaattcttcgtccaggtgctgacacatgagtccctacataggcaacagcagcagcaacaacaacaggtaccgccgctcccagatgaactcacgctgtcgtacgatgacatctctgccgcaattgtgcactcttctgacggccatctgcagtttttgaatgatgtgataccaacaacaaagaatttgaggcttctagtggaagaaaaccgagttagatatactacaagtgtcatgccccctaatgaagtttactccgcctatgtggtgaacgatacggctccgaagcccaacattgtcgagattgatcttgataatgacgaagacgacgacgaagacgttactgatcaagaaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25141 - DNA, 2217 bp, Artificial Sequence
  Artificial sequence: vector, primer or fusion gene
  misc_feature: Y1-33A heat tolerance conferring fusion gene
atgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctcggaagtgcagctcctggtgcatcagctgctccaggtgctggttctggaagtggttcaggaatgtccgataaagttattaaccctcaagttgcatgggctcaaaggtctagtactactgatccagaaagaaattatgtcttaataactgtgtcaattgcagactgtgatgcccctgagttaaccattaagccatcatacatcgaattaaaggctcaatcaaagcctcatgttggcgatgaaaatgtccatcattatcaattacacattgatctatacaaggaaattatacctgaaaaaacaatgcataaggttgctaatggccagcactactttttgaaattgtataaaaaggatttagaatctgaatactggccacgtttgacaaaggaaaaggtgaagtacccttacatcaaaactgatttcgataaatgggttgatgaagatgaacaagacgaagttgaagctgaaggtaatgatgccgctcaaggaatggatttcagccaaatgatgggaggtgctggaggtgctggaggtgctggaggcatggacttcagccaaatgatgggaggtgctggtggcgctggttctccagatatggctcaattgcagcaattattggctcaaagcggtggtaatttggacatgggagatttcaaagaaaacgatgaagaagatgaagaagaggaaatagagccggaagtgaaagcttaa

SEQ ID NO: 25142 - DNA, 2170 bp, Artificial Sequence
  Artificial sequence: vector, primer or fusion gene
  misc_feature: Y1-38A heat tolerance conferring fusion gene
atggtagtatccatcataccgcaatttcctgatatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacaaagagcaattgaggacgattatgacttctatagtaaaaggacaagagatcgagtttaatgatgacaatttatcgagattttatgacgaagcgctcataagaaaagtatgttttaataataaattcgaggtaaaaacttcaacagcctcaccagaaacacattgtactaacttcacctttgttttccttttattttgtttttacctattagatctataaattaagtgatgatttcaagccccaagacgtaaatggtctctcaagagctttggtagacgctattcaattgaggggtgtgggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25143 - DNA, 1635 bp, Artificial Sequence
  Artificial sequence: vector, primer or fusion gene
  misc_feature: Y1-39B heat tolerance conferring fusion gene
atgtccctacggccttgtctaacaccatccagcatgcaatacagtgacatatatatacccacacactctctcacatctacctctactctcgctgtcataccttacccggctttcggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25144 - DNA, 3462 bp, Artificial Sequence
  Artificial sequence: vector, primer or fusion gene
  misc_feature: Y1-40A heat tolerance conferring fusion gene
atggaagctggcaggagtgctgatgaagtgctataccacaatcagtcgtcagtaaagttaggtgagttagaaagatacgttattacatatgagctataccagggtgatagtattcccgctgatatcacactggattccctatgggtaaagatcaaaaataccacaaagctatcctataaaccagcctatctattgggcccatttatcttatattgtgacgtgcgagcaaaagattacgaaagctcgtataagatcatatgttcggcggataaaccagtatttcaatcaaacctacaggcacaacaaaagtttattgcagagttgtccttgcaccacattaagccacgctatgtatggatagtggatattgtcagtcaaatactatttaataaagaaactaaggtaacttttgagatagtagtcggcaattcaaaggcctctttgaaaagaaaaatacgatgtaatgattcattgcctgataaagcctgcaatattttacacacaggattatcggtgcatagacttaccaccgcagatatatggaaagtaccacgacccatagacatgtcgcaaaaatcccatttagtcattctcacgcatggttttcaatcaaacgtttcggcagatatggaatacttaatggaagaaatatacaaggctcaaatgaacaatccaaatgagcgactagttattaagggatatatgaagaatgcttgtgagactgagaagggtattaagtttttgggtgttggattggcaaactacatcatcgacgagttatatgatgactctgttgggaaaatttcatttattggtcattccctgggtggattaacacaaacttttgctatttgttacataaagaccaaatatccatatttctttaagaaagtggagccaatcaattttatctcactggcgtcaccattgctaggcattgctaccagcacgcccaattacgtaaaaatgtcattgtcgatgggtatcattggtactacggggcaagaactgggtcttaaggatggaaattatggtgataagcccctactttacctgctatccgaggaatccttaatcagtgtgcttgctcgattcaaaagaagaacactttatgctaatgccgtcaacgacggaatagttcccttgtactcctcttctttactttttttggactactctcaattacttcagaaactgggaggtcaaactacggcaccttgtgatcctctcttccagcctgaagtaagtcctattggggaacttccaaatcatagcgatgttgctaatgatgatgatggaatcaatgcatcgtcatggaacacgttttggaagagcaaggaaaataactgcgacaagaaatctaaacgcttgatgaatgcttccgtcatcaaatctatgaagtctgtgcttctatcaccatgccccgacgcaaagttcttctcagatcccgatgcaagggtcgcaacaatcatacatgataagatctacacagaaaagaatttaccgcctccatcaccaacactttatgaaggaacagcagccaaggaaggcgaaacgaggaagacgagaaaagagatggaggaaatcatagcacgccgctggcacaaggggatgcattggaggaaagtcgtggtattgctgaaaccagatgcccacaataacatcatcgtaagaagaaggttttccaacgcttacggctggccggtggttgaccaccttgttaccgcccatttccaaagagatgacccaatcgcctcaccaatgcaagataaacagtttgctgaggaagatataaacatggcaaccggaggggtggaaccaaacaagttctactcatggctcaccaagatcgaggatcctagtgtgtaccatggtggaatagtctccacagctagccagctcgccagctcctggattagcaagcattcctctgtgacagatggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25145 - DNA, 1668 bp, Artificial Sequence
  Artificial sequence: vector, primer or fusion gene
  misc_feature: Y1-43A heat tolerance conferring fusion gene
atgtggagacgtcggcgcgagccctgggaggagttatcttttcttcttaacagcttatcaccccggaattggtttatccggagatggggtcttatggctggaagaggccagcacctttgctggctccggtgcgcttgtgacggcccgggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25146 - DNA, 2316 bp, Artificial Sequence
  Artificial sequence: vector, primer or fusion gene
  misc_feature: Y1-45A heat tolerance conferring fusion gene
atgagtggcacgaggtgtttgctaggcgtcggactaccagttgatgtgactgctacggaaactttgactcatgatgaacaaggaccaggtgtagagccaggaccgtgttcgcgaggaagttctatagatggtctgctgccctcgttgctcggtccacatgatgatgtggatgacgattcggcggcttttcacaagtacatgacactatcgcgagatggcgcaggcgccatccatgctccgtcattagtcgaagacgcctcaaggaacgacgacgacgacgatgatgaagacgacgacgacagttccatgtcgcgagacctatccaaggctctagatatgtcatcgtcatcatcgtccagcccgcgcgttcaaagtcggcggcaccgtagttctgtgagcgcaatatctgcaatcttacaccaaggaaaatctggccgcgaagacataactggaagccttagcgttccggcagaacaagaaaaactcagttttcttgccaaagcctcgagtattttctttcgaaggaacagtatgcccagagacaaacatacgcattcagtatgtcccgctagccgcccagattccgagagatttatcgtcacatctgcagccgcgcagtctttacgccgccaacaacaactggaagacgctcagtacgctcgagttattacaaactttcgtactataggatggtgctctcccagcgagatagagtctgtggaatataaacggtccttgatcaatgcggagtgggacgaaaagatctcgcttttgtctcacgcgcaatgctataaaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25147 - DNA, 2184 bp, Artificial Sequence
  Artificial sequence: vector, primer or fusion gene
  misc_feature: Y1-47A heat tolerance conferring fusion gene
atggccagcatagacgcattttcggaccttgagcgccggatggacgggttccaaaaggacgtggcccaggtactggcacgtcagcaaaaccacgcgcgccaacagctgcaacagttccaagcggaaatgcgtcaattacataaccaacaccaacatctcatagatgaactgcaacggcttgccacccagcgcaccgctctgcagcaacaaatacatgcggcccaacaagctacaaataccaccagagagcagtggagaagctatcacgagcgtgaatctgagttatctagacggcagtcgaccttagcagcccaatcgcgcgagctggactcgctgctgcaacagcgtggtaaagagtgtgtccaattacgcgcacgttgggctgcgcagtcgggtaacgatgccgcagaggtcgcactgtacgaacggctgttgcagcttcgtgtactacccggagccagcgatgtgcatgacgtacgtttcgtattcggcgatgattcacgctgctggatcgaagtcgcgatgcacggagaccacgtgatcggaaactctcacccggcgctggaccccaagagtcgggcaacacttgagcacgtgcttaccgtccagggcgacctcgcggcatttttagtcgtggcccgcgatatgcttctggcatctttaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25148 - DNA, 3147 bp, Artificial Sequence
  Artificial sequence: vector, primer or fusion gene
  misc_feature: Y1-48A heat tolerance conferring fusion gene
atgggcaatcagtcattagttgtgcttacggaaagtaagggtgagtatgagaatgagacagaactacctgttaaaaaatcgtcacgagataataatatcggagaatctttaacagcaacagcttttacgcagtctgaagatgaaatggtagatagcaatcagaaatggcagaacccaaactattttaaatatgcatggcaagaatatctttttatattcacatgcatgataagtcagcttctaaatcaagcaggcactacacagactctttcgatcatgaatattctttcggacagttttggctcagaaggaaactcaaagtcatggctgatggcatcttttccgctagtttcaggctcatttattttgattagtggcagactaggtgacatatacggattaaaaaaaatgttgttagtaggatatgttctggttattatatggtctttgatttgtgggattaccaagtattctggtagcgatactttttttattattagtagagccttccaagggctagggattgcatttgttttacctaatgtgctgggaataattggtaatatatatgtaggtggtacttttcgtaaaaacatcgtgattagttttgttggtgcgatggcccctattggagcaactttaggttgtctttttgcaggactgatcggtaccgaggacccaaaacaatggccatgggcattctacgcgtatagcatagccgctttcattaattttgtgctctccatatatgccattccgagtactataccaacaaatattcatcatttttctatggattggattggttctgttttgggcgtgataggtctcattttattaaattttgtgtggaaccaagctcctatatcgggttggaaccaggcttacatcatcgtaattttaatcatttctgtgatttttcttgtcgttttcatcatttatgagattcgatttgccaagactccactattgccgcgcgcagttataaaggatcgtcatatgattcaaattatgctggctttattctttggatggggctcttttggcatctttacgttttattatttccaatttcaattaaatataaggcagtacacggcattatgggctggtggaacttactttatgtttttaatttggggtattattgccgccttactggtaggatttactatcaagaatgtgtctccatcagtgtttttgttcttttctatggtagcattcaatgtgggctcaataatggcaagtgttacaccggttcacgagacatactttcgtactcagttaggaacgatgataattttaagttttgggatggatctttcatttcctgcttcttccattatctttagtgataatttaccgatggagtaccaaggcatggctgggtcattggtgaatactgttgtcaattactccatgtccttgtgtctcggtatgggtgccacagtagagacacaggtcaattcagacggaaagcatcttttgaaaggctatagaggtgctcagtaccttgggataggattggcaagtttagcatgcatgattagcgggctttacatggtcgaaagcttcataaaaggccgcagggcaagagctgctgcagaatacgattgcactgtggctggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 25149 - DNA, 2268 bp, Artificial Sequence
  Artificial sequence: vector, primer or fusion gene
  misc_feature: Y1-58B heat tolerance conferring fusion gene
atgtccggaaaagcttctacagagggtagcgttactacggagtttctctctgatatcattggtaagacagtgaacgtcaaacttgcctcgggtttactctacagcggaagattggaatccattgatggttttatgaatgttgcactatcgagtgccactgaacactacgagagtaataacaataagcttctaaataagttcaatagtgatgtctttttgaggggcacgcaggtcatgtatatcagtgaacaaaaaataggaagtgcagctcctggtgcatcagctgctccaggtgctggttctggaagtggttcaggaatgtctagagcagttggtattgatttgggaacaacttactcgtgtgttgctcatttttccaatgatagggtagagataattgcaaatgatcaaggtaataggaccactccatcgtatgtggctttcacagacaccgaaagattaattggtgacgccgccaaaaatcaagctgcaatcaatcctcataatacagtttttgatgcaaagcggttaattggtcgtaaatttgatgatcctgaagtgacgacagatgccaagcacttccctttcaaagttatatccagagatggtaaacctgtagtgcaagtagaatataagggtgaaacgaaaacatttacgcctgaggaaatttcttccatggttttaagcaaaatgaaggaaactgctgagaactatttgggaactacggtcaatgatgctgttgtaactgttcctgcatatttcaatgattctcaaagacaagccactaaggatgcaggaactattgcagggatgaacgttttacgtattatcaatgaacccactgcagcagcaattgcttatggcttggataagaaaggcagggctgagcacaatgtcctgatttttgatttgggtggtggtacttttgacgtctctttactttcaattgatgagggtgtttttgaggttaaggctaccgcaggagacactcatttaggtggtgaagattttgataataggttggtgaaccatttagccactgaattcaaaaggaaaacgaaaaaggacatctctaataatcaaagatcgttaagaagattgagaactgcggcagaaagagctaagagagcgctttcttcctcatctcaaacctcgatcgagatcgattctttatttgaaggtatggatttctacacttcgttaacaagggcaaggtttgaagagctatgtgctgatttattcagatccacattggaaccagtagaaaaggttcttaaagattcgaagctggacaagtcccaaattgatgagattgtgttagtcggtggatctaccagaatcccaaagattcagaaattagtttctgacttcttcaatggcaaagagcctaatcgttctatcaacccggatgaggctgttgcttatggtgcagccgttcaagctgccattttaaccggcgatcaatcaacaaagacacaagatttactattattggatgttgcgccattgtccctaggaattgaaactgcaggcggcataatgactaagctaattcctagaaactcaacgattccaacaaagaaatcggaaaccttctctacctatgcagataatcaacctggtgttttaattcaagtctttgaaggtgaaagaacaagaacaaaggataataacttacttggtaaattcgaattaagtggcattccgcctgctcccagaggtgtgcctcaaattgatgttacctttgatatcgacgctaatggtattcttaatgtgtctgctttggaaaagggtactggtaagagtaacaaaatcacgatcactaacgataaaggtaggctctcgaaggatgatattgataggatggtttctgaagctgaaaaatatagggctgacgatgaaagggaggcagaacgagttcaggctaagaatcagcttgaatcgtatgcatttactttgaagaataccataaacgaagcaagtttcaaagagaaagtaggtgaagatgatgcaaagagattagaaacagcgtctcaggaaaccattgactggttagatgcatcgcaggcagcctctacggacgaatataaggatagacaaaaggagttggaaggcattgccaatccaataatgacgaaattttacggtgctggtgccggcgcaggtcctggagcgggggaatccggtggattccccggatccatgcccaactcgggtgctacgggaggtggagaagatacaggtccaacagtggaagaggttgattga

SEQ ID NO: 25150 - DNA, 2511 bp, Artificial Sequence
  Artificial sequence: vector, primer or fusion gene
  misc_feature: Y1-58C heat tolerance conferring fusion gene
atgctggcacaaacattcaaaaaaccacacagagccgttctagaacaggtatctgggaccacggtcttcatcagaaataagagaacaaagagcaagagctcactgtcacctttggcacaaagggtcgtcacgcagttgagtgtgatgtctgcaagcagaaagcagcccaagttgctgaagctggcgcgtgaagacctgattaaacatcagaccattgagaagtgttggtcaatttatcagcagcaacaacgggagcgcagaaatttacagttggaattacaatataagagcattgagagatctatgaaccttctacaagaactcagccctcgtctgtttgaggctgccaatgcttccgagaagggcaagcgattcccgatggaaatgaaggtgcccactgacttccccccaaatacgttatggcattataacttccgaaaaggaagtgcagctcctggtgcatcagctgctccaggtgctggttctggaagtggttcaggaatgctgcgtgtaacaaccttggcgtcttcgtgtacttcatttcccttacaggtcctcaggaggcggttgaccatatcttctttgacaagcttccaacccacaaccaagacacaggtcgtggtcatcggtgctggacatgcaggctgcgaagctgcagctgcgtcatctaggactggtgcgcatactactctcattacaccatcgttaacagatattggtaagtgttcgtgcaacccctctattggtggagtgggtaagggcatccttgtaaaggaaatcgacgctctcgatgggctgatgggcaaagtaactgatctcgctggagtgcaattcaaaatgctgaacagaagcaagggtcctgctgtgtgggggcccagagcccagatagacagagagttatataagaaatacatgcaaagggaactttccgacaagaaagcacaccccaacttgtctctgctgcagaacaaagttgctgacttgatcttgtatgaccccggatgtggccacaaggtcatcaaaggtgtggttctggatgacggtacccaggttggggcagatcaggtcataatcactacaggtacgtttctcagtgcagaaattcacatcggcgacaagcgtattgcagcaggaagaattggcgagcagccaacatatgggatcagcaatactctacaaaatgaggtgggctttcagttagggcgtttgaaaacaggcactccggctaggctggccaaggaatccattgatttcagcgctctggaggtccagaagggagatgcgttgcctgtccctatgagttttctgaatgaaaccgtgtcagtcgaacccacgaagcaactggattgctttggcacacataccacacctcaaatgcacgactttttgcgcaataacttgcatcaatccattcatattcaggacacgaccatcaaaggcccccgctattgtccctccatcgaagctaagattctaaggtttcctgatagatcttcccataagatatggttggaaccagaaggtttcaactccgacgtcatttatccgaacgggatatccaattctatgcctgaggatgtccagttacaaatgatgaggctcatcccgggcatggcaaacgttgagatcttgcagccggcatacggcgtggaatacgactacgtagacccacggcaattaaagcctagcttggaaacaaaattggtggatggactattcttggccggacaaataaatggtactacaggctacgaggaagccgctgcacaggggatcattgcaggtatcaatgcaggattactatcgcgccaagaacgggagcaattggtcttgaaaaggtccgaagcgtacattggtgtgctcattgacgatctaatcaataatggcgtcatagaaccatatagaatgtttacttccagatcagaattcagaatcagcgtaagagccgataacgcagacttcagactgacgcccattggtgctcaactagggattatatctcctgtccgtttaagtcaatattcaagagacaagcacctatatgatgaaacaatacgggcgcttcaaaatttcaagctaagctctcaaaaatggtctagcttactacaggctaatatcgcgccacaggctgaaaacagatctgcttgggaaatattcagattcaaagatatggatctacataaactctacgagtgcattcccgatttacccattaatttgctggacatcccaatgcatgttgtcaccaaaattaacattcaaggtaaatacgaaccttacattgtcaaacagaaccagtttgtgaaggcatttcaggcagacgaaaatatgctgttgccgcaagattacgattaccgtcagttacccacgctttccactgaatgcaaactactcttgaaccgcgtacagccattgaccataggccaagcaagacggattcaaggtatcactgcggcagccctatttgaactctaccgtgtggcacggaagccaagccaaccagtcatgtaa

SEQ ID NO: 25151 - DNA, 2568 bp, Artificial Sequence
  Artificial sequence: vector, primer or fusion gene
  misc_feature: Y1-66C heat tolerance conferring fusion gene
atgaccttgtggccacatccggggtcatacaagatcaagtcagcaactttgttctgcagcagagacaagttggggtgtgctttcttgtcggaaagttccctttgcatgtatttcttatataactctctgtctatctgggctctgggcccccacacagcaggacccttgcttctgttcagcattttgaattgcactccagcgagatcagttactttgcccatcagcccatcgagagcgtcgatttcctttacaaggatgcccttacccactccaccaatagaggggttgcacgaacacttaccaatatctgttaacgatggtgtaatgagagtagtatgcgcaccagtcctagatgacgcagctgcagcttcgcagcctgcatgtccagcaccgatgaccacgacctgtgtcttggttgtgggttggaagcttgtcaaagaagatatggtcaaccgcctcctgaggacctgtaagggaaatgaagtacacgaagacgccaaggttgttacacgcagcatcgttctttggggcgttggaagtgcagctcctggtgcatcagctgctccaggtgctggttctggaagtggttcaggaatgcttaaatctggtagactcaactttctcaagttgaatatcaattcacgattactatactcaacgaaccctcaactgactaagaaggtcattggtatcgacctgggtaccacgaatagtgctgttgcatatatccgtgattctaacgacaaaaaatcagctacaatcatagaaaatgatgaaggacaacgaaccacaccatctatagttgcctttgatgtcaaaagctcgccacagaataaagatcaaatgaaaactcttgtagggatggcagctaaaaggcaaaatgctattaattctgaaaacactttctttgctacaaagagacttattggccgtgcattcaacgacaaggaagttcagcgagatatggctgttatgccatataagattgtcaaatgtgagtcaaatgggcaagcctatctcagcacgtctaatggtctcattcaatcaccaagccagatagcatctatattactgaaatacctgaaacaaacttcagaagaatacttaggcgaaaaggttaatttggcagttattacagttccagcatattttaatgattctcaaaggcaagccacaaaagatgccggcaagttagctggcctaaatgttttgagagttattaacgaaccaactgcggccgccttaagctttggaattgatgataagaggaataatggattaattgcagtttacgatttgggtggtggtacatttgacatatccatcttggacattgaagatggcgtgtttgaggttcgtgctactaatggtgacacgcatttaggtggagaagattttgacaacgtcattgtaaactatattatagataccttcattcatgaaaaccctgaaattacacgggaagaaattacgaagaacagggagacaatgcaaaggttaaaagatgtttctgaaagagctaagatagatttatcccatgtgaagaaaacttttatcgaacttccatttgtatacaaaagcaaacatctacgagtgccaatgacagaggaagagctggataatatgactttgtcattaatcaacaggactatcccacctgtgaagcaagcattgaaagatgccgatatcgaaccggaggatatagatgaagtaatccttgttggtggtatgacccgtatgccaaagattagatctgttgtaaaagatctttttggtaagtctccaaattctagtgttaacccagatgaaacagttgctttaggagcagctattcaaggtggtattctatccggtgaaataaagaatgtcttacttttggatgtgacaccattgacattagggattgaaacatttggaggagcgttctcacccttgatacctagaaatacgacagttccagtaaaaaaaacagagatatttagtactggtgttgatgggcaagcgggtgttgatatcaaagtttttcagggtgaaagagggttagtgcgtaacaacaagttgattggtgatttgaaacttacaggaatcacccctttgcctaaaggcattccccaaatatatgttacttttgatatcgatgcggatggtatcatcaacgtatctgccgctgagaaaagtagtgggaaacaacaatccattactgtaataccaaattctgggttaagcgaagaggaaattgcaaaacttattgaagaagcaaatgcaaatagggcacaagataacttgatcaggcaaaggttagagcttatctctaaggctgacattatgataagtgatactgagaatttatttaaaagatatgaaaaactgatttctagcgaaaaagagtattctaatatcgtagaggacatcaaagctctgagacaagctataaagaattttaaggctaacgaaaatgacatgtcaattgatgtaaacggaataaaaaaagctacggatgcgctacagggtagggcattaaaattattccaaagcgcaacaaaaaaccagcagaatcaaggtaaataa

SEQ ID NO: 25152 - DNA, 2310 bp, Artificial Sequence
  Artificial sequence: vector, primer or fusion gene
  misc_feature: Y1-67B heat tolerance conferring fusion gene
atgcagattttcgtcaagactttgaccggtaaaaccataacattggaagttgaatcttccgataccatcgacaacgttaagtcgaaaattcaagacaaggaaggtatccctccagatcaacaaagattgatctttgccggtaagcagctagaagacggtagaacgctgtctgattacaacattcagaaggagtccaccttacatcttgtgctaaggctaagaggtggtatgcagatctttgttaagactttgaccggtaaaaccatcactttagaggttgaatcctccgacacgatcgataacgttaagtcgaaaatccaggacaaggaaggtatccctccggatcaacagaggttgatctttgccggtaagcagctagaagatggtagaaccttgtctgactacaacatccaaaaggaatctactcttcacttggtgttgagactgagaggtggtatgcaaatttttgtcaagacactgacaggtaagactataaccctagaggttgaatcttctgacactatcgacaacgttaagtcgaaaattcaagacaaggaaggtattcctccagatcaacaaagattgatttttgctggtaagcaactggaagacggtagaacgctgtctgattataacattcagaaagagtctacgttgcatttggtgttgagattgagaggtggtatgcaaattttcgtcaaaactctaacagggaagactataaccctagaggttgaatcttccgacactattgacaacgtcaaaagtaaaattcaagataaagaaggtatccctccggatcaacagagattgatttttgctggtaagcaactagaagatggtagaaccttgtctgactacaacatccaaaaggaatctactcttcacttggtgttgagactgagaggtggtatgcaaatttttgtcaagacactgacaggtaagactataaccctagaggttgaatcttctgacactattgacaacgttaagtcgaaaattcaagacaaggaaggtattcctccagaccagcaaagattgatttttgccggtaagcaactagaagatggtagaacgctgtcggactacaatattcaaaaggagtccactcttcaccttgtcttgaggttgaggggtggtaacggaagtgcagctcctggtgcatcagctgctccaggtgctggttctggaagtggttcaggaatgccaggccagataatcagcattccgtttttgtcgcagaacgaggacatggataaatacttgttggagtaccgcagtttgaagctccttcatcagtccagtaattccttccagtctcacaatgcgccctcccaccagtcgaactaccacccccattacaatcacatgaaatacaacaacactggtagctattactattacaacaacaacaataacagcagtgtaaacccacataaccaagctggtctacaatccattaacagatctattccatcggccccgtacggggcttacaaccagaacagagctaatgacgtaccatatatgaatacccaaaagaaacaccacagatttagcgctaacaataatttgaaccagcaaaaatacaagcaatatccccagtatacgtccaatccaatggttactgcacatctgaagcaaacgtaccctcaactgtactacaatagcaacgtcaatgctcacaacaacaacaacaacagcaacaacaacaacaacaacaacaacaacagcaacaacaacaacaatctttacaaccagacgcagttctccacgaggtacttcaactcgaactcctctccctcgttgacttcttccacttctaactcatcctctccatacaaccaaagcaccttcgaatacattttgccgtcaacttcggcagcttccacaaatttatcgtcgtcatcatcaaacaactctatgcacaccaacccaaccactgcaacatcgacatccgccgatttaatcaatgatttacccgtgggccccacgtccagttcgcttatctcggatctacattctccaccaactgtatctttcctaccagcaagccaaaccctgctcatgtcctccaccacatctagctctattggcaccaacataaacccaccgcaacattcaccatccccatcgcaaagggaggatttttcgacggcaccagtgaacatgtcttcgtccgcatcactcttgatgaatgattcttctttaggatgggggtctaaccacatgaacgtatcttcatcctctcaaccagcatcatcaagaccctttggcatttggaatactgacatgagcgtttggagttga
